United States Patent 7,560,542 (NUCLEIC ACID MOLECULE SEQ ID NO. 68811 AND OTHER MOLECULES ASSOCIATED WITH PLANTS) - sequence listing, part 7

SEQ ID NO: 37966 - DNA, 279 bp, Zea mays
  Clone ID: LIB3060-030-Q1-K1-B9
aattacggatcgacccacgcgtgcgtttgtgtgtatgtatgagagtctttgtgcatttcgcgagcgcgaagggcacgcccggtaagctgtcctatgacgagagccagatcaaaacgtacatgtatgtaaagggcactgactcggctaaccagtgctggaccatcgacagttgcttcttgtcgttatcgatcaaggccggtaagaaccatatgaagaagctttgactgtaaccgacgtccatgaccgccaaggcaaagggcatctccaagtactcgtctt

SEQ ID NO: 37967 - DNA, 408 bp, Zea mays
  Clone ID: LIB3060-030-Q1-K1-C11
aatcaccgggtcgacccacgcgtgcgggaatgcatcgccagcgacgtcttcgtccgttgactcccccggcccatcctcctgggcctcgagtcccacgctcgcgcccctcatcgccgcgcagctcaactacctactctcgcactacaagctgcccattaaggcggtacagatctcgtcctactgccgcaacggtcgccctgccaatcgtgctaagctcgccatgaccttctgcctgcactaccttcactgggatcgcgtgtacaatgcgctgcctcccaaggaggcaccagacatggagttcccaacgtaagatgagaggatccagccatttgtcgattacactgctgctggaaatggcgataagagctgctaggcgctttcggattgccccgcccacgaaggactaca

SEQ ID NO: 37968 - DNA, 376 bp, Zea mays
  Clone ID: LIB3060-030-Q1-K1-C6
aagcccagcacgatcacccactccctgacgtttaagacactcgctggacccaaaaactgtcgcatgcgcatcctcgcgaccggtcaacgcgggtacacgactcagctacgagtcgatgctccagcgccagatccagagccgattccagcacccactccaacgcgcgctgcagcaacggcccacccgaccaaaaaaccccaactgtaaggccccgacaacaaaccgcttctagcctacaaggcgaatggcggtctgaagctgctcaatccggccaccggcagcataccccgtaacgacgggcaactcctaaccataaaacatgccagcaaaagtcgcatcaacagccaaaccatggcccttggaaccggcgaccttc

SEQ ID NO: 37969 - DNA, 91 bp, Zea mays
  unsure at all n locations
  Clone ID: LIB3060-030-Q1-K1-D1
cctgaattcccgggtcgaaccaagccttccgnccaagaccagggtcaaggaggccataacaacttgatccgccaaggtcaacaaccccagg

SEQ ID NO: 37970 - DNA, 334 bp, Zea mays
  Clone ID: LIB3060-030-Q1-K1-D11
accggtccggaattcccggggtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcatgtgaagacggccgtcacggacgggtacgacgccgtccaggtcgggtaccac

SEQ ID NO: 37971 - DNA, 302 bp, Zea mays
  Clone ID: LIB3060-030-Q1-K1-D12
ggatcaaaaaggctgactccattgcaaagcgaaatcctgctgtaaaaatacatacatcaggatcagggcatcgtccaccttcaccggataggacgacggccgatccatatactatacacagttttcgatccaatcgaaccctaacatcggtggatccatcatcatcacagctcacaacaacatgtacttaattaacaacaacggttggacgcttgttggttgcttaatcctgctaattaacacgctactagcaaaaacacgagaagatgatgatgaacaggagcagaagctcggtatcatca

SEQ ID NO: 37972 - DNA, 317 bp, Zea mays
  Clone ID: LIB3060-030-Q1-K1-D6
tatacgaccaccgcgtcaaatgcatatgactttagctggaggacgtactgccatggcgagttcgcgagcccttcaccgcagtatgacacttgcttgggagacctgtatagtgttgcttggatggaagacagtgatttccacaatctgcgaactgaatctttcagccaccaatccacctggtccaaggttagaaaagtgttcaaggttccatcaacttttggttccaatttaatccattatggttaattgaattggaatgtaaaccttttgtttcgtaccattgccccaaaccttgttaccgttaccaccccttcatt

SEQ ID NO: 37973 - DNA, 411 bp, Zea mays
  unsure at all n locations
  Clone ID: LIB3060-030-Q1-K1-G1
tccgaattcccaggcaggcaggtcggcgaggatggcaggaagaccgaagaccgagccgtgcggtggctcgggacgggaacgggacaggaccccaaaatctcagatccttcctgcccgcccgcccgtgcccgtcgacgcgtcgttcttgccggcgngcctcacctccgccttttctcctcaaggggaatcgatacgccaaaagcttggccaaggtgcttggggtcttcggctaccggttccttatctggaaccccggcttcgacttcgacgaccaaattcttgggttcatcaagggctacaagcgcaactttaatcttgcttgcattgaccacagaagcacaacggagcattcggcgaggacctggacgcttgaaaccgacgaccaagccatatgctggggaattgcatatt

SEQ ID NO: 37974 - DNA, 357 bp, Zea mays
  Clone ID: LIB3060-030-Q1-K1-G2
caagcttggataaggaattcattgcgaaagctataactttgcctggtcaaggggagattatggatatgatggaagttgcagatcctgatgcagttcatgctgtccgtaactttattaagaaggagcttgccgtgcaacttaaagatgatcttcttgcggctgtgaaaagcaacaggagttctgaggcttacacatttaaccatgatagtatggctcgccgtgcattaaaaaatacatgccttgcatacctggcgtaattgaatgacccaaatttcgttgaccttgcactgattgagtccaagtttgcaattaccttgccgaaccagttggttgaattaccagcttattccaaaattc

SEQ ID NO: 37975 - DNA, 396 bp, Zea mays
  Clone ID: LIB3060-030-Q1-K1-G4
tgatttgcaaggaagcattgatcggcagatgtagctccatgatagagtctacaactgctgaagcggaagcgttgtctaaaggactacagactatataaaatgacgatttggaggaaattagagagctgggttcaggtacttatggagcattttatcatggtaaatgaaaaggatgtgaatttcgcttgttaaaagattaaaaccgagttgttttgtagaaaaaccatttaaaaaaaaccgttgaattgcggattcctgaaagaaagttttaatcttaagttaattcattattcaaaaggtggttcaatttaatggggtattccggaatgttccaattggaacttaaccactggtaactaatttattaataatggatcttttaaaccagttcttagg

SEQ ID NO: 37976 - DNA, 445 bp, Zea mays
  Clone ID: LIB3060-030-Q1-K1-G6
ttgcgctgctccataattacttgtgctctaagctttgatccaaatccacacacattgatctaagggccaggttgcagaatggagagaacactgatcacctctaacctctgcttgagtgcacacgcttcaagatcgtcccggagggttcactacatccctacttccgcctctgctgctgcacacaactccagctacaggaagaagagtgccccgtctctgccgccgtcggccgccgcatctgccactgttgtcaccgcccttccgtcaactgacaatgtccagtccactgctccaaaacagaccggccgacaggagctgaaagatctcgtggccgccaagaccagcacttcaagaactgcacgtgcgccaagccaggctcggtctcgggctcggactgagcttcgccgccggcctgccccggcagccacgtccctgccaatggcgt

SEQ ID NO: 37977 - DNA, 163 bp, Zea mays
  unsure at all n locations
  Clone ID: LIB3060-030-Q1-K1-H1
ttcccgggcggcatcgtgaaccacctggactgcagcaggaagaaggctgtggagatcggcaaggagctggcaaggaagcacttcatncaccatgtcttcagggagaacgacttcgaggacgggaaccagaacctgtaccgcttcttggagcacgaccccgctg

SEQ ID NO: 37978 - DNA, 280 bp, Zea mays
  Clone ID: LIB3060-032-Q1-K1-A5
gggtagacccacgcgtacgaagcgtattggcttccgatctactgaagcggttcagccgcagcagactgcgacgggcgacgaggacaacgcaggctctatacatgggatgccagctatgcggcgccgtgccccggttccacggcctgcggggctacgccgtgccgacgtccgcggtggtagagctgacctacgagaagctgatcacgaagtaaggtgtcctcgaagggcatccgctgccactacatccgctgcgccaccaacctggtcatggtgaccacga

SEQ ID NO: 37979 - DNA, 269 bp, Zea mays
  Clone ID: LIB3060-032-Q1-K1-C5
atatatttctggttttttggttttttttttttttaataaatgatacactttgagcaactttattattatatgtattattacaaggcacaatggcacatacattcagtgatacaactgcaatatacatgaacaccctttggataacttctggtttatctatgcaactgctggaattcattccaaaaacgccttcggagataaaaaccctgtattttggtagtacatatgcatgcattgtcacgaatgatgggcgccaaggtcatattatc

SEQ ID NO: 37980 - DNA, 258 bp, Zea mays
  Clone ID: LIB3060-032-Q1-K1-D6
gatgaacaggaaagccgcaaatcatgacacaaatcacgcgtatacaaccaagagtcgaacatgggctgttcctaaagcctccagtttttttaggctcaaaatgtgcttatagccgatacagatccaaaagaaatgggacagcaggtgcgtgcattagtcagtaggcacacgtacatacatatacagcaaacgacgacgacagcagcgtcacccacaagtgcgcacatcagatctacagggtgaaatccagcaagtaat

SEQ ID NO: 37981 - DNA, 440 bp, Zea mays
  Clone ID: LIB3060-032-Q1-K1-E8
aagcaatactcccctgtgctctccttgtgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattggtcacgtgggcccacttccaattattagtagatgaaaaattgatagga

SEQ ID NO: 37982 - DNA, 447 bp, Zea mays
  Clone ID: LIB3060-032-Q1-K1-F6
gctcgtaccggtccggaattcccgggccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggccttcgcaagtcccggcgcgctcttctcagagaactcggggagtcggcgcacgaggcgcccgtg

SEQ ID NO: 37983 - DNA, 421 bp, Zea mays
  unsure at all n locations
  Clone ID: LIB3060-032-Q1-K1-G1
ttcttccgcgcgccctctctctctctctctctctcctgccttctgcctgcggccggcccatgtccgtggcgcccctcctgccctgcgagctgcttctccagcgaaaaggctgctgcgccttgacgcagcaccgatccaccgncgcccaacccttgcgttctgtccggcagctaggtagcgagctgcgcggtggctgcgaccggaagcagggaggggaacagggcagcgaacgccgggcgattgccttgcttgcctgtgtgctccgcccggcgcgagttggtcggtcgttccatgcatggatgacaaggaacttatctcacagtccgacctgcagtcattctaccagcagcagcagcagcaccaccgggccttcggcggcggcggcgggcagcatagcccgtnctcgctggccgggatgcac

SEQ ID NO: 37984 - DNA, 436 bp, Zea mays
  unsure at all n locations
  Clone ID: LIB3060-032-Q1-K1-G5
ccggttcggaattcccgggctaactcaggggacacgagcgccatggccgtcacatcgaccgttgccgtcgtgctgtccccgccgtacgtgggcgggctccgcctggcgccgtctaccggccgggcgcgcgtgtcgttccgcgcggcgccggcgccggcgcggcggtccgtggcggcgcgcgcggagctgagctcggcgctggtgatcagcctgagcacgggcgtgtcgctcttcctgggccgcttcgtcttcttcaacttccagcgggagaacgtggcgaagcatgtgcccgcgcagaacggcaagacgcacttcgacgccggcgactagcgcgccaaggagttcgcggtcctgctcaagttcaacgaccccgtgggcttcaacctagtagacgtcctcgcctggggctcgctcggacacatcgtcgnctactaca

SEQ ID NO: 37985 - DNA, 473 bp, Zea mays
  unsure at all n locations
  Clone ID: LIB3060-032-Q1-K1-H1
ggaattcccggggttctgcatgtcttcaaagggttgtgaccccatatagccggatgtcagtcaattcatccatggcgatcaatccattcctcgagcaggccaaggttcttctctgggttttgaggaaggacccatctgcgatgctcatctaattaaggttacctggtcatcttgctactcggtcgcctacaggatcggatagcttactctatctataatcacaccgagcaaactgtccatcctagctacaatgggtagcacgcacaaggaagaagtaggtgtcctggaggaaatacttgacgggagaaaagagccgaggaagctatctttatcagttctaaaacacatcacaaatgacttctcgcacgagcgaataatcggttatggtgggtgcggagaggtttacaagatgaacagggcattctgcanaacggaagcgtcgctgtgaagaaaatcttcagcaacctaaatgt

SEQ ID NO: 37986 - DNA, 453 bp, Zea mays
  unsure at all n locations
  Clone ID: LIB3060-034-Q1-K1-B5
cgttcggaattcccgggtcgaccacgcgtccgngcagtagccacagccagaacaccagctgacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacgggtccaggcccaaccgcgccgacggggctgggtactggaaggccaccggcgctgacaagcccgtgggcacgcccaagccgctggccatcaagaaagcgctcgtcttctacgccgggcagggcgcccaagg

SEQ ID NO: 37987 - DNA, 302 bp, Zea mays
  unsure at all n locations
  Clone ID: LIB3060-034-Q1-K1-B8
ccggtttcggaattacccgggctcggacccacgccgnntccggagggcgccagaaggggcagtcgctgtacaggtatggaagagcgaagtatatgaagtcggcaggcgagccggaggatngtccgtgcctggaaccgtgnntcgaccatatcgtgatatcctggagnnggggtggacaaacctnncgccanntcctcgccgaagccttncannagtccgtcgccaaccattcatcnnngcaagcccgaggcccctacgtgatggttggttctcaaagggttcggggtgcctaatggcatttg

SEQ ID NO: 37988 - DNA, 275 bp, Zea mays
  unsure at all n locations
  Clone ID: LIB3060-034-Q1-K1-C2
ggaattcgggtcgacnacgcgtccgcgcagctgacggacgactgaaccaccgtcagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcngagggacctgagcgtcatcggctttcggctcatcg

SEQ ID NO: 37989 - DNA, 252 bp, Zea mays
  Clone ID: LIB3060-034-Q1-K1-C6
tcgtgcgctcgccagcagcagtcagggtagccggaccggcgccctgcgcgccggtgtcgtaccgtgatgaccgcgcgcctcggccccgcgcagcaaccccacggccccacgcgaccggtgccccgcgcgctcaggccgccccgacggccgagccgaccaaccagctgtggtcgagcagcgcgcgccagagccccgccgacctccagcgacccgacccgaccgaccccaagtcgcgcgtccctagccaagtcg

SEQ ID NO: 37990 - DNA, 431 bp, Zea mays
  Clone ID: LIB3060-034-Q1-K1-C7
ggaattccgggtcgactcacgcgtccgaggattcttgaagagatcgagcttcttttgcaccacaaggtcgaggatgtcttgcagctgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgaccacgcctgcggctgcggtagcagctgcaagtgcgacccctgcaactgctgatcacatcgatcgacgaccatggatatgattattatctatctaacttgaggtggtgggtgaacaataataagcgaagccgagctggctgacatacataggtatcgtgtggtgtgtgagagagagagag

SEQ ID NO: 37991 - DNA, 277 bp, Zea mays
  Clone ID: LIB3060-034-Q1-K1-D5
ccaataattttttttgtgatttcgtatcaattctactcatgaactcttttatgggttctgctacatttacactacaatataattcgtgaatgctatgtggcctagagttgttcttactacaatctattcagtatgcacctgatgggtgtttgtgtgtgtttctcctggaatcatgtgctacagatccccagcacgtaaacactggacgagtgttcggtgctatgatcattgctgctgcgcctggagctcggcctgcgtgacaaacatgccgtggaag

SEQ ID NO: 37992 - DNA, 318 bp, Zea mays
  Clone ID: LIB3060-034-Q1-K1-D6
accggttcggaattcccgggccttcactcacctccccccgcggcccgcgccaatggccgattcgccaaaccctagctccggcgaccttcccgcgggcgctgggtgctcgccggagaagccggtcctggcggatcgacgtgtgtctgcgctcgccggcgccggcgcgaggtacaaggccatgtcccccgcgcggctgccgatatcgcgggagccgtgcctcaccatccccaccgggtttaggcccggagctctcctcgagtcccccgtccttcttaacaacttcaaggttggaccggcttccacaaccggtactctgag

SEQ ID NO: 37993 - DNA, 289 bp, Zea mays
  unsure at all n locations
  Clone ID: LIB3060-034-Q1-K1-E6
taccgtttcggaattcccggtcgactcacgcgtccgcaccagcaaagtgagtgtgatcgatcacacactgcacacactgccatggccgtcatgggcaaggaggacgagcaggagcagcagcagcacaaggaggaggaggtggtccaaggagatgtgcgagtcgtcgtccagcaggagacgtcggcggacgaggaggccgagtcggcactggtgcgcaagatctccggcctggccgncgccatcgccaggctgccgtcgctgagcccgtcgccggaggtgaacgcgctct

SEQ ID NO: 37994 - DNA, 369 bp, Zea mays
  unsure at all n locations
  Clone ID: LIB3060-034-Q1-K1-E7
aagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgncgctgtcgacggacgacctgctgaaacaagtggactacctgctgcgcaacggctggataccctgcctcgagttcagcaagctcgggttcgtgtaccgcgagaa

SEQ ID NO: 37995 - DNA, 138 bp, Zea mays
  unsure at all n locations
  Clone ID: LIB3060-034-Q1-K1-E8
ccggtttcggaattcccgggntcgacccacgcccgtccgtgcgcttcctgcctgcnntgatctcgcactctcaaactccactactactagcagcatcaggaggtgtgagaatagaaatggccagtctnnngtggaaga

SEQ ID NO: 37996 - DNA, 454 bp, Zea mays
  Clone ID: LIB3060-034-Q1-K1-F1
ggaattcccggggcgaggcaaaagcgcaaacgcgaccacagacagagcgcgcttcaaggccttttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaaccttcaatgagtggggctggtgcaaacagaagcttggagcaaatgccatccttgc

SEQ ID NO: 37997 - DNA, 209 bp, Zea mays
  Clone ID: LIB3060-034-Q1-K1-F6
tatctggtgcacatgcatagccgactgtaggtctttgggacaaggacaggtgcatgtgggcccaataacttagaggttctgccacatggcacaagaagaataagaaatatgcatttgtaccaaacgaaagagacatgatcaaaggtatataaatgagcaatgtgtgcaatttttcaatcgaagttctgagaatctaagatgtttagctc

SEQ ID NO: 37998 - DNA, 411 bp, Zea mays
  unsure at all n locations
  Clone ID: LIB3060-034-Q1-K1-G1
ttcttctcgtgctgtcacccctttcttcaatcgcctcccgattcccgcggggctcgcagatcccggaaggacaccccgccgcccccgatgagccgccaccgggtcgagacctgcgactcgtggcggcccccgcggaagaaccacgccggtgcgccgccgctcctccgcgcggggcctcggctcctcgccttcgcctcgctctccgtccgcgacggcggggactccgccgcggccgtcgccaaggcggttgaggaggcggttgtcgtacgatccgatgaggtgaaggaggcggtggccggngaggagaggaagaagacgaagtcggcggagcgcaggctgccccccgcggcgcagctggtgagccatccgctcgcgctgctggcgctagtacccaacagcgccgcgatcttt

SEQ ID NO: 37999 - DNA, 368 bp, Zea mays
  unsure at all n locations
  Clone ID: LIB3060-034-Q1-K1-G4
ggattcccgggtcgactcacgcgtccgggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccggcgaagaccttcttccacgacgtcggcctcggcggcatcggctacgaggtcacccgctacctctacgccacctgcaacgacctcaagttccccaacttcggcatcaagacggccgncaacgccaagatgtggagcgagtccggcacgttcatcgggtacgt

SEQ ID NO: 38000 - DNA, 414 bp, Zea mays
  unsure at all n locations
  Clone ID: LIB3060-034-Q1-K1-H4
accggttcggaattcccggctcgactcacgcgtaagccgcggttcgatgctctgacgccgaatgagatgagcggcgggaggccccaattccggaaagtgcccatgccgcagcaccggttcgcgccgctcaagcgatgctggatggaaatctacaaacccgtatacgagcacatgaagatcgatatacgcatgaacctcaaggtactggactggagtctacccatattgggctttcttgttttatgtgaatgagcttttcgtgctctattccttgcaagaaccatagattgtatacttcagatcgccgtcaagaagctcaacccggagagcgtccaaggcctgcagagtggcaggataacatggagaacttcaaccctttcggtgagaatggagagtanggtacagggtcaccat

SEQ ID NO: 38001 - DNA, 228 bp, Zea mays
  Clone ID: LIB3060-034-Q1-K1-H7
ggaccaagttgtggggccatataataagagacattggtagctgacattgaatgttatcttgcgaataacttggatgtagactagctgtcttgagaatcctgtagacagtggggctagaattaaacaacttgaacatctgattgtacaagtaacctcttgtaattttattttaacacataaggaatgatactctagagaaagatattgttgtccattcatgtcttgtat

SEQ ID NO: 38002 - DNA, 317 bp, Zea mays
  unsure at all n locations
  Clone ID: LIB3060-034-Q1-K1-H8
cggctcgacccacgcgtacgcggngacaactgcttcacccctgccgtcgccgccgccctacgcttggtgcctaggtgttcatcggatcgttcaccgggcacaagcatcacccagcagggtttcttgccctatctgtttaagactgggatcgcttctaccccgacgaccaagccgtgcctcccctgttgccggcgtcgccccttccccaccagtgaaactcgcggtctatctacaccgnacgcacctngtgtaagtgtcggcgggtgcaccccctgtagccccgacgttgggtcctactggttcattccggttggttt

SEQ ID NO: 38003 - DNA, 279 bp, Zea mays
  Clone ID: LIB3060-035-Q1-K1-A12
ggaattcccggctcgacgcacgcgtacgcccacgcgtgcgtgcttacacattctatttatttctgtcagtagtatattgagactgagtcaggtgtgtgctagacattgggaaatgtcaaatggagcgcataggagccatgcgtcggattatgctgctaggtgtacgagaacatggcggcatggctgattaccaagaacacccttaagatcatgcccttcaagctcccgacctttgtgattctattatttcctacgtgcacatgatagcaatggggattt

SEQ ID NO: 38004 - DNA, 413 bp, Zea mays
  Clone ID: LIB3060-035-Q1-K1-A3
cggattcccgggtcgactcacgcgtccggaataatctagtgatgcctgaagctgcaaattttactgggaaatcagctttcacttcggttcggggccatgtcactgatcagtgctccacaggttggtttggacctattgagtcaaattcccacacagaccatgcatcgtcaagtttgatcaggtcccagcctttggttattggaaatgatgttcagaaaaccaaaggcacttcattcaaactatttgggattcctcttggcagtccagaaaaatctgaacctctggtatccccaccaagtgtcgcatatgacgggaaacttcaaacttctccaacagacaacaatgagccttgttcagaagctacccagaatatccagaacaaagtgccaagtagttcaaccagaagctgcaag

SEQ ID NO: 38005 - DNA, 442 bp, Zea mays
  Clone ID: LIB3060-035-Q1-K1-A6
taccggtccggaattcccgggagccgcatccataaacaagaaaaagaaaagaaaacccccgctgccagcgacagaagaagaaggggtcccggctggtgtggttgcgttgcgcctccctcctgtctgcgtgcgtgcaatcgacgcacaggcgcgggcgctcgcaccaccacgaccacgacccgatggctttcatgcgctcccgctcaaatgcatcttctggcatgggagttgctcctaacattagggagacattcgtcgagcttcaaatgaagaaggcattccgatatgttatcttcaaaatcgaagagaagcaaaagcacgtggttgcggagaagacaggggctactactgaaagctatgatgactttatggcctctcttccagagaatgactgccgatatgcgctgtatgatattgattctgctactgtggagaatgtgca

SEQ ID NO: 38006 - DNA, 462 bp, Zea mays
  Clone ID: LIB3060-035-Q1-K1-B12
ggaattcccgggtcgacgccacgcgtccgcaaaagccggtccaactggggataaaacccatgtatccacacaagtcatgggtactcagtgatatgcagctccagagtacattgcaacagcttttaaagggagatgtcaataatacttcctagtcttctacaaagtgtgttggcaaaccaccaaaggagacctcatggctgtaattgaatccttccaaaaccagcgctgcaacgatctaaacctcctaaacaaagcaaacatagttctcatcctgaaaaaagaaggagcaaatgcatcacggactaccgccctatcagcctcatccactcggtggctaaggttataacaaagatcctagcactccggctagaacctctcatggataaactaatctcgcaatcacaaagtgagctattatcatcatgacgtggtgcatctggaggtgcagaaacaattggatct

SEQ ID NO: 38007 - DNA, 443 bp, Zea mays
  Clone ID: LIB3060-035-Q1-K1-B9
cggtccggaattcccggggggacgcacgcgtacggcagagagcctcttgctgggagtgaactaaggcgacggagaccgcgagggccgcgaagtatgctgggcagcgatgatggcgacctctgccagcggcgtctccctcctcctcctactcgcccatccggcgccgccaccgcaccccgccaacggcgccagcaggtacacacacagtcagagtcagtggccacgcagctcgatccgcgcccaccctctgcatgctctcaccgtcacgccgcgttccgttcgcagcctgtggcgcggcagtggcgccgcgctagctcctcatcctgctcgcttcgcggtcaataggaagacgctccggttggttaacgtcagcgtcagctgcagcgccgaggcgctgcgctccgactgcgctggcgcggagccggctgagccgcggtctgtgc

SEQ ID NO: 38008 - DNA, 462 bp, Zea mays
  Clone ID: LIB3060-035-Q1-K1-D10
ggaattcccgggtcgacgccacgcgtccgcccacgcgtccggcaacatagaaagcacaatagtgtaccaacaatggcagccaaaatagtttggctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttat

SEQ ID NO: 38009 - DNA, 428 bp, Zea mays
  Clone ID: LIB3060-035-Q1-K1-D12
acccgttcggaattcccgggtcgagccacgcgtccgcccacgcgtccgcccacgcgtccgcccacgcgtccgcccacgcgtccgattcgttccggctcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattat

SEQ ID NO: 38010 - DNA, 461 bp, Zea mays
  Clone ID: LIB3060-035-Q1-K1-E10
ggaattcccgggtcgacgccacgcgtccgcggacgcgtgggtgctgatcgtgcagtcaaggctatagaatctctacctgatagcgacgacgaggatgttctgacttcaaggcgtgctcttattgatatcacagaaagagtcatcacacggacaaaataggaaggtgttcggcgtccataaggtgaatggagagctgaacctcgcctttggcctagtgtttcacttggattttcttttttgtatacttcggttcattgcattcttttcgcagccaaaaccccaagttttgtgtatcattgctgaaatttaggattaagaaatggccctgcatttctgggaagcttctagaggttttggctgcatgtggcaacaaaatatatgtcaccgattgcaatggcaccagatatcgtgtagccatataagtgtgggagcattgtacccaatatacacttccgtaaaga

SEQ ID NO: 38011 - DNA, 436 bp, Zea mays
  unsure at all n locations
  Clone ID: LIB3060-035-Q1-K1-E3
ggaattcccgggtgcgactccactgccgtctcgcaaagggaattcccttcccctttagctcgccgctctgccgctcgcttcnngtctcccttgtagagggtgctcggggaccngnatggaacttggcctgagtactttaggtnnagagaatcngnngtttttctttgtctttctagcctcggggtctgctttgcgtnnctggtggtgnnngtgaagggggnnagaaatnntcgtgagaatnnctgttctncggatctaggtncgtgcntgagcctcgnnnggaatnncagggngnntttcactacctatagcnnttcgtcngnnatttganaatttnngatgtacctaannntggagtcttaaggggggtggcaannaaagtcttagnncagtagnntcgttcttatttgatgtnnatgaagcttccnnnccttgg

SEQ ID NO: 38012 - DNA, 430 bp, Zea mays
  Clone ID: LIB3060-035-Q1-K1-F1
cggtccggaattcccgggcagcaatccacacaagcacttcgacgtcacacgggcgctgcacacagacacaccaagcgtcggcaccaatggctggactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcagggagagcttcctcgccagggctaactgagcagcccgggcggccggcatccacgcccgttcgtgcctgcctgcgtgccttatgtatgtct

SEQ ID NO: 38013 - DNA, 404 bp, Zea mays
  unsure at all n locations
  Clone ID: LIB3060-035-Q1-K1-F12
acgcgtgcgctccccgacctcccagctctagagtctagacagccacaggcaggagctccacggagtggacgtgacctcagacctgacacattcacagtgtcacgctgcctcaacgtcatgtctctcctcgcctcccccacgccgttcggcgtgaccgccatccgccgccgcgtcgccccgcttcctctcctccctgctggcggtcgcgccgccctgcacgtggccctcgcgcgccgcggcggggtctcgtcccggacgcagcggcgcctcgaggaacgaggaggcaagaagcgccgcggtggggtcgtggcgcccgacgtggacgaggacgcggcggaggcggnggtggctgagtgggaaagggagccgctggggttcgaggtgtcgacggagcccatgccgcg

SEQ ID NO: 38014 - DNA, 372 bp, Zea mays
  Clone ID: LIB3060-035-Q1-K1-G3
ttggttttttattcaatcacgagtatagaatattgggtttgcatgcacaaaaccagtggaaagaacttatctaatagctcaaactgtctcaaaatctctatgctacaactgagctaatcgttctccgcaggatgggataggataatctgtcaaaatggttgttatagacgtcggttaacggtaatggtgtacacgatgtggaaagaattccctatatctatgttcactgcacgaggggcgcgaactatgaacacaacggtgagcgacattttaggcgttgaagagcttgcggaacggcccatccttgcgatctttggcggcctctgtcaatgcaaggaacctcttgaagcccgtggtggctgctccgcgccc

SEQ ID NO: 38015 - DNA, 473 bp, Zea mays
  Clone ID: LIB3060-035-Q1-K1-H10
accgttcggaattccgggtcgactcacgcgtccgcgcgtccctgctcctctcccagctgctgctgcttccggtggtaacggttgtggccggggagaccgccgcgcacccgggctacgcgcacgctgaggaggcatgcagcggtatgctagaggcagaggcggagaaagcaacggtgctggtgcctgcgccggagcggcgcgaagagttcgacggcgggcggatcgtggacatcagccactactaccgcgaggacatgccggagtgggagtcatcagagggctccggcgagttcctgcagctggcgcggtccatgcgcaacggctccgacatcgctaacttctcggagctccggctcactgcgcactccggcacccacgtcgacgcgccgggacacgtcttcgagcactactacgacaccggcttcgacgtcgacaccctcgacctcgctgtcctcaacggaccagcgctgttg

SEQ ID NO: 38016 - DNA, 434 bp, Zea mays
  Clone ID: LIB3060-035-Q1-K1-H12
ctcggcttcgagctcccatcccccatgcgccgtccgtcacctcgtcctcggcgcgcgcctctgcttcctggtagccgcgcccagcttcctctcttccgcgcgccccctgcttctccttggccggggcttcatcctctccctgctcgccatggctggtcgagctttttttccagccacgaagctcccatggccgccgagctcagcctttgctcctccctgcgtcgcgcgcctggcttgctctccagctcccgtgcacgcccggatcctcttcctcccaggggctcggccgcatctccatctcccagcaagcgccctaccgaagccctcccatggcgttgttcctccctggtgccgagtctctctctgccaatcgcccatggcgcccagccgcttggccttcctggtactcgctctccctcagtgccctgtccctt

SEQ ID NO: 38017 - DNA, 426 bp, Zea mays
  Clone ID: LIB3060-035-Q1-K1-H5
ctcggttcggaattcccgggcgcggcgcggggcatgcgtgcaagtgcaaccaatcgcctcgtcgtgtgcgctcgcctttgcttccctcggtaaggtgagtaacctcgttggctgatcaaggctttgacggcggcaccaacgttcttccctcgccgcctcgttgcgtccgcccgcccagcgccaactcctcgtactcgtacataaccacgcaccccaccgcgtacagcgttccctctcgcgccccgcggtgagctacccccgctcgccttagctagctacccaccatggccctaccgccgtcctcctcgccgtcgtcgctcttcgacgcgtcagcgcagtccacgcccctgcacctgcaccttccgaccaaggcgcccggccgcctcccgctgctccccttctcgcgcgccgaccatccgtcgtcgc

SEQ ID NO: 38018 - DNA, 442 bp, Zea mays
  unsure at all n locations
  Clone ID: LIB3060-035-Q1-K1-H6
taccggttcggaattcccgggctctcctcttgcgattcgctcgctcgatcctagcttcccttccaagaagcgcagcgcccatggccatgggcacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgncatcatgcgggagggccccaacctcttgaagct

SEQ ID NO: 38019 - DNA, 195 bp, Zea mays
  Clone ID: LIB3060-035-Q1-K1-H7
aaataaaaaaaaaaaaaaaaaacataaataaaaaaaaaaaaaaaaaaaaaatcagggacggaaaataacaaaaaaaggggcaaccaatctataactatccaaacttactaacgcgtgcatgcactattttatctattctatcttctcccttaattccatttcattgcccttcaatttccaaccttaactccagtt

SEQ ID NO: 38020 - DNA, 395 bp, Zea mays
  Clone ID: LIB3060-036-Q1-K1-A10
aattcccggctggagccacgcatccgccgcactgcacgcgagtcctccactcctaccgcacgatggctgcgctgcgcctcgcatgcttcaccctacgtcgcgccgctgccgagtcctccgcctcctccggcgcgaccccagccgcgtccggctccgtctccttcgcccgcgcggcgcgggggctgccctccctccgcctggccccgccccgccgccgcggtgacctcgccaggccccgcgccgcggccgatgccgcggcggagagctacgcgtccgcgctgtcggacgtggccgtcgagaacggcaccctcgaacagacggtctccgacctggagaagctggaaaaggtcttcgcggacgaagccgtcgccgagttcttcgacaaccccaccgtc

SEQ ID NO: 38021 - DNA, 411 bp, Zea mays
  Clone ID: LIB3060-036-Q1-K1-A12
tccagccacaaaaaaggacccaagatgcatgcgctgggcctgggccgcgggtgcaggcgcgtccatgccagccactgccgctgcaccgcttcttcctatcctccggctccaccccgtcctcgcaatcgcaacatcacaaggctaacctgcatcgccgccgtgcgcgccagcgctgcccagtccgcgcagatggaacgcaggcaggaggcgaaggttgtgaagctgcgggcggtggaggccacgcccgagtccttcgcttcgttcgggcaggtcatcggcgcctcccccgacggcgacgagttcggcccccacgacgcccagctcgatctcagccgcggcatcccaaggttctacatcatgcggttgcagaaccggccgctgaaattctctaccatcacccaccacgccagc

SEQ ID NO: 38022 - DNA, 260 bp, Zea mays
  Clone ID: LIB3060-036-Q1-K1-A2
gaaaggaatgaagtaggtatacactgatgctctgctatgctctcgtttgcgccatatatatatacaacatgctaaccgtccattccaattcaatccaaggattacgtacaagaaaacaagagcatcgcaaaacgatcctcactcgtactcggagctacataacgtacgtacattcaccctatctagaccctattcgacaccatctacgcaccgctatacaaagcagatcatgctgatatacactctcaaacatctgaaca

SEQ ID NO: 38023 - DNA, 389 bp, Zea mays
  Clone ID: LIB3060-036-Q1-K1-B1
tactggtccggaattcccgggcaagacaaatgattccggccttgcttcctacgttgctggtcaagttgaccgcaccctttcctggaaggacgggaagtggctgcagacaattacctcgttgccgatcctagtcaaagggatcgtgactgcagaagacactaggcttgcgatcgaatatggcgctgctgggatcatcgtgtccaaccacggcgcgcgccagctagattatgttcctgcgactatcagctgcctggaagaggtcgtcagggaagcgaaaggccggctaccggtgttcctcgacggcggcgtccgccgtggcacggacgtcttcaaggccctggcgttgggagcttcaggagtgttcatcggccggcccgtgctgttctcgc

SEQ ID NO: 38024 - DNA, 462 bp, Zea mays
  Clone ID: LIB3060-036-Q1-K1-C4
taccggtccggaattcccgggctcctagtccagcatgtacagctactatctgtactgggaggggaagtggtattggtggtcgtcggggtactggagcgaacctaacgatagtacgcatgcggtccctatctatctatctatctatctatctatctatctatctatctatctatctatctatctatctatctatctatctatctatctatctatctatctatcttgtgtttctcttcatgctattgtatcgaataaaagaatttgcctgtaattttaaccggctagccgccggtgtcttccttgatctatgtgcatgtaggcagacgttacccagcagttaatatagttatattaactaatgcctccttcaactatgcgttgggcatgggagcattagccgaaccacctcaggacagctctgccgacggtgtgatcttgatcaaggatatggccgaatggcaa

SEQ ID NO: 38025 - DNA, 368 bp, Zea mays
  Clone ID: LIB3060-036-Q1-K1-C5
ggaattcccgcggcgacccacgcatccgagccatagctcccatcgacgatcatctctagcctgaccattcatttcttgtggtaggctacttactacatatggctgtcaacattctctttttaacgatggaaaggataacatataataactctcctagatactgagttccactacaaaaaaaagacacataagcactctcagactctcattcttcacagcatcgacccatgaccgtacagtctcattctcatctgattgaagaggataccctttctaatgccatttatttacacctctatatcgatcaaccatactccgtcggacagttactacgcctgaaacccaacatttcaaccccaaagttcgaa

SEQ ID NO: 38026 - DNA, 328 bp, Zea mays
  Clone ID: LIB3060-036-Q1-K1-C8
actcggtcctgaattcccgcggcgacccacacatccgagcaaactacacgctctgcgtctccttgctcaccaatactcattcaccatccgaagatttcttcacaggtcatgaactatccaccttcctactccttcactctcttccctttcatttagcctcccgctcttctctatcccctctccattcccaaccatcttttcagttttttccgctattgcccgatacccatccacatccagctcacgactaacctcatcccccctcccttctcttctccttcctcctcctcctcctctccgtcttctacttcgttctcggccattgtca

SEQ ID NO: 38027 - DNA, 435 bp, Zea mays
  Clone ID: LIB3060-036-Q1-K1-D11
ccgggtcgacccaagccttccgtggcaccaccaaatggtcctgtagaccaaacccttggttaagaatccgcttaaatggggggatcttatcaatttggaaccggagattgaaccttggcctgaaccaaggccccagaaggattcaagtcactttctgaaagacctgggaaacttttttcaagagaatgctgatcagtctgatgagatacagaatttcagaaacatatctgacaaggctgaaaaaatcatggaggaaatagaccggctgcaaaagaaactgaaacagctgcaaggagaggagcgtaatcacgacgagaggagcttgtcacctagacaaatggctgcgtcactgaagcgaaagagtctatcagagcctagatatccagagctgcagattccagagaacattgaacaattctcgatgtcgcaaatcga

SEQ ID NO: 38028 - DNA, 398 bp, Zea mays
  Clone ID: LIB3060-036-Q1-K1-D7
ttctgcagttcctatggcaaagcctctcaatggcagtggccgtagcatgccaggagggaatgagggaatgcggctcatattttcggcagttgtaggtgtcatgctgggttacctgtttgggatctccttccctacagtcaacataaccaagcttcacttcccttcgagtatcatctcttatatcgaagataggaactctggcatcacaacccagacattgttgaaccatgcttgggcatctgcaaacaatcataaaaagaatagttctgaatctaacactgatgaaattcccgagatttatgttcctacaaacccaaaaggtgctgagagacttccaccaggcattgtagtgtctgaaacagatctttatccccgaagactattgggtggatctagtg

SEQ ID NO: 38029 - DNA, 423 bp, Zea mays
  Clone ID: LIB3060-036-Q1-K1-E10
cggtccggaattcccgggctcaattcaccgcccctgccccctgtttgtctcgtcgctgctacccacccatgctccccccaccaccatggccgcgacctcgtccgtctggtcggtgtggatcgccctgtcgctgacgctaacgcttgcctcggcatcaccagctgacgggcaagggggcggaggagcacactgcccgcccgtgctatgcggcggcgtggagatcgccttcccgttcgggatcgtccaggagcaggcgacggccaccaactgcggcgggatcgggttccaggtccgctgcgtcaacggcacgccgtacctcggatacagccggtacgaccactggctccagatcctcagcgtctcctacaccaacgcctccttgctcgtcgccgacacccacaagctcgagaagctgggagcctc

SEQ ID NO: 38030 - DNA, 435 bp, Zea mays
  Clone ID: LIB3060-036-Q1-K1-G11
cccgggtcgagccacgcgtccgctgtttctgtgctctgcttccctgtgaatttgaaacagctgctcccttttacacactgcagttcgccaaagaaaatgctcttgagcttgaccttccagcgatcaagctcggtgagcacgaagacgtaaccgaggaagccgtgtctactactttgagaagggcaatcagccgtctttctactctccaggcacatgatggacactggcctggggattatggtggccctatgttccttatgccaggcttgatcataacattgtatgtgactggagcactaaacactgtcttgtcatcagaacaccagaaggagatccgtcggtatctttataatcatcagaatgaagatggtggctggggcttgcacattgagggtccaagcaccatgtttggctcagcactgacctacgttactt

SEQ ID NO: 38031 - DNA, 408 bp, Zea mays
  Clone ID: LIB3060-036-Q1-K1-G4
gtctcggaattcccggggcgacgcacgcgtccgccgacgccgaggctgcgcgccctgcgccgggatcgagaggggaaagggaaggggagcaggcggctcgcttggaggctggagctcggcccggcgggcccatggggggacgcctggtgtccatgctccggtggccgccggacctgggcctgcccagcctggccgcgctgctccccgcgccgcccgcgcacctccgggtccaggtccaggagtggtggcagtggcagtggcagcggtcgcggcccgagcagctgggcgcggcggcgcggcggtggcccgagctcgtgcgggacgtcccggtcctggtggacgccgcgctgtggggcgtcgtcacgggcgtcgagtccgtcgcgctcgtctccatgatgtgctgcttct

SEQ ID NO: 38032 - DNA, 419 bp, Zea mays
  Clone ID: LIB3060-036-Q1-K1-G9
cggtccggattcccgggatcgaccttagtctcgctacgtagcagtgcaataaaaaaagcagccgcaatggcgagcagcaccatggcccgctgctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagct

SEQ ID NO: 38033 - DNA, 333 bp, Zea mays
  Clone ID: LIB3060-036-Q1-K1-H1
tcccggggcgaccgcacgcgtccgcggttcgggttcgggttcgtgaggttctcctttgttcggtttcgtgggtgggcggggcgagatggctgcgtcggatggtgagtaccgctgcttcgtcggcagcctcacctgagccacggacgaccactccctgcacaacgccttcagcacctacggcgaggtcctcgagtccaagatcatcctcgatcggtagacgcagaggtcccgcgtgcttctgcttcatcaccttctccacggaggacgcgatactgaacgccatcgacggcatgaaccgcaaggaactgtacctacgcaacatcaccgttaacg

SEQ ID NO: 38034 - DNA, 456 bp, Zea mays
  Clone ID: LIB3060-036-Q1-K1-H12
tccggtccggtaattcccgggtcgacgcacgcgtccggtgccaactgattacgagaaaataagggctatgaatatgatgaagaacaatcaattggttgaacggctaggccttggacaattgaaatcactggtgactgctacagctgcaaacaacaaagaagactgtcctcagcaatcagagagtttatatgatggtgaaaacactgacaattctaatgaagaggaatcccaatgtactaacggtggttgtgccaacatctccaatgatggtgatcagatctcaacaaaagtaacaagaggaaataaaataattgtggcacctacggaggagcgaacaattagagtcactaggcaaagaattgctaaagtaaaccaagaaaatagccacaacctgtctattcataaacaactcagttcatgtcctgctacaaaccatgattcgatagaaactcttgt

SEQ ID NO: 38035 - DNA, 429 bp, Zea mays
  unsure at all n locations
  Clone ID: LIB3060-036-Q1-K1-H6
tcctcattcgcgaaaagaaaaacacatggcgaccgcagagggcaggacaggacagggacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtggggcaggatccaaatggcggcggcaatagaggaactgcggctcctgggatccatccctgtactggaaggtccgggagaggtcgacggcgtggtgggtgaggaagggcgaccgcgaggcggcggcgacgacgaggagatcctgcgattcatggactcggtggacagctacctgctcctcatggactccctatcctncgctcttcgtcaggtatgcgatcctgcag

SEQ ID NO: 38036 - DNA, 444 bp, Zea mays
  Clone ID: LIB3060-037-Q1-K1-A3
cggaattcccggtcgacgcactcgtccggccatccccttttgctgcaaatctttctctgaattgtgggtctccgacaatggcggcgctggctccatccaagattctgggcacccagctcaacttcgcgggctcctcccgctactccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagat

SEQ ID NO: 38037 - DNA, 212 bp, Zea mays
  Clone ID: LIB3060-037-Q1-K1-A8
ggaattcccggcggagaggggcctcctgtagcctctcacttccctcagtcctcgttcgtctgctccctcctctctctacctatctggaggtatccttcctgtggcgcggcagagatggctgcccctgcctccaccacggctgctgctgctgcagcgctgctgctgctgctcctactgtcgctcgccgcggctgcggacatgtcgatcgtgtc

SEQ ID NO: 38038 - DNA, 342 bp, Zea mays
  Clone ID: LIB3060-037-Q1-K1-B12
ggaattcccggctggacccactcttcctcggactcttggtcatactcatgggcttttaaaccaccgtcacgctcacgcctatacgacgaacttctcaagttctgcgggggagactagaaacgaacctaggatctcaatccttttgcgcacctctcatcatactcctatcctatctagtatcccgtccgaccctagtctacactgatccactatccactgctatttctactacatcacctacattctacttcgatgccaatatattcaccttatcttaactctacactatatatccattcgaacccttcgagtcagtactcttcaaccacctttacttcatct

SEQ ID NO: 38039 - DNA, 477 bp, Zea mays
  Clone ID: LIB3060-037-Q1-K1-B3
cggttccggaattcccgggtgcgacgcacgtcgtccgcagcgtctccagctacccctccatctctcggtccaaaaattctgcaggcgagtctccgatcctgtcgggactactatacccacgtccgcagaagtccgcgtcgacctgatcgtctcgggggtacgaggacgaggggaagtcgcggcgtccgcggttgtcctgccactcgtactcgtcgcaaggagaacggaagaggaagcccgtatctcctccggcccggctgcccgccggaaccgatggaactccgagcactgtgatctcgcgcctgggccgtcgcgaagccgcttctacgcggctgcagctcggccacagcgatcgggccgggatggacgagctggagatggacgaggaggtcaggcccgagttcccctgcccctactgctacgagggaccagacgtcggatccctctgcgcgcacctggaagaggagcaccccttcg

SEQ ID NO: 38040 - DNA, 413 bp, Zea mays
  Clone ID: LIB3060-037-Q1-K1-B6
cggaattcccgggtcgacccactcgtccgctggtccgtggccatggcgtcgtccatgctctccgctaccaccgtgccactccagcagtggggctgcctgtccgagttctccgggctcaggagctccgcgtcgctgcccatgctccggaatgccacctccgacgacttcatgtccgccgtctccttcaggacccacgcggtcggcacgagcggcgggtcgcggcgggcgccgactgaggctaagctgaaggtggccatcaacgggttcggccgcatcgggcgcaacttcctgcggtgctggcacgggctcggcgacgcctcgcccctcgacgtcatcgccatcaacgacaccggcggtgtcaagcatgcgttccacctgctcaagtacgactccacgctcggcatcttcgacgc

SEQ ID NO: 38041 - DNA, 453 bp, Zea mays
  unsure at all n locations
  Clone ID: LIB3060-037-Q1-K1-C2
ttctcggaattcccgggtcgtacccactcgtctcgagattggtgagggtcggctatgtgacctgtctacaaggtgaacactcaaggtatgggtacagggtatgtgccctaaaggttcgtgtctttacattctacgacaagggtcaaacggagtttcgttaatgagtcttcttgcaatcttctgatgtaacacatgangaatcttgtcaaatctctatggtctgctgtgctagaaggaaaccacaggtatccttgtctacaattatctgtgaaaataatagtcttgcacatacccttctagattcgcgacacagcaacatccagttcaactggagaactcgggtaaatatctgcatcggtgttgcccaaggattagctttcctccatggcagtgtcagccctcacattgttcaccgtgacatcaaggcgagcaatatacttcttgataaggaca

SEQ ID NO: 38042 - DNA, 439 bp, Zea mays
  Clone ID: LIB3060-037-Q1-K1-C4
tcggaattcccgggtcgacccactcgtccgctccgactcctccggcggcggaaccccttccggcgaggatggggaacatcttcgtgagagaagcccaagatcaccgaagtggacagggccatcctcaccctcaagactcatcgcctcaagctcgcccagttccagcagcagcttgagaaggtaattgaagcagaaaaggaagctgcacggcagttggttcaacagaagaagagagacagagctttgattgcactgaagaagaagaaagctcaggaagagctgttgaaacaagttgacacatggcaaatgaatgttgaacaacagctctcagatattgaactagcatgtaaacaaaaggctgtatttgaaagcctgaaggctggaaactctgtccttaagtctattcataatgagatatacatggatgatgttcaaaatc

SEQ ID NO: 38043 - DNA, 73 bp, Zea mays
  Clone ID: LIB3060-037-Q1-K1-C9
aattcccggctggacccactcttccgatcgtactgcaccaatctgccatcactcttcgatcacactcatgaag

SEQ ID NO: 38044 - DNA, 130 bp, Zea mays
  Clone ID: LIB3060-037-Q1-K1-D12
taccggttccgtgaattcccgggtgcgtacccacgtcgtctcgtcacatactccatcgtcatctcatcctcactatatgctgcaactagcatcatgctgctcatcctgcttgcgcttccttcctgtcatg

SEQ ID NO: 38045 - DNA, 445 bp, Zea mays
  Clone ID: LIB3060-037-Q1-K1-D2
attcccggctcgacccactcttcctgaggaaaagggtccgttgtgtctacgttttatagggtcgtcggctgcccttactagaggaggatcacctctttctcgacgggccctatcgtgcctgtgttccgatccttgctgtctcggctctctctgctcctagtcctcatacctctgtactctctcttgctttgtcttctgctactatcacgtctcctcttcacactccggtcaatcttacaatctctctcaaactgtccaaaaagaaagcgaccatatcccgcatctcgatgatgcctattggtactccacgtgttccttaccgaacacctgttgaaagaacctgtcaatggcttgacatatggaacgctctgtaccgtgagcggattatcttcattggggacaatatagatgaagaattcagcaaccaaatgttggcaagcattct

SEQ ID NO: 38046 - DNA, 392 bp, Zea mays
  Clone ID: LIB3060-037-Q1-K1-E6
cggaattcccgggtgcgacccactcgtccggccggtcaagaaaactccccagtccagtctgcgagttggatggccttcttcttggcggtcttgttcatcctcatcttgctagccatcgcctcctacgtccagtacactcgctggcaaaaggggaaaggccgcttcggcagccatgggaggtctgctcccttgaatctgcctcctggctccatggtctggccttaccttggctagaccctccagctttactcccaggaccccagcttcttcttcgcttccaaacagaagaggtactgcgagatcttcaagactcaccttctgggttgcccgttcgtgatgctggctagcccggaagctgctcggttcgtgctggtgactcaagcgcacctgtt

SEQ ID NO: 38047 - DNA, 441 bp, Zea mays
  Clone ID: LIB3060-037-Q1-K1-F10
accggttctcggaattcccgggtcgacccactcgtccggttagccgagagctcctctgttcctctcgtgtctggccgaacaggcagagcgaccggtctccagagcgctccggatggcgtcaggagctgcggcggcccctgtcgttcagactgtggtgctgaaggttgccatccactgccatggctgcaagaagaaggtccggaaggtgctcaggggcatcgaaggcgtgcaggacgtgacggtggacgcctcgcagcacaaggtgactgtgacgggcaccgtggactccgacacgctcatcaagaggctgtacaagtccggcaagaagggagtgccctggcagtgtcacccgcccgccaagaacagcgagcccgcgccggaggccccgccggctccgcagcctgccggcgactgctgcaaggatgctgctgctgctgctgc

SEQ ID NO: 38048 - DNA, 420 bp, Zea mays
  Clone ID: LIB3060-037-Q1-K1-F12
accggttcggaattcccgggtggacccacgcgtccgggaagaaaaaaaaaataactccaccattcccttccctctcgcgagctcagatcgctgtaagcatggaaaaaagaaaaatggcgcagctggtggagacgtacgcgtgctcgccggccacggaacgcggccgtggaatcctcctggccggggaccccaagacagacacgatcgcctactgcaccggccgcagcgttatcatccgccgcctcgatgcgcctctcgacgcttgggcctaccccgaccacgcctaccccacgaccgtcgcccgcttctcccccaacggcgagtgggtcgcctccgccgacgcctcctgctgcgtccgcgtctggggccgctacggtgaccgcgctctcaaggccgagtttcggcccctctcgggacgcg

SEQ ID NO: 38049 - DNA, 413 bp, Zea mays
  Clone ID: LIB3060-037-Q1-K1-F5
ggttctcggaattcccgggtcgacccactcgtccggcaactaagcaagtgtactgaggactgtatgcatcgatccagcgttccagctagcacgcgcgcatccagcacccagcacccagcagtagaatctatatatcgtacgcaagtagtggatcgaggcatctatctgcagtccctttcttcttcttcctcttgattgataggtgcgccgaagcttgttttgttgggtggcctttgtctctgtcgtctcgtctcgtctcgtcttccgcccggccgtcaccacctgcaggctatactagctagctattaagtccggccaaccaagcagctcgatcaggtcggtcgacggcggggacagttcggagggaggaggctgccggagaccgaatgacgcctaccatcaactcgcggtcc

SEQ ID NO: 38050 - DNA, 259 bp, Zea mays
  Clone ID: LIB3060-037-Q1-K1-F6
attcccgggtcgactccactcgtccggtattttgatggctcgttaaagcttcttgtgtaacacccctggtgtttatattccgctcgacaactagtatggagttaagcacgtaatatcagtggataaaacatatgctaaattttaatcatcttctatcgcgattttaatatcgcatctgtttctgtctatttagactcctaaaattttcgcgaatttcggaacgcaattgttctgaaagcttgcgagcctgtgcccaatt

SEQ ID NO: 38051 - DNA, 386 bp, Zea mays
  Clone ID: LIB3060-037-Q1-K1-F7
ggaattcccgggtcgacccactcgtccgcccactcgtccggtggaatctcttccctcgcaggataaggtgcctcggccgtaaacagagtggttgttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgactacgactccgtcgctgccggacgccgccccgaagctggggatttctaacaagtt

SEQ ID NO: 38052 - DNA, 330 bp, Zea mays
  Clone ID: LIB3060-037-Q1-K1-G2
ggaattcccggcgcgacgccactcgtccgacggcttccctccacaaccacttgctcttcatctacttttctcctccgccttccactgatgctttcccctgcctgccgtcgtgcatcatcatctccggccagggccagggcatcccggtccggcctcctccactctgcgccccccagactcgtcgctgcgtatctgctggccgccatggccaccgtcatggccgcggccgtctcgtccttcccgtcctcctcggccgtcgtcgccaaggcgtcgccggcgtccccctgtgccgccccgcactttcgcccgagggccctacggtccgctatc

SEQ ID NO: 38053 - DNA, 352 bp, Zea mays
  Clone ID: LIB3060-037-Q1-K1-G5
ggaattcccgggtcgacccactcgtctcgagtcggaaggagcaggtggacgtggctgtcgcgaccaagttcgcagctcttccatgggggttcggtcgtgggagcgtcatctgcgcgctcaaggcctcgctggatcgcctcggtgtctcgtcggttgagctctaccaactccattggccagggatatggggcaactaatactacctggacggccttggagactctgtggagcaagggcttgtgaaggccgtcggggtctcaaactacagcgagaaacgtcttcgagactcgtacgagcgcctcatgaagaggggggtcccgctcgccttcaaccaggtgaactacagcctgat

SEQ ID NO: 38054 - DNA, 436 bp, Zea mays
  Clone ID: LIB3060-037-Q1-K1-H11
cggattcccggctggacccactcgtccgctcgtctcctcggtctcccctccctgtcttccagagactcagagcagggcgctcgtgagtcggaggagaagcgcgaccactaccatgggctttatctcgttcgtcggccgggttctcttcgcctccctcttcctcctctcggcctaccaagagttcattgaatttggaaatgactgtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctattgtgtatgacttctactaccat

SEQ ID NO: 38055 - DNA, 438 bp, Zea mays
  Clone ID: LIB3060-037-Q1-K1-H5
tctcggaattcccgggtcgacccactcgtccgttgtatcacatgaatgaactcagagcatctcagtgttaaaactgtgagcatatcaatgcccgtcctttaagcaatatgggagctaattgctgcattgctgcaaaggagaggacacaaccatgcattactccattagaagtatcagcgtacaggaatgtgagacattcaccatcatggagctttcggtgggacaatcgcacacatatagaagacataatggaaatccctactctgttctccaaccatagtagtggaagcattcggcctgatacaaagagtggttccattgccccaactgaagggttttctaatggaaatagccttggaactagcccttccaatgtgtctcacggaacaaagtggcacaaatctgacaaaaaaatggaagcatctaaggttacaaagg

SEQ ID NO: 38056 - DNA, 145 bp, Zea mays
  unsure at all n locations
  Clone ID: LIB3060-038-Q1-K1-A10
gcgtggtcaatttatgaaaggatcttttnaaagattacatgcacctgtataactaaaaaaatgtttgactaataaaaaaatttcataaataaaaaaaaaaaaaaaaaatttaaaattcaatttataaaaataaaatattataata

SEQ ID NO: 38057 - DNA, 322 bp, Zea mays
  Clone ID: LIB3060-038-Q1-K1-A2
ggaattcccgggtcgagccacgcgtccgctgtttttttttttttgcataatttgcatccagtgctaaatgtgaattcaatcatacagttgttttgtcaattaatcgttgtggtaaaagttcggagccgtaaatttatacactgatgatctgcgtgtaatatggaatgaatgtggtaacatcacctttcgtcaaaatatttgtgcagaacatagttaagcactcgagattttcaaatggcgtcctcaacgagcatctcatctacttggcgatgacaccagaccagattcttctatacataccttactatctgggtgaccactt

SEQ ID NO: 38058 - DNA, 379 bp, Zea mays
  Clone ID: LIB3060-038-Q1-K1-B9
ggtttggaattccgggcgggacccacgcgtccgatgcgatccatggctctgcattctccacaatccatgtgacgcccgagactgttgatctattccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcatcaacatggtggagcaggagctgcctggaggcgggctcctcgtgtaccagatcttctgtgctgctgaagactctgttgctacctcgcccaaatctgtttgccactgctttg

SEQ ID NO: 38059 - DNA, 447 bp, Zea mays
  Clone ID: LIB3060-038-Q1-K1-C10
tcccggtccggaattcccgggtcgacgcactcgtccgcttctcagcacgtacctcgagtggtgtcacacaaaggccggtgtcagtgaccgcttcgttggatcacaaaaccagcgatgccagaaggaagttcctaaaacttgcacttgggaaccttggagttggactgcccaccttgttgggcgctaagaaagctctcgctgatgagcaaggcgtctcgtcctcgaggatgtcttattcgaggttccttgagtatcttgacaaggatagagtgaagaaggttgatttgtttgagaatgggacaattgctattgtggaggccatttctcctgagcttggtaaccgcgtgcaaagagtccgtgtgcagcttcctggtctaagccaggagcttcttcagaagttgagggagaagaacatcgattttgctgctcacagcaaccaggaagact

SEQ ID NO: 38060 - DNA, 270 bp, Zea mays
  Clone ID: LIB3060-038-Q1-K1-C6
aattcccgtctcgacccactcatccgcagctcgcttcatctaccacttccttctccaccaactactcatcttccattaagccggataactttaaatttacgacgtcctccaccgccccgcccgccccttcttcttccacctccccttacaacgaataattcctcctccgccaccttaacaacccctttcaactctccgctatccttaacttaccactaccacccacaccacatacccccggttacctaaagatcacataaaaagcaccat

SEQ ID NO: 38061 - DNA, 312 bp, Zea mays
  unsure at all n locations
  Clone ID: LIB3060-038-Q1-K1-C7
ggaattcccggcggagcacgacgcacgcagagccgcagagatccgtcacactgcatgttttgaaaactgaactgtaagatggcatgagggtagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaangaggagggt

SEQ ID NO: 38062 - DNA, 322 bp, Zea mays
  Clone ID: LIB3060-038-Q1-K1-D2
aattcccgggtggacgcatgcgtcccagggtcgataagtatactaggatacattgagactatgtcgccatagtaaagaacccgacgcagctcatccctgccaggtttatgatcaatgatcttggttcctgcttagagtggaataaagctatgcagaagattaccggtataaagagggaagatgcgataaacaaattgttaattggggaggtcttcacgcttcatgattatggctgtagggtgaaagatcatgcaactctaacgaaacttagcatactgatgaatgcagtgatttctggtcaggatcctgagaagctcttttt

SEQ ID NO: 38063 - DNA, 323 bp, Zea mays
  Clone ID: LIB3060-038-Q1-K1-D4
ttcccggctcgacgccacgcgtccgccgtccttttaccttctcccattcacgccccgtctctttcgtggccttccttttccggcggccacaagtgggcgagcggcggcgcccttcaccaggtcttcgtcgggcccttcaccggcgacgagcatccaccagaaacgtggagctcagagcattggtgcctctttcctctttcaccaaggattccggtgccttgtttcacaagacaaaaaaagtctcaagggtcttgattcttgtatgaactcaagatttatggtggatcttggagctgtgggatgctaagcctggtctagctacc

SEQ ID NO: 38064 - DNA, 310 bp, Zea mays
  Clone ID: LIB3060-038-Q1-K1-D5
tcccggctcgacgcacgcatccgtactccacacacgacccaaatctacttctttccacaggcaacttacaacgcaacagcggcgcgttcatcgagtcgacgtcgaccagccactatatacgcaagaaagccaagaaaaacacttctatccctcttcctccatatccaataaccaaaggtagctggctagccgcgactcattggctagacgattcaagcagcagctcatgatggtggctccgatgatgattgcgtcggccgggctgtgcatgctggccggcgtggcgatggccaaccggtccctcgggaaa

SEQ ID NO: 38065 - DNA, 293 bp, Zea mays
  Clone ID: LIB3060-038-Q1-K1-D6
tgtgattctcctcttcagctcttctcgcccattccagctccgactgcgccggggtggcaccgttcaccccagcggcgccaggcgtccacgggatggtggttcttgtggctactgccgctcggtggcccgggggaagcacggccgcccgggcgcgcccgccggctgcgaggggcagggcccccatccgcttcgccgccgagccctagcacaaggcggccacggtcaggtttgaaaaatatagattgttatcatggatgaaaccaataaggcatgacgtcagggcccaaatgtcc

SEQ ID NO: 38066 - DNA, 314 bp, Zea mays
  Clone ID: LIB3060-038-Q1-K1-D7
ggattcccgggtcgacgcacgcgtccgctcaagctctagccgaactccctcacgccatcctctttcctggtgttcatccctgcggcagccaccacttgggcgctcctctccctgcccctcccatggcggctccccctggatccctccctgcgcggaccctctcccgtggatggtgccgccccttcctgcagcacgtcgtgctccctcccctggcgccctcgtccccaacgccggaaatgccgctgctgctccaccagccgctactgctcctgaacgccagtgccgaccaccatctcccatggcgcaggagctcc

SEQ ID NO: 38067 - DNA, 329 bp, Zea mays
  Clone ID: LIB3060-038-Q1-K1-D8
accggtccggaattcccgggtcgacgtcgcacgggcgctgctcacagacacaccagcgtcggcaccaatggcttactaccaggaggtggacgactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggaga

SEQ ID NO: 38068 - DNA, 320 bp, Zea mays
  Clone ID: LIB3060-038-Q1-K1-E1
actcgtctcggaattcccgggtggacgccactcgtccggcgcccctggcccctctgtccgatctctttccatagccggcttcgagctcgggctagtcgttcatggcgtggacaccagacgagctccctggtgctcgcccctctccagccgagctcctcctatctctccctcgcgtcttcctctccctgccatggacgccggagttccgctgctcggccatggccgctgtcgagcttcctgctcgtgcctatctccctccatggctgcgcttcatcaagctctctgcgcgccgtgaagcccctgcgcgtcgcggtctccca

SEQ ID NO: 38069 - DNA, 403 bp, Zea mays
  Clone ID: LIB3060-038-Q1-K1-E10
cggaattcccggtcgacccactcgtccggcaaaactacggttgcagaaaacggtgtctcgagagtcggggtctccgagcacacaatagctattctcggtgaaaacaggtgggaagacccaaccagactgacgcataacaaaaagacagccatcaccggcacagttgcatctactaagacttgcatcttctgtcgaggcgaacgccgcctcatgtgcttagaatgtgatggaacaggtgagccgaacattgaaccgcagttcttggagtgggtcggtgaaaatactaagtgcccatactgtgaaggaattggttccattttgtgtgatgtttgtgatggaaagaaagtaatggcaagttaagtaaggcttatagcaagaattccctgccttgtctgtgttcggt

SEQ ID NO: 38070 - DNA, 184 bp, Zea mays
  Clone ID: LIB3060-038-Q1-K1-E11
ttcccggctggacccacttcttccgctccaataatggagtttcctcaccactttcaccaccacgtccatctccacatacacgactttatactaccacataggccctcctaccccagtctactgctgctacttccaaccacctccaccccacccgtacttcctctctcccttcgacccctatcct

SEQ ID NO: 38071 - DNA, 434 bp, Zea mays
  Clone ID: LIB3060-038-Q1-K1-E12
tcccgggtcgacgcactcgtccgaaatatgaaaggtgtcacatttatgacgattttgcattggtcttaatgacaaattttgacttttcatcactaaagtcaatcatcccctacgaaacgtcataagtaggagaggcttatgacattttgatctattgtcacaaggtattcgtcatagaaggctatatgtgttgtagtgagagtttatacacatggttagggtactcactatcttcaaagccgggaggttgctcaacatagacctcttccttgattggtccattgaggaaggcacttttcacgtccatttgataaagcttaaagccatggtaagtagcataggccaataatatgcgaattgactcaagcctagctacgggtgcataggtttcaccgaaatccaaacctttgacttgggagtatcctttggccaca

SEQ ID NO: 38072 - DNA, 322 bp, Zea mays
  Clone ID: LIB3060-038-Q1-K1-E2
ggaattcccgggtcgacgcacgcgtccggcgggtgcaccaaaaggaatggcagcgctaggctccctgcgacttctccaggcccgggccggcgctgcggccaagtgcgcagccgtgggtggccggacatccgcgcggcgagcgccacggccactgttcgccgtgcgcgcctcggctgctgacgccgccaacagggatgccgtgctcaaggccttccgcgagaacagggctctcaagataattcccggtcttcagaactttgacaggatcagtgttgcatctgttgccacagctgcagataagggaggtgcaacacatgtagac

SEQ ID NO: 38073 - DNA, 325 bp, Zea mays
  Clone ID: LIB3060-038-Q1-K1-E4
ggaattcccgggtcgacgtacgcgtccgggccgtgatcctcctgcagggccggttcgccggcaggaaggcggtgatcgtgcgcttgttctaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaa

SEQ ID NO: 38074 - DNA, 298 bp, Zea mays
  unsure at all n locations
  Clone ID: LIB3060-038-Q1-K1-E5
tcccgggtgcgacgcacgccgtccgggtgttctgctcttgtttcgtncctcaatcgtaattcggaagtttcgcattggagtcattcgtcggtgtcggtaagctttacgcagccagggcgcatgacttgttgtccgccgcgcctcgccactcagaagcgagggaagtggtagccgaggggggtggtcgtcgtcgctcactcattggaaagggaggattgactntngtgatggacacgttcgtaatttcgaactcttggctgaagaaccttcgactccagccgattatannaaatcttga

SEQ ID NO: 38075 - DNA, 310 bp, Zea mays
  Clone ID: LIB3060-038-Q1-K1-E7
tcccgggtcgactgacgcgtccggccatggcgaagaagccagtggaggaagcgctcctcgcagcggcggacgagcacgaggaggagagcctgagcgtgcgcgaggagctgaagaagcagctatggctggctgggcccatgatcgccggcgcgctcctgcagaacgtgatccagatgatctccgtcatgtacgtgggacaccttggagagctgcccctcgctggcgcatccatggccaactccttcgccaccgtcaccggcctcagcctgctgctaggcatggcaagcgctctagacacactgtgcggcca

SEQ ID NO: 38076 - DNA, 439 bp, Zea mays
  Clone ID: LIB3060-038-Q1-K1-F10
ggaattcccgggtcgacgcactcgtccggatctacacacatacatagtttcttctactacacgacgacaaacatggggaagccttgtagagatcggagagtggggtggatactccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtc

SEQ ID NO: 38077 - DNA, 322 bp, Zea mays
  unsure at all n locations
  Clone ID: LIB3060-038-Q1-K1-F3
tacccgtccggaatgcctggatgcgacgcatgcgtccggatatgtacctagaccgaancttgtgtgacactggcaacctgagcgtgaatcggcaggatttcatcccgtcggccaatgattcggagggtgatgcggccacgacacctgctcctgccacagagaaaccgtacatcactttgctctaccgtcctggccactacgatattctctacccaaagtgaattttgcgcatggttagtttcacgacttcggttgagaaagcacactgcccagaaaactcgtcatgtttcgcctgtgtgctgccaaaggtggcaaacttgct

SEQ ID NO: 38078 - DNA, 323 bp, Zea mays
  Clone ID: LIB3060-038-Q1-K1-F8
ggaattcccgggtcgacccaccgtccgctctactcgcataccactgcatgggtgttggggttcttgtatccctgctagtgggggccctctcccacagccaccaagtctgctctgtccagagaatcaagtgccagtggtgaccatgctcacaattctttacccaccatagccagaacattctagggagttgctggcctatatgaagcttgttccataatcatctcagaacacgaagaagaagtggaagtccctgaagagaagacaacaccacctttggagtctcaggcagggtctcgtctctactttagcatctgcgggcctga

SEQ ID NO: 38079 - DNA, 391 bp, Zea mays
  Clone ID: LIB3060-038-Q1-K1-G10
tcccgggtcgacgcactcgtccgaactcggagatccacacggcatcattctgtttgccttcttttgcaaagagggtaatcgagtgataagcgaactagatgtgaagggtatctccaagggctaagtaccttatgctctcaacacagaatttgttgtagtgtgaaaagcggatgcctccctcccttttctcccactttgatgaatagtataagcacaggagatgagatgcaacagttatcggagttatcggtctacatggtcctgaccagtcgtatgtctcggctgcctggtgcagctatgaaaacgttttgcaatagcttttttcggcagtcctcacatcatcacggttgtgtttccgcttccatatctgaatggaatacatatacgtatg

SEQ ID NO: 38080 - DNA, 301 bp, Zea mays
  Clone ID: LIB3060-038-Q1-K1-G4
tactcggttcggactgccgggacgtacgcgtccgcagcagtccagcaccatgggcggcgctctgatcgtcgcgctcctcctcgcgaccaggccgctctccttgggcggcggcgcgcacccgggctactccgacgccgacgagagcgcgtgcacggtggacgcgggcgcggagctgctgcggcggctggaggagcgcgggcccggcgggcgcagcatcatcgacatcacgcacgcggtcgtgccggacctgccggcgttcgccacgggggcggtcgcggggcccatgctgcgcctcagggag

SEQ ID NO: 38081 - DNA, 74 bp, Zea mays
  Clone ID: LIB3060-038-Q1-K1-G9
tcccggctcgacccactcttccggcttctctgcctgctcgtgaaccacatatacacggtatactgcttgcagtt

SEQ ID NO: 38082 - DNA, 130 bp, Zea mays
  Clone ID: LIB3060-038-Q1-K1-H7
attcccttctcgacccactcgtcctaaaaaacaactctaaaacacacaatcttataaaaaaaacatacaacaaaactaaaggcagaatttatacaaacaccaagccacccaacaaccactctcctcacac

SEQ ID NO: 38083 - DNA, 406 bp, Zea mays
  Clone ID: LIB3060-039-Q1-K1-A9
tccggatttcccgggtcgacccactcgtccggtcgaacttggtacttactccaggcatgaatgcttctagaagttctcatgatgcagtggaggtgtctgatgaaggcaagactggcaatgaaacattgctttctgccgagggaggggagaggttgggaccatctttaaatggcaccagcgagggaattaaagggcgcctaaataatgatggttctgtgccccacacttcaaaagttgaaagagaagagggtgaattgtcgcctaacggagattttgaagaggaccattttgttcctttcgaagatggaacatctaaaggaaaggaagattctacaagcagaccattccatggtaggcctggggaagtggtaccctcttctgccgaggcagctggtgagaatgattc

SEQ ID NO: 38084 - DNA, 369 bp, Zea mays
  Clone ID: LIB3060-039-Q1-K1-B12
aattcccggcgtgaatgctaggtccaagttatgaggatgagccgctgcgctactatcaccgcaccggaaatgccacctgcagcacttttcttccaatcatagttcctcaaattccagcacctttggcaccacagccgtctcaatctcaaccttcagagccagcaaccgcagtgcaagccaccagagtcagcagcgttgcagtaactgagacatccacaaccagcagaattgaggtctgcatggggggcaaatgcaagaagtcaggctctcttgctctcctgcaggagttcgagaaggctgtgggcaccggtggctcggtcgtcggctgcaagtgcctggggaagtgctgcctaggtcccaacgtgaggc

SEQ ID NO: 38085 - DNA, 347 bp, Zea mays
  Clone ID: LIB3060-039-Q1-K1-B5
gattcccgggtcgacccactcgtcctctggctacctcacacagtgcagtcagtcacacagagcctactatccagcactgccggccatcatttcctcccgtgtgcaaactgcaaagcaagcaatggacatgggcttctacaagctctccagcaggggctgcggcatcaagcacaaggcggcggcgatgcccttctaccccaggaaaccggctcatgtggctcccgccgcgccgtctgcgcatcatgccgtcagcaaggcgaaacagccctcatcgaccaccatgtggtcgattccggcaccgccatcgtcaaccgtggtcgccatggatgttgctggaaactgcatgg

SEQ ID NO: 38086 - DNA, 406 bp, Zea mays
  Clone ID: LIB3060-039-Q1-K1-B6
ttcccgctctacccactcttcctagaagctggaaaggtgaatggctcaaattacatagtacaaatctcttgcttaagacgcatttattaaacgatcacagctcaatcaatataaccatcctaacattaaacagctcataatatacattaccatccatcacaaactacacaaccttattgaacaactcatagactcacaacaattcaaccaacaagtcttggtcacacaaacttccacctcatcactgaaagctcttcacatcaatacaacatagctatattgatgaatcatacgttttcatctaaaattgtatattcttgccctatatcaataattaccttaacattatacactgctaatattctattttatgatcaccatactaatctaattcaccttatccctc

SEQ ID NO: 38087 - DNA, 291 bp, Zea mays
  Clone ID: LIB3060-039-Q1-K1-B8
tcccggctcgactccactcttcctggttcttctactaaaacctatttttatctgaagacaagttccctgatgatctcaagatatatatttaaagatctcatacaaatatctactggtgtcctatcatatgcctatcataccgttgaagatctcataggtatacctacaacactggaaagctttcatcctatgtatcatataaaaaaattctagctctcttatcccaaactacctgtccatctaaagtattgctcaatatatttcaatacttctccaaaatgttactatatc

SEQ ID NO: 38088 - DNA, 367 bp, Zea mays
  Clone ID: LIB3060-039-Q1-K1-B9
tcccgggtggacgcactcgtccgatcggtgtgccttctcggctgcgatgtcggctgcggcggctgctccagccagctggaggtatttgagggactagtggacgaggtgctcgagagggaggtgctgggagcgtgcctggaccaggcccccgagcgccgccgcatccgcgaggctttcaaggacgttcagctcagcatcgaccattgcctcttcaagggacaatatagtggcatcagaacaaaggagtcatgtgagcataactctaggggtgtggagattttctcaaaatgctggtttccggaaaatcgtccaatgagagcaattgtttgtctttgccatggttattgagacacatgtaccttttttc

SEQ ID NO: 38089 - DNA, 393 bp, Zea mays
  Clone ID: LIB3060-039-Q1-K1-C11
tcccggttcgacccactcgtccggtgttgtgttgtgctgttctgcgagaagatagagaagaggaggaagaagagcaggttcggagaatcctgcctgcgcgcgttacgacaagcatatatgggggagatcaccaatgtcatggagtaccaggccatcgcgaatcagaagcttccgaagatggcctacgactactactcgtccggctcctaggacgagtggactctgcaggagaacagggaggccttctccaggatcttgttccgtccgcgcatactgatcgacgtgtccaagatcgacatgaccaccaccgtgctggggttcaagatctccatgcccatcatggtctcccccactgctattcataaaatggctcacccaaatttggagaacgcc

SEQ ID NO: 38090 - DNA, 74 bp, Zea mays
  Clone ID: LIB3060-039-Q1-K1-C5
ttcccgctcgctccacgcttcctatgtcataccatggggggtcgttcgatttctcgcagaaacatcctgacctt

SEQ ID NO: 38091 - DNA, 431 bp, Zea mays
  Clone ID: LIB3060-039-Q1-K1-C8
gattcccgccttgacagttggcttcaggctgctcttaatccagggattgaatatactcaccctctggttgttccatacgatgataatatatgaattcccatgctcacttttatctgatggggttcgaaattcacttcggtaccttaaacttcgttgttgtgctctccgtcccacagttgaacttgcccccatgagaagcctaacaagtttacatttgtcctttgtgagcattaaatgggatgggttaaagcgcctcctttccaactcccttgctctggatgaattatagctagtatgttgtgactagatcgtttgcctcaatattccttcttccctgcatctgtttatcatccttaatattttttgattctcgttctctaaatttctatattgctattctttaaatcctttattttttttttttttctttc

SEQ ID NO: 38092 - DNA, 309 bp, Zea mays
  Clone ID: LIB3060-039-Q1-K1-C9
attcccgggtcgacccactcttcctcttcacatcacgtacccatattgttcattcactaaatactcgagataatgctacctctacagtcggatcacaaaaccacgtggtaccaacctatcactcctactacatccaattctgaacattccatatagactgctcatcatctttactcctcagatatctctacctgatctacaagtcttctctctctctagaatctctcattccagtttccaccaacatcttaacaaatatagaatatagaatctcaatatatatgaaattctgtcctttaatatcatcaa

SEQ ID NO: 38093 - DNA, 449 bp, Zea mays
  Clone ID: LIB3060-039-Q1-K1-D1
ggaattcccgggtcgacccactcgtctcgcgcaccacaagcgagctagggacccttctctgaagaagagagagaagacgtctctcggcggtctgcatccccgttccgcaacctctcgtctgctgcctgcctgcctgcctgcctgcaaaaaggagtttgtcatggcgtctaagcgcatcctcaaggagctgaatgacctgcataaagaccccatcacatcatgcagtgcaagtcctgctggtgaggacatgtttcattggcaagcaacaattatgggaccacctgacagtccctatgctggtggtgttctcttagtgaacattcatttcccgccagattaccccttcaaacctacaaaggtttctttcaagacaaaggtcttccatcctaatatcaacagcaatggaagtatatgccctgacattctcaaagagcaatggagccctgctt

SEQ ID NO: 38094 - DNA, 222 bp, Zea mays
  Clone ID: LIB3060-039-Q1-K1-D10
tccctgctcgacccactcttcctcccactcttcctaaggaatggcctccattccattaatggctttgaagactccgaccgatgtccctatatctactacgtccctacctaatccttctctctataaaactcgagctcgtgcacatggagctgattcttggtcgccccaacctctccatgatctctccctctctcccgccgtagataatctctgtctattctc

SEQ ID NO: 38095 - DNA, 417 bp, Zea mays
  Clone ID: LIB3060-039-Q1-K1-D11
tcccgggtcgacccactcgtccggttcgctgttgctctctccagtagtcccgttgagtgacctcccctgctcgacaactagttcgaccgccgccgccccacgcctgctggccaggtcttcggcggaccctttgccgtcgacgggcatccaccacaccagggttttgcacattaatgaagacttaaaagttccagaacaaagcactaagggtgctcgaaggaaaaatgctttaggttagatcaaaccatggtttttaaagcggtaaggcggtccaaggcgttggagcaccgtctggacgcctaggcgaggtaggtgggcaaggcgcctaggcgttagaccaccgcccagactcctaggctactccttaagaacagtggatcaaactgtagatcttgccactgccttcaagcatcctat

SEQ ID NO: 38096 - DNA, 432 bp, Zea mays
  Clone ID: LIB3060-039-Q1-K1-D12
ttcccgggtcgacccactcttccggaggagtcagagaccgaactctgccgtctcttcctcctccctctgcacccccacggccgcgcatgtcctccaccgccatgattgggattaccaacctactttgccgccacgacccgctctcctcccttccccgggctacgtcgtcggccgcccggtcctgtactctgcttcctcctcgatgcctcctccattcttcttgctgctccccttcctcctccgtctctccgtgccgttcccgggtccgaccaacagcatcactgaagctcatccctgcctcctacacctgcttcatgggtccagccaacaatgatgccaccactcttaaactatcatcgtctgccgaccttctccgcctccttatcgtccccagctccaccgctgtcaccggacactccttcagtgctttca

SEQ ID NO: 38097 - DNA, 344 bp, Zea mays
  Clone ID: LIB3060-039-Q1-K1-D5
ggaattcccggcgcgacgtatcactggctcggcacacagacacaccaagcttcttctaccaacggcttactaccatcatgtaaagctacttctcagaggaggtgaggtccatgtccccggccgtcttcagccgccacgcacgcatcctccaccagcacttcttcaaggagaagttctaggacctctacacggtctcactctccgtctccaaccaccaccaccaccaccatgctcaccacgactgccactgcttcctcatgctcgagaccaggatcgagaagtacatcaacaccttcaccgtcaaggtccactagcgcatgtagagcttcctcaccagttctaac

SEQ ID NO: 38098 - DNA, 340 bp, Zea mays
  Clone ID: LIB3060-039-Q1-K1-D8
ttcccggctcgacccactcgtcctctggtcacctggagctggacctgactttggcataccatctcatctcttcaccagtggtccttctcgcacaattgctcgccgtcgccgtccctctccttctgctcctgcttcaccaacgctcatcaattcgcctccgtcgtcgcagcagcagcagcagatcggccaagcagggaggacagctcctgccgtcttcgcccccggctctgcccatcatcggccaccttcacctcgtcagcgacctcccgcacgtctccctccgtgacctcgccgccaagcatggtggggacgactgcctgatgctgctccgtcttggcgc

SEQ ID NO: 38099 - DNA, 433 bp, Zea mays
  Clone ID: LIB3060-039-Q1-K1-D9
tccggtattcccggtcgcacgagtctcttcgacgtctcacgggcgctgcacacagacactcctttcgtcggcaccaatggcttactaccgtaggttgactactgctcggaggaggtgaggtcggtgtccccggccggcttctgccgccacggaggcggcgtccagcagcacttcttcaaggagaagttcgaggaggtcaacacggtctaacgcgccggcgccaaccaccaccaccaccaccatggtcaccacggcggccacggcttcttggtgcgcgagaccagggtcaaggaggacatcaacacctgcaccggctaggtccactagcgcaggtagagcttcctcgccagggctaactgagccgcccggcggccggcatccactcccgttcgtgcctgcctgctttccttatgtatgtctggggttgactggt

SEQ ID NO: 38100 - DNA, 437 bp, Zea mays
  Clone ID: LIB3060-039-Q1-K1-E1
cggaattcccgggtcgacgcactcgtccggtgatcaccaacagctagtgctagtcccccttccttccatccatccatggcatgctgcatgaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctactacgacctccgcgcctacctcgagtcgcaggagacggctgcccatgcagactgtcagcatctcggcgtggcgctcctgagcgagaccatgtccacacccgtgctggtggccacagcataccagaccct

SEQ ID NO: 38101 - DNA, 55 bp, Zea mays
  Clone ID: LIB3060-039-Q1-K1-E11
ggaattcccgggtgcgacgccactcgtccggcagaccggtctcagcatctttcac

SEQ ID NO: 38102 - DNA, 319 bp, Zea mays
  Clone ID: LIB3060-039-Q1-K1-E5
ttcccgggtcgacccacttcttcctagcccggtccatttttgaagctgctatatcaatgaccaaccagggtgttcaagggtgcccatatataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcttatcatgctgaattcttcttcttctgaacgaacgacctgactcagatgacctttgggttcatcag

SEQ ID NO: 38103 - DNA, 314 bp, Zea mays
  Clone ID: LIB3060-039-Q1-K1-F1
ttcccggtgtcgacccactcgtccgtgtgagttgctaatgaaattttgtacattcaatagagagagagggtagttgatgttaagcgtgttatgtgactgccctttcttttcgctttgcttcctggatccaactgccgccttctcatcctgtcttcgttgattcgctgttcttccatcggatgcctttatctgcctagatcggatcatgagcaaatctcattgtgtaaatcctgataggaggaagagaacgaccatagttgatcgataccgtccctgtattgcttgtgcctgtctcgtacggctcttctaacaac

SEQ ID NO: 38104 - DNA, 411 bp, Zea mays
  Clone ID: LIB3060-039-Q1-K1-F5
attcccgggtcgacccacttcttccgtagttaagtctgagagaaaaaagcattagctgagcatcatcaatggcttatgctggctactaggccgagggtctgactctgttgtgcctacacttgagccccttcgcgttgcgcgttcacatgtctctaagcatcatggccctaaccttctagtgcgttgatcacgtacttgaagataggtgcatgctcatcttaaaacacgacgacgtactcaaagtcgttccagtgctcacaacactagctatggagtcttacgcttcgtctagtgtctactttatcatctgcgggcctgagactaactcatctataaacaaagatgaatcatcaagaatcccttacgggagtaggagagtttctactagattttggtgtttcagtggtcctg

SEQ ID NO: 38105 - DNA, 228 bp, Zea mays
  Clone ID: LIB3060-039-Q1-K1-F7
ttcccggctcgactccactcttcctcggaagatgatccaaatcgaccctaatctcggtctaatcctcaggatgaatctgatgaactaatctaaagatggatagactaaacaagtatcagaacaaggatgatcgtcaagtggacttcacctaacatcactaacctagtgttattcatgcaaacccattgcatttatcatctccttgtgttttaaaaatctttttcactt

SEQ ID NO: 38106 - DNA, 184 bp, Zea mays
  Clone ID: LIB3060-039-Q1-K1-F8
tcccgctcgacccactcttcctggatgaaaatgctaataagacggtcattcaatacgtacacttaggaaagatcacagactttttctacagaatagagggactaaacaaatacaataacaatgatcatcataaagccaacaatccttaccatcactaacatagctttaatcttccaaacatttt

SEQ ID NO: 38107 - DNA, 398 bp, Zea mays
  Clone ID: LIB3060-039-Q1-K1-F9
tccggaattcccgggtcgacccactcgtccggctagccttcccgttcctgcatcgcgtcctagatgggcgcctacaccccgacgactcagacgttcactcattgcggctggtactcaaccgattctccgacctcaccaactactagtaccgcgccaactacctcggcgtcaagagcaggccacagaggcagagtacgctccatgacatgtacctaccccgcaacaactagcacatgccacaatccgtcgacttgcggtccaagggctccttccacgaaatccaagaccaatccatccacgttagacgctagcctgactgaactatagcggaccacgaacgcatcactacaacatggactatcgaccaaatctcctaaactcatcaccaacttactcac

SEQ ID NO: 38108 - DNA, 447 bp, Zea mays
  Clone ID: LIB3060-039-Q1-K1-G1
gtattcccggctcgacgcactcgttcggtctgggacaccgcggtgctgtcggcttaccctgagactttcgccaagaacctttatcgttttgtcatccactctcgctgggccatgctgttctcgttggtctgcgtgttcccggagctgctcgcccgcatctgcttcaagttcggctagtccctattttttatgtctcatttctcttatttttcatctttttttttcctttttcttctattttcttctttctttttcatcttttttatcttttttcttttcttaatttttacttctttcttttttcttcttacttttttattttttttttcttttgttttatttatttttttttttattctatattttatctttttttctttatcattattattctattttttttattctttttactttatattttttttatattttatttaatttttt

SEQ ID NO: 38109 - DNA, 246 bp, Zea mays
  Clone ID: LIB3060-039-Q1-K1-G12
tcggtctctgattcccgggtcgacccacttcttcctacagtatctactctcacaagtactgtcttgtactccaattcttcaaacttatcttgacccatttacatatacaataggatgttggatactcaatcgaacatactgacccatggacatctaattaccagctgctaaatattcagcatacttcaaacaacttactctacatacgctccatcatcttcatctacatcttatcctattacaaac

SEQ ID NO: 38110 - DNA, 398 bp, Zea mays
  Clone ID: LIB3060-039-Q1-K1-G6
ggaattcccggctcgactccactcttcctagaatagaaagattcagaataaacaatttttataggattcaaataatcaaataaagtaaatgtttgctggtaataaccttatttatgacaagtttcaaattggtaaagtatacccctaggataaagaagaagaaggggctgagaaaactcgcaagaaaagttccaacctatcgtctacttaaattcgaacgggttttcaaagcacaaaatctcatacatatgtctgttttcaaagcacaaagagttctagatgagattcgctggcgttactactaggaaaccgttatgatactgaatcttattccttatcgtgcattgtattccatcttaaagttggtatattctgtttcatctaattcatcttattat

SEQ ID NO: 38111 - DNA, 272 bp, Zea mays
  Clone ID: LIB3060-039-Q1-K1-G7
gaattcccgctcgacccacttcttcctgcgcatactaccaccctactactccttttccacccacctcacctgatccctagctcgaactctttgccgtgcccatcgacatctatcgcattgctgcaccccgatggctaccctcgcctccaagaattgcctatgctcgtgcagctattcgttcgatgaccccgatccgatcgagtactctacttcaaccgcctctgctaccacaaggtctcatacatatgtctgttttcaaagcacattatatt

SEQ ID NO: 38112 - DNA, 185 bp, Zea mays
  Clone ID: LIB3060-039-Q1-K1-G8
tcccggctcgacccactcttccttacccattacagtcccttcagcatcctcttcacccacccctccctctccttctgtcgttattcctgcacctccgatcgacatctatcacattgctgctccccgattactacactctcctccaagaattgcctctgctcattcagctcttctttcgattaccc

SEQ ID NO: 38113 - DNA, 426 bp, Zea mays
  unsure at all n locations
  Clone ID: LIB3060-039-Q1-K1-G9
tcccgggtcgacccactcgtcctcacggttaactcacaacgaangcaacgactatgcttggaataatcccaccctttgtncgtcaaactccaaagacacgattgtagttggattaattcccaccccacaaccccccaccacaagaacttgttcgatcgaattcttcttcaactacccgcctcgttaacccaaggaaggaggcaaagcaaaggcttctcgcaaggtttcccgtgagcggcttctgcggctgtctccatgaacagcatcaagcatgctctgatttacagcttcgtggccaagggctccgtcgtgctgtctgatcacacggccttctccggcaacttcagcaccgttgccgtccagtgcctccagaatcttccccccaacagcaccagatccacctactcctgtgacggccacaccttc

SEQ ID NO: 38114 - DNA, 397 bp, Zea mays
  Clone ID: LIB3060-039-Q1-K1-H1
attcccgggtcgacccactcgtcctatgataaacttcggattctatctctctcttccattcttacgtttccatattacactggaggctttctactcaaatctactaatactactctaatatgcccattggtgttccaaaagtaccttaccgcattccggagatgaataatcaacttcgattgacttatacaatgttatctatctagaaatgacactttttttaggtcaagagattcccttctagatcactactcatattacacgtctgatactatatctcaatacacaagatggacatacccacatgaatttgtacattaactcccctaacgggttgctaatctcaagtatcacacttatagatacgattcatacgtctacacttgatatatattca

SEQ ID NO: 38115 - DNA, 440 bp, Zea mays
  unsure at all n locations
  Clone ID: LIB3060-039-Q1-K1-H11
gtctcggaattcccgggtcgacccactcgtccgtgccaaccgtcgtggtaccccatgtgatccaaaggaaaccaaaatatctgctagcgtgctgatggaaagaattcaaagaggggctctgctagctatggtgctcatgagagacaagtatgggttcagaagtcaagttcaggctcgtgagtttgtccattgatgatactcccataaaaaacaggtattgaagtcgtggagaagtcttggattctgcagcgcattcttctttgttagctgttgatcctgtgaagtatggtaacgaaatgtccaatggtcaaatgctaccatgaagtgcaatctcagatctgtcagtcgaagtctcagctgaaaagagggctcggctgatttgattcacagaaatagtgaagtaacataacccggcatgtangtagctctncgacaacttt

SEQ ID NO: 38116 - DNA, 449 bp, Zea mays
  Clone ID: LIB3060-039-Q1-K1-H5
tgaattcccggctcgacccactcttcctcagtcctataactcttcatctccctatctatacacacatctcattaaactccttgatagtatttattcagcatgacctaacaaatacaaactctaacaacttcgactagctctacatgtactgctactatcttgctgaaactgtcgatttaatgagcttacctgtaatgttcatcgcaacctagtctaaatcaacaactgaaagcttatacagtgctgccttgtctctgggaattgctaaccaactcactaacatactcctgtatgttttagaggatgctagaagaggaaggatatatttaccacattatgatcttgcacaatcatttctctctgatgaggacatcttcaaaagtttcatcacgaacctttttaaaaaatttaattataaatcatatcaataaatccaggatatttttttg

SEQ ID NO: 38117 - DNA, 435 bp, Zea mays
  Clone ID: LIB3060-039-Q1-K1-H9
cggtccggaattcccggggtgcgcagccgcatccgctgcttttcgttcgtcttcatcctactcgagggcgaaacccacaaaccctctccctgccgtactccggcctacacatgcaggggcgatgactctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacatgcgttaatcacgagacaggaatggttgatcc

SEQ ID NO: 38118 - DNA, 237 bp, Zea mays
  Clone ID: LIB3060-040-Q1-K1-A4
cggaattcccgggtgcgacgccacgcatccgggagaaccgtgagcagagagacatggttcgccaccaccagcagcgggcgctgctccggttggtactcatcttgggccggctactccttgccccgcccctcgccggctcgtggggaaaggagggccacatcatggtctgcaagatcgccgagaagtacctgtcggagaaagctgcggctgcggttaatgcgttgctgccttagtctg

SEQ ID NO: 38119 - DNA, 134 bp, Zea mays
  Clone ID: LIB3060-040-Q1-K1-B7
tcccgggtcgacccacgcatccgctccggttcaccattttttgatgagtttagggggctccccgtctcggcccggcttggtgtatatgccagcttagtgatcagtgaacggagtcatgcttgtgagattaggct

SEQ ID NO: 38120 - DNA, 407 bp, Zea mays
  Clone ID: LIB3060-040-Q1-K1-C1
gattcccgtctcgacccacgcgttcgccagcactgaacacttgattgattcattaggtagctagctagctgaatcacaatgggtcctgccaagttccatgcgtggcagtagccacgacacgactgtgacgactactaacgctggcgctcctgtgtggaacgacaacgaggctctgactgtgggtcctctcggtcccattctgcttgaggactaccaccttatctagtaggttgctctacttttgctttagtctcatttatatctgctttgtttatatttcttttttaattttttattatttatttttttattattttacattgtgtttgttgtttttatttttatattttattttattttaattattattatttttttatattttattattattttttttatttttt

SEQ ID NO: 38121 - DNA, 430 bp, Zea mays
  Clone ID: LIB3060-040-Q1-K1-D2
agtttagttttatggaataaaaaaagaaataaggtatgttttaaaaattagggttgtcttataaaaacctttttattatttttatttttattttttttttatttttttttttatatttttttttatttttttttcttattttttttattttttttcctttttatttttttttttttattttattcttttttttattttttttttttttttttttttttttttccttattttatttttttttttttttttttttttattttttttttattttttattttttttatatttttttttttctttttatcttttttttattattttttttcatatttattttttttttttattttattcattatttattttttttttatttttattttttatttatttttttttatattttatatttttttatttttcttttttt

SEQ ID NO: 38122 - DNA, 495 bp, Zea mays
  Clone ID: LIB3060-040-Q1-K1-E6
cggattcccggcgcgacccacgcatccgaccccagcctgatccacgctctagatatcctcgccatctgggcctgccaggtcgggctcataagcacggtttggggctaccgtattgccttctggccgttcggctaggttttttttttttttatattcttttttttttatgttgatttctttatttttttttttatttttttttttataaaatttttattttatttatttatattttttttttaatattttttttctttttatattttatttattttatatatttttttttattttatatttttttttaatttttttttattttttttttttattgtgtgttatttattatttttttttttatatatatattattcttaatttttttttttatttttttttttttattttatctttattttattttttttttatttattattatattttttattttattattttaatttttattttttttatttcttttattttttt

SEQ ID NO: 38123 - DNA, 478 bp, Zea mays
  Clone ID: LIB3060-040-Q1-K1-G6
gattcccggctgcgacccacgcgtcctcggcaagcaagcaagcagcgtgtatttacatactaggcagccaggcagccagggcgcccaccttgatggtggcctcgtctgccaccgccgtcgctcctgtccagggtctcaagtccaccttcagccttcccatctcccgccgctccttcagaatcctttgcttcttcttcatctgcatattttatccttttcattcattttttttctttttttctttaatttttatttatttataatttcattttttattatttttttatttttttttatttattttatttattttatttattttatttttgttgtgattttatttatttttttattttattattatattattttattctatttatttattttatttttatattatttatttatattttttattttctattctattttttataattttttttattatcttttttattttatttttttttat

SEQ ID NO: 38124 - DNA, 185 bp, Zea mays
  Clone ID: LIB3060-041-Q1-K1-A8
catgaaagcttaggcacagatttattaaactggatatttaattctccatatactgaaatactcaagaagaacataatgaatatacacacacatatatatctacatatttattgtaataataccatcaccgttaactacgtcaataacatcacatgaatattttattcgcatctggtaaaagccaa

SEQ ID NO: 38125 - DNA, 295 bp, Zea mays
  unsure at all n locations
  Clone ID: LIB3060-041-Q1-K1-B12
aattaccgggtcgagccacgcgtacgcggacgcgtgggcgtcgacagcatgttcgttctctccgcgaagctcgccggcttcgcgctncgacctcaacgcaactgggggggggcgctagcacagatgacacgcccaagaggctgacctacgacgagatccagagcaaaacgaacatggaagtgaacgtcacaatcacgtgtaaccagtgcccgaccatatacaactgagtgcactcagtgcctgtcaaggacctcaagtaccatatgaacaacatgcacctgtaccccaactcctt

SEQ ID NO: 38126 - DNA, 386 bp, Zea mays
  Clone ID: LIB3060-041-Q1-K1-B7
accggccggaatcccgggtcgacccagcgtccgcacaccaccaccttgggcgccgggcccttccatgctttccttcgctcgtcggcaaggacaagatatatagtgctagctgttctgtgctgcggtcgtcgtcttcttatataagacgccaacgacgcatgtcctcggagcctgccgaggccaggatatagaggcgtcgccgggccgggccactgcacggtcggcggatatggctgtcgaagcgcacagcctgctcttagcaggagggcacaagcaactcaccagcgcgggatggccttggacgaccggcgacgaagctagatgcgcgactgcgcgaccgagccaccagcaggctttccagctccagcaggcctcgtgtgtgggcg

SEQ ID NO: 38127 - DNA, 421 bp, Zea mays
  Clone ID: LIB3060-041-Q1-K1-C10
actcggtcctgaattcccgggtcgagccacgcgtccgcgagcagaggagcgcgtacctccaatagcaaatcaaccagccagccgcctcgccggaagagtagtctaaggctaacaaggagttccgcaagctggagagcaccatggagttgatcaaagacctgagatcgaaacaggaggaaatcgagggtctcaaatctttggtagcaaatgatcatgaagagaaagacatgcatgagatggcagaagaggagcttcttgtggctgtcgaggaggagaaacgattgcagcatgaactgtttagatcgctgcttccaaaggatgaagcagatgaaaaggattgcatattggaggtgcgggcaggaactggaggagaagaggcttctttgtttgcaatggatatattaagaatgtacgagaaata

SEQ ID NO: 38128 - DNA, 415 bp, Zea mays
  Clone ID: LIB3060-041-Q1-K1-C3
tccggaattcccgggccactccgcgctagctgaggacggtacagcggcacagaggtgcgacgtacgacgacgacgacgcaggcgccagacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgccgggttcaccctcgccgacacgctggcctgcg

SEQ ID NO: 38129 - DNA, 444 bp, Zea mays
  Clone ID: LIB3060-041-Q1-K1-C7
ccggtctcggaattcccgggtggacccacgcgtccgcagcaatccacacaagcacttcgacgtcacacgggcgctgcacacagacacacgcaagggtcggcaccaatggctgactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcatggagagctttctcgccagggctaactgagcagcccgggcggccggcatgcacgcccgttcgtgccttcctggctgccttatgtat

SEQ ID NO: 38130 - DNA, 391 bp, Zea mays
  Clone ID: LIB3060-041-Q1-K1-D2
ggaattcccgggcgagagcttcggcgggcccttcctcgtgcccagctaccgcggctcctccttcctcgaccccaagggccgcgggggctgcaccggctacgagaacgccgtcgcgctccccgccgggggcagaggtgacgaggaggagctccagaaggagaacatcaagaacgccgcctcctccaccggcaacatcacgttgagcgtcaccaagagcaacccggagaccggcgaggtcatcggcgtcttcgagagcgtgcagccgtccgacaccgacctcggggccaaggcgcccaaggatgtcaagatccagggggtctggtacgctcagctcgagtgattcgagtgtctaactgctatgtgtccgaccgtcgtcatggatcttgggaag

SEQ ID NO: 38131 - DNA, 437 bp, Zea mays
  Clone ID: LIB3060-041-Q1-K1-D7
tatatattaatcatcctattttaattaggttctaatccaattagtagtaagtatttgcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgcttt

SEQ ID NO: 38132 - DNA, 328 bp, Zea mays
  Clone ID: LIB3060-041-Q1-K1-E1
aattcccgggtcgacccacgcgtacgcccgagtggacgtaagaagggacgagtggtcttgacgccggccagccatggcggagggtctgctctcctattcgcacagtctcgccagccccacatttcaggccccagcacttcccatgagcagagatcctctagaaagtgaggcaaagcgtgtcctaccacctatgtggaggtcctaagtactcgcatagcgcacttacgagcctgccaattggaaccgaaggttggaggtgaatacaatgcgccatctcatgacgcagactttgtcttctttcacaatcaggctcaccattccctaagca

SEQ ID NO: 38133 - DNA, 108 bp, Zea mays
  unsure at all n locations
  Clone ID: LIB3060-041-Q1-K1-E10
cggtcctggaattcccgggntcgacgccacgccgtctcgcgcctcagtcttggctctcgccttctgggcttctgctgcanntcctccaaggggatcgtngnnatggcc

SEQ ID NO: 38134 - DNA, 397 bp, Zea mays
  unsure at all n locations
  Clone ID: LIB3060-041-Q1-K1-E11
ccggtcctgaattcccggtcgagccacgcgtccggtggaagacaaggccccgttctcgattaacccaagccaaagagtcagagggagagagagagatgtagtcgtattggtcgtggcctgtcgaaggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgngtcgacgaacctggtgaactacctcaaggaccgcctgcaccagggcagcaaagcccccccgaacggcgtcaccaactggatgggcactagcgcca

SEQ ID NO: 38135 - DNA, 387 bp, Zea mays
  Clone ID: LIB3060-041-Q1-K1-F8
attgccaaggtatgtgctcctatacggtattaaaacctcagcaactcgtccatgatttctgttcatagttggaaggattttctcagtgcaacaaaagcaactaaaaatatcggcgaaacaagaaagatgatgtacgggacgatctgctcgattcccacctccggctcttctaagctcgcgtagtaattcttcttgctgccaaatttggtgaagtacgtctcgtagcctgtgcttttgggcactggaatgctgctcaccttcatgaaatccattgcctgaaagctgaacacgaacatgtttgctttcttgctgatctcactattcgggtggtttttaagtttgctatacatgctcattgcttccttggacctgcaaagtgaatcaaga

SEQ ID NO: 38136 - DNA, 406 bp, Zea mays
  Clone ID: LIB3060-041-Q1-K1-G1
gaattccggtcgacccacgcgtacgtgccaccattgggccttggaagaccgggctcattggccagttgcagaaagcgttcgggacaggagtaccgaagctgcagcggtcagagctggaacgtgcctgcgaggacttcagcaacatcgtggcgagctacccacactacaccgtctacaagggaactctgtcgaccggcgtcgagatcgccgtggtgtccaccatgatcacgtcgagcaaggagtggacagagcattcagagagctgcttcaggagaaaggtagacgccctgtcgcgaataaaccacaagaacttcgtcaacctgctcggcttctgcgaggaggaagaaccgttcaccatgatgatggtgctcgagtacgcgccgaacgggacgcttcacgagagcct

SEQ ID NO: 38137 - DNA, 470 bp, Zea mays
  Clone ID: LIB3060-041-Q1-K1-G10
tgcatttcaaaataatatctccctgcgcttttcctagccctttgtcatccaaggaaacgaataaggaaccggcgcttttacacccccgccaagaacaggagcaataacaacaaggctcctcgcaacaatccattctcatccatggcgaagctcatgaacaagctggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgttggcgtcctggtgacggccgggttccacgtctccggcggccacctgaaccccgcggtgacggtggggctcatggttgcgcggcacatcaccaagcttccgggcggtgctgt

SEQ ID NO: 38138 - DNA, 400 bp, Zea mays
  Clone ID: LIB3060-041-Q1-K1-G11
accggtctggaattcccgggtctggtccgtggccatggcgtcgtccatgctctccgctaccaccgtgccactccagcaggggggcggcctgtccgagttgtccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgcttgcacgggcgccgggaccccttggcccttgaagtcattggcattaaccacccccgaagccttaagcaagccgtccaactggttaagttccaattcaagcttggcattttt

SEQ ID NO: 38139 - DNA, 386 bp, Zea mays
  Clone ID: LIB3060-041-Q1-K1-G6
aagctggtggttttgaaagtgggggagttggagggtcttcacgggtccggaggtcggggagaactagttgggtgccccctcctaaagaaccagttgatagggttgagataataccaactggagatgggtaagagtatccttgcttcgttcttatgtcttacactaatacacgattatggaggtgatggtcactttcgtttggcaaaacaaacggtaagtacaatttaatccattttcgttgattgtagttgacttgctgtaatttctggttataatgtttgtcaaatgtacattcaggaagctagcactggtgcaatgcccagtgatgttcaaatataccttaggggcacagaggaccagatcctgcaaatccatatgtgttgtgc

SEQ ID NO: 38140 - DNA, 358 bp, Zea mays
  unsure at all n locations
  Clone ID: LIB3060-041-Q1-K1-G8
taccggttctcggaattcccgggntcgactccacgtccgtccggcttttcctcttcctggtggtctctnnctcgtcttctccaaccgaccgcccgattggcngnnattccagtttcgtacnncccgagtaccngntccagctcgttctcgtcccctgggaactcctcagcccccttctctcgtcccgcccttcggcacctttcgtacggccgcnncggcaccacaaaccgcgccagnntctcgagaaaataggaacctcggagggaaccgatgtgatggaggggatgactcnnngccgctgacccgaagacccgatgaagggggtgcccggtgaccaggntnactcgccnnngcgggg

SEQ ID NO: 38141 - DNA, 330 bp, Zea mays
  Clone ID: LIB3060-041-Q1-K1-H2
tcccggtcgacgacgcgtacggcaagagcggtggctacatcttagattagtggtacgaggagtacgaccgagggaagacgaggaacgtgcggacgtcaaagcaggactttggcgggccaaacccgttccaggaggaggcggactacgtatcgcagcggacgacgaagcagaaatcctaccgaggcaagtcttggcacaagcgggcctaacacggtagataggggggagttgagagaatacgcgcacgagacagagaatccccacacgcacatgctccttgttggtaccttgtaacacccatcggtgagggagatttacgttaaaaaccat

SEQ ID NO: 38142 - DNA, 242 bp, Zea mays
  Clone ID: LIB3060-041-Q1-K1-H5
actcggttcggaattcccgggccgaacgcaagacctgcccttgaatttacaggataccccttcctcctctccatgggtataacattccgaggtatggtgaacaaaatccatgcataaagacgcactcgaagccaatatccccgcatttattgctacaccattgctcattctatatcctactcactttttacttattatccatgtataaacagcccagtctaaaccattcattacccatccaa

SEQ ID NO: 38143 - DNA, 460 bp, Zea mays
  Clone ID: LIB3060-041-Q1-K1-H6
accggttcggaattcccgggtggacccacgcgtgcgcgcccgccagtgctcgatcccagctccttgccgcggcttccagtccctctgccggccgtggagctcggccctagctcagattcttgcgccgcgcccggctgtttctcccctgcgtgccgtggctgtgccgttcctgtgtgcgcggctcactgctcggcgtccattcccctgtgctcaccatggtcgtcgttgctccctggtgtaagttgccgcacacgttgtatcccagctcggagctccctctgcacagctcagattcagcccagccgtgctgagttcggcctttgcttgtccctgtgcttgagctccgtcctcccagccatggcgcacacactggttgcctctgctcgagctcgcccggccagagttcccggtcgccgtgtcctgtcgagcttggctccgtgcgtgcgcttttttttccctt

SEQ ID NO: 38144 - DNA, 387 bp, Zea mays
  Clone ID: LIB3060-041-Q1-K1-H8
tgcttataaaagcaccgacagtgaattcttagaatctgacagtagtcaaaatcaatgcgggtcaactgcatcaactgctgtacttgttggtgatcgtctcttcgtcgcaaatgttggtgactctagggctatcatatgcagggaaggaaatgctattgctgtttcaaaggatcacaagcctgatcaaactgatgagcggcagcgtattgaagatgctggaggttttgtgatgtgggcaggaacatggcgcgttggtggtgtacttgctgtttcgcgtgcttttggtgacaaactcttaaagcaatatgtggttgtggatccggagatccgagaggaagttgttgatgacacactcgagtttcttatccttgcaagtgatgggctgtg

SEQ ID NO: 38145 - DNA, 114 bp, Zea mays
  Clone ID: LIB3060-042-Q1-K1-A11
tccctcctaattactccctctgcatgtatacgccgagcatgtttttttggtaagaatcatcaagccccttggcgactcgtttctgagtttcgcagcggcgctagattttatttt

SEQ ID NO: 38146 - DNA, 409 bp, Zea mays
  Clone ID: LIB3060-042-Q1-K1-A9
accggttcggaattcccgggctccggcgcgtgcccgctgttcctctctccctcccggctctcttcttcttctacacgctaccgtctcacaggggtaggcgcccctcccggatgccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaactaactccaactacactgagctggcccagctctacgagaagtacaatgaccaaagctttgaaatcctggctttcccatgcaaccagtttggtgggcaggagcctggtaccaatgagg

SEQ ID NO: 38147 - DNA, 101 bp, Zea mays
  Clone ID: LIB3060-042-Q1-K1-B4
ttttttttattttgtttgttttttaaaaaattctttttattttttatattttttttttttttttttttttttttttttttttttttttttttttttttttt

SEQ ID NO: 38148 - DNA, 294 bp, Zea mays
  Clone ID: LIB3060-042-Q1-K1-B6
gaattcccgggtcgagccacgcgtccgcccgtctcgcacgttccttcccaactccgcagcgtagcctctccgcggcgcgatccagatccaggttgttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatg

SEQ ID NO: 38149 - DNA, 295 bp, Zea mays
  Clone ID: LIB3060-042-Q1-K1-B8
tcctgaattcccggatcgagccacgcgtccggaagagactcaactcctacgtcgccctcgcgctcgatacgctttgcgcattagccttaactgtggttggggggcaaagattcctcgagacttcgaagattatgccagctggtgtccttgctggcctcagtgctgtgatgtccgcgttttatctgttcaaaattgcaagcggcggcaaccacatcccaccaaagaaagagtaaactggactctaacttgtaaagtatgttcgattgaactcggaagactactagccactgcgtta

SEQ ID NO: 38150 - DNA, 414 bp, Zea mays
  Clone ID: LIB3060-042-Q1-K1-B9
cccggctcgacgcacgcgtccgatgataaactgcggattctatctatctttttcttcctaacgttccatttttaagggagggtttttacttaagttgggtgatattaatctaatatgcccattggtgttccaaaagtaccttaccggattcccggagatgaagaagcgacttgggttgacttatacaatgttatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcg

SEQ ID NO: 38151 - DNA, 324 bp, Zea mays
  unsure at all n locations
  Clone ID: LIB3060-042-Q1-K1-C12
ggtccggaattcccgggtgctcccagtcctccaggagcctcgcagcctgccgccgcggcagccactaccgcgccccttcgcacgtcccgcgccactcccgccgtctccgacgcgccgtcgtcagcctgcgtccgatggcctcgtcgacggctcaggcccccgcgacggcgccgccgggtctgaaggagggcatcgcggggctgtacgacgagtcgtcggggctgtgggagaacatctggggcgaccacatgcaccacggcttctacgactcgagcgaggccgnctccatggccgatcaccgncgcgcccagatccgcatgatcg

SEQ ID NO: 38152 - DNA, 286 bp, Zea mays
  Clone ID: LIB3060-042-Q1-K1-D1
aattcccgggtcgagccacgcgtccgacaagtccgaacgaactgaaggagaggaggatgaggaggaatggcggacgcagccagaggccgggggtcttcgactctcccggtggctaacgtgcacgcgcttgcagagtcttgcaacgacaacggagccgatgcgccggtgcccgggaggtacctcatcaaggatcctagcgccgaggaggtcgtagccgccggcgacagcgcctgcacgattccggtcatcgatttccgcaagctgctcgatccggggtcgtacgagg

SEQ ID NO: 38153 - DNA, 332 bp, Zea mays
  unsure at all n locations
  Clone ID: LIB3060-042-Q1-K1-D10
cggtctcggaattcccgacccacgcgtcccccgcacggaccccatccccaacgctgccatttcctcgctccaccccacgacagcagtgctggcccagcgccatgccgctgcgccctctctcagcgcatcgtcgctctcatggtccgcctccatcgccgtctcccgcatcccgccagcccctggcctcgcgctccacccactagtgaatcctcccgcctccggcaaccgccagagcccggtggtgtgtgcggcgtggacgcggctgtcgcgcggngaggcggagcagcggcctcaccgcatgtcgtggaagcagcgcacgaacatgtacatgc

SEQ ID NO: 38154 - DNA, 298 bp, Zea mays
  Clone ID: LIB3060-042-Q1-K1-D3
accggtcctgaattcccgggtcgagccacgcgtccggaattgttaattcatgagtcgaaaggagggacttatgtcaccacagacagaaactaaagcgagggttcaatttaaagctggtgttaacgattataaatagacttactacaccctggactacgaaaccaaggatactgatatctcggcagcattccgagtaactcctaatctcggagttccgactgaagaagcaggagctgcagtaactgcggaatcttatactggtacatggacaactgcttggactgatggacttaccagt

SEQ ID NO: 38155 - DNA, 263 bp, Zea mays
  Clone ID: LIB3060-042-Q1-K1-D8
gagcagtgggcgctacagcctccatcagctagctgccttgccgtgtcctcctcttcctcctgggggtggcgatctctgcggaaacccgagcttcgtccaagccgggcagtagtgcgcgccgcctgggcgtaattatggattcttttgagggctctgatcatataactcaaagaaaggttgttcctgcaaaacatattgcattggttgatggaaagaatgagcctgctgtagaggggttgcctaatggttggctgaaagaatgc

SEQ ID NO: 38156 - DNA, 302 bp, Zea mays
  Clone ID: LIB3060-042-Q1-K1-E7
gctccggaattccagggtcgacccaagcgtcccgtcattatagccgtgtatgatgtaactgaccatgatagctttaacaatgtcaagcactggctgggtgaaattgatagctatgccagtggaaatgtaaacaagctttaggcggagaacaagtgtaacctgactgacaacaggaatcccatcttacgaggcatggcaagaagcctaggagatgacatccgaataccattacttgatactactgccaaggatgctgcacacgcgcaaaaagcatttataaacatcctacggcatataaataa

SEQ ID NO: 38157 - DNA, 287 bp, Zea mays
  Clone ID: LIB3060-042-Q1-K1-E8
tcctgaattcccgggtcgagccacgcgtccggtgacacggacggcactagctcgaggagggtcggctagccagagtcacagcagaaggtgaaagggagcggatatgggggcggatcgtttcctgagcgtggcggatggcggcctcggcggcgaggcgctctacttcgcggtcatcctgtggctgtccgtcatgtcgtggatcatcttcacctgggtcggcgacggcggcgaggacgggaggcggcggaggaagcgccggggcagccgcggcagcccggtgttcgtcg

SEQ ID NO: 38158 - DNA, 346 bp, Zea mays
  Clone ID: LIB3060-042-Q1-K1-F12
gaatgctcatgacgagaagctcaaagaaatcaagaacgggaggttggcaatggtagccatgcttggcttcatggtgcaagcatccgtaactcatgccggccccatcgacaatctcttgacacacctttcggacccgttcaacaaaaatatcattcacacattctcctcttcctaagtactcgtcccaatgcccggatgctatggcacaaaaaggtcacaatgtttttgaacacaacagaacaacatgattattgatttacgtccttctccccaccgaataggggaaggaaggttagggaagcgttcaatcaattcaatgagatagtgtaatctatagcaaactcag

SEQ ID NO: 38159 - DNA, 295 bp, Zea mays
  Clone ID: LIB3060-042-Q1-K1-G1
ggtcctgaattcccgggccctcgtttttcctctgcgcactttttctcgtttccagccttccaggcagccacgcctcgcccgttctcggatccgctggaaaacggtcaaagccaaaccagccaaatcgcgcgcggcggcggcggcgacgagaacgagacggacgcgcgcgcgctagctgaatcaggtcaggaaggaggagagccgccggcgagcacagcagcaatgccttactgcgaggtgggcaggtacgcggacggcgacaagtgggagggcgtccgcgtctactaccgccgct

SEQ ID NO: 38160 - DNA, 396 bp, Zea mays
  Clone ID: LIB3060-042-Q1-K1-G9
atcggctgcttctctagttattctcaagtgatattttggtgtagagcttgaccaggttcagtgtttctttggacagtgcatgtgagccagcaaagtatatgtgcatgggagccacgttgagttgctcctgcagtgctgctgtgctggcatgccccagaattcatgttcaccaagttgtggtcgagttccatatgcctacctacataatcagtgatgcctgcccatatatatacaaccctttggttgggttcagtgaaggtttcctccctgctcacgaattctgtccaaagataactgaaaggtgttgtggcgcatgtgttcctgctagtattaatcttctccccagtccctagatcgatttgcttaagctggtatgtgccaccccctgtgctggtg

SEQ ID NO: 38161 - DNA, 286 bp, Zea mays
  Clone ID: LIB3060-042-Q1-K1-H2
attaccgggtcgagccacgcgtccgggcgtgctggcaaggagcttgagaaatagcttaagttcttgaagaacggtgatgctggtgtggggaagatgattcccaccaagcccatggtggtggagacattctcgcagtatcctcccctgggtaggtttgctgtccgtgacatgagacagacggttgctgttggagtcatcaagagtgtggagaagaaggacccgaccggtgccaaggtgaccaaggctgctgccaagaagaaatgatgcgacctgtcgttgatgcagc

SEQ ID NO: 38162 - DNA, 316 bp, Zea mays
  Clone ID: LIB3060-043-Q1-K1-A10
cggtccggaattcccgggcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagccagtagtcgttccatgatgtatgaagctccccttggctacagcattg

SEQ ID NO: 38163 - DNA, 409 bp, Zea mays
  Clone ID: LIB3060-043-Q1-K1-A11
cggttcggaattcccgggtcgagccacgcgtccgctcctctagtcttacctcgttgcacctcaagaaacttggcgcgcaaccaggagaccgcctcttctctctgtctgtctctctctctctctgccttctgattccaagctccccaactgcccagcaccaacctgccgaactcccctcctttttgttggtttgtcgaattataaattgagcccggccggctgactaccatgaagccgccatcactggtgcactgcttcaagctgctggtcctgctggcgctcgccaggctgaccatgcacgtccccgacgaggacatgctatcgcccctcggcgcgctgcgcctcgacggtcatttcagcttccatgacgtctccgccatggcgcgggacttcggcaaccagtgcagct

SEQ ID NO: 38164 - DNA, 475 bp, Zea mays
  Clone ID: LIB3060-043-Q1-K1-A2
tccggaattcccgggtcgacccgggcgtccgcgaggaactcatcatgaatccactaattgctgctgcttccgttattgctgctggattggccgtggggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttttagtacattggcatttgcttatgtaattctaagtatatcaatactttactttactcctatttattatattatttcttttttatattattccggaaattttgtatttatcgggacagacaataccctaggaacccca

SEQ ID NO: 38165 - DNA, 482 bp, Zea mays
  Clone ID: LIB3060-043-Q1-K1-A3
ccggtccggaattcccgggtcgagccgcgcgtccgctcaacagcaacagctaagcctctgccacatgacagcaacatggctgaggaggaggccaagagggtggaggtggaggtcaccaaggagcccgaggcggcggcgaaggaggacgtagccgatgacaaggccgtcatccccgcgaccgacccgacgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgtgaagagaatgagaagacaaaagctgagaacaaggctgctaagaaagtatccgctattctttcatgggaaaacacatagaaagcaaacatagaagctgaactgaagaagattgatgaacaact

SEQ ID NO: 38166 - DNA, 461 bp, Zea mays
  unsure at all n locations
  Clone ID: LIB3060-043-Q1-K1-A7
tcccgggtcgacccgcgcgtccaaccgcggccgcccccaagttggccaaccccaaggcccaacccgcaacccccggcttcctgcccgtgggtggaaccaaggatgggattagcctcgccaaggaggaggtggtggtcggcgaggggctcgcggggatggggatctcgaggccccttgtgatggcgatggcngtggcgctgctgatcgccgtcgccggtgcgaccgccgaggagcangagcccctgctggcggcggacgcggtggccggcgcggtggaggcggcgctcggngaggtggagaccgcggcgctcaggccgagctggcgcaacttccggcgaagatctcggcgctagagtcagacatagaagagcgatctcaagaactgaagaataagatgatgccatcatgaacctggagaaagccattgaagagaagtcaaaggctattacctctatgctgga

SEQ ID NO: 38167 - DNA, 424 bp, Zea mays
  Clone ID: LIB3060-043-Q1-K1-A9
gaattcccgggtcgagccacgcgtccgcgtctgtccgctacccctccccgaccagatcgctacgagacgccgcgcgatcggacgcaggccgacgccgacgaccgctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattcttggaaacatttttga

SEQ ID NO: 38168 - DNA, 431 bp, Zea mays
  Clone ID: LIB3060-043-Q1-K1-B11
tcggttcggaattcccggctcgagccacgcgtgcggtgtaccaaagcacaatttaacatggtagaaatggtagcagcaccatttcagggtgggcaacaaccaaaagctggtacagaagttgtttctaatgtgctactgggctccagtgtgttcctacacaatgttggtcttcagtctgccttcaagaaaagctccacaacaactgtttcggcaatggctcaacaacttcaggatgaactagagatcgagaagcaagaaaaagatggccttcaggaagaagtggaaaccttgaaggcttaagcacaagcatctcaggagaccactgatagtatgaagaggtcgatggaagaaaataacagcctccttcgtctactattaagcttcaatcgaggccaagtgcctccatcttaagtctggttgaccactatagg

SEQ ID NO: 38169 - DNA, 359 bp, Zea mays
  Clone ID: LIB3060-043-Q1-K1-B2
taattcccgggtcgagccaggcctgcaatcccaccaacatccacggccggccacccttttcctatatgccgtaccgcccgtcatcacaactgtcctgtaaaaagttcggggtggacgcccgcacctccagaatcacgtgctccctacaggacgtcaccatcaggtacatcgacgccactaatctcgccgacttctcgctctctacctattcactcctcgtataggacgcgagcgcatatagcactcccaataggctgacctacgacgagatccacagcaaaacgtacatctacgtgaaaggcacacgcactgtgaaccagttcccgaccatctactgactcctaaaatctttcccgttc

SEQ ID NO: 38170 - DNA, 375 bp, Zea mays
  Clone ID: LIB3060-043-Q1-K1-B4
ccggaattcccgggtcgacccaggcgtgcgcgggaccgaggaactggccgagttctaggtagagaatcggttttgcttgtctcagcacggggtgtgctgcgtctggtggtggtgagggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaaaccatcctgatatccctttt

SEQ ID NO: 38171 - DNA, 454 bp, Zea mays
  Clone ID: LIB3060-043-Q1-K1-B7
cggaattcccgggtcgacccgcgcgtgcggacgacttgtttcattgattcttgaagagatcgagcttcttttgcaccacaaggtcgaggatgtgttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggaggtggcagaacaataataagcgaggcccagctggctgtcatacataggtattgtgtggtgtgtgtgagacagagagaaacaca

SEQ ID NO: 38172 - DNA, 448 bp, Zea mays
  Clone ID: LIB3060-043-Q1-K1-B9
actcggtccggaattcccgggccaggacgtacgtacgtacgtagatcgatccatcgatcgctagctagctgacgaccatggcgtccctcggctgtgccgccagcgtgctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcaccctcaccgtgccgggcacctacggcttctactgcgagccgcaccaaggagcaggaatggtcggcaagatcacagtcaactaaagctagctatccattccatg

SEQ ID NO: 38173 - DNA, 376 bp, Zea mays
  unsure at all n locations
  Clone ID: LIB3060-043-Q1-K1-C4
tcctgaattcccgggtcgagcggcgcgtccgaccgagaccaagaccaccagcaggactcgcgaggagagcgcgcccggaaagaaaaaaaaaccctggcggcgcccgggcctccgccgcgcgatgtcttgcacggtggccatcccgagctcgccagtcttctcgccctcacgccgcccactctcctgcaaggccgcctccgcctcaccggagcccaccgtccccgcctctaccgcggcgcccgcgcccgccgccgccgccggctcgccgctccgccccttcgcgctccgcgcgctgctgcgggaggaggtctccccgtcttccgccgcccagccgacctccgncgcagcggtggctttggtaccgagcggggccgcg

SEQ ID NO: 38174 - DNA, 317 bp, Zea mays
  Clone ID: LIB3060-043-Q1-K1-C7
cgtgcgtgctcgttcgctttccaaagcccgggcacgcacgttggtcgtcgcgagcacgacctcgatcggaggagatggtgacgccggacgggcttgcgcggatcgagacgatcgggaagaagaagcatgacaacggtgtgtggtacgactacagctcggcgccggtgcgcgcgcagatcatcgacgagctgcactcgctgcagcggaagctgtcggcgcccatgacgcccaaacggtcggggcccaccactcccattaagggcggtgcccacttgtccttctccggcgcgatctccgaggaagatcgccacacgcag

SEQ ID NO: 38175 - DNA, 457 bp, Zea mays
  Clone ID: LIB3060-043-Q1-K1-D1
ccggtcctgaattcccgggtcgggccgggcgtccgccgccgccaaccgatccggcgccctccagcatggcgggggcgggggcgaaggcggcgggggcggtggctctggcgcgcgtgctcgcgctcgctggggccaactcggagggcgacgcgctctcggcgctgcgccggagcctcagggaccccggcggcgttctgcagagctggtaccccacgctcgtcaacccctgcacctggttccacgtcacctgcgaccgcgacaaccgcgtcacccgcctagatcttggtaatttgaacttatctggtcatctggtgcctgagcttgggaaactggagcatcttcagtatctggaactttataagaataacattcaaagaacaatcccttctgagcttggcaatttgaagaatctaataagcttcgacttgtacaagaacaacatttcggggacaatacc

SEQ ID NO: 38176 - DNA, 330 bp, Zea mays
  Clone ID: LIB3060-043-Q1-K1-D10
gttcggaattcccgggtcgagccacgcgtgcgatgatatttcagaacaagtccgaacgtactgaaggagaggaggaggaggaggaggagtggcggacgcagccagaggcctcgggtcttcgtctctcccggtggctaacgtgcaggcgcttgcggagtcttgcaacgacaacggagccgatgcgccggtgcccgggaggtacctcatcaaggatcctagcgccgaggaggtcgtagccgccggcgacagcgcctgcgcgattccggtcatcgatttccgcaagcttgctcatcccgggtcgtcccaagaggaatgccccaagcttggaac

SEQ ID NO: 38177 - DNA, 259 bp, Zea mays
  Clone ID: LIB3060-043-Q1-K1-D12
ctcggttcggaattccggctcgagccacgcgtccgacgcggtccaagcacatcaacttacattagcacagaagagaaacgggcacacgcaagtgatcaaggcataggaatattgaccgtcggcactgggcgacttgatccctgggctgccggatgaaatgaccagcgagtgccgttagctggtagtcttacgaccaactggcggaggatcactccatatcacgccagctgaagtccaatgtctattcaaccagactacc

SEQ ID NO: 38178 - DNA, 459 bp, Zea mays
  unsure at all n locations
  Clone ID: LIB3060-043-Q1-K1-D4
tcctgaattcccgggtcgagccgcgcgtacgcacgcgcgcagtcactaacgcacgccccaggttttttccttctccttgctcgttcgctcgccgtggacggctccgagcagctggaagagtcctgcgcgcgccaagtgaccggagaagctgcgagatcagagtagttgcttgccgctcccgtgccaccaaattagattggacgtagctagcagctagctgagccgtagtgcgtagcggcagctaggctgctagctcgatcgttatagctgcgtactagtggtgtcgcagcagaagcagtagccagcttcagtagccgatccggtggtaaaagcaactttttttggacatggcggcgngaggagccccggtgcttgtgaagcatgcttgcggcgtggaagagctgcggcagctcccgccggggttccggttcccgcccacggacgaagagctcgtggtgc

SEQ ID NO: 38179 - DNA, 160 bp, Zea mays
  Clone ID: LIB3060-043-Q1-K1-D7
accgtaccggcggcgttgctcggtttgctctgcctgcaggccggcccgcacggactggactgtactgtacctatacacctatatactacgacgtgcacatgtacgagtctacgacgtgctgctgtaccatactaatactagtgcgctgctgctcccttgc

SEQ ID NO: 38180 - DNA, 391 bp, Zea mays
  Clone ID: LIB3060-043-Q1-K1-D8
tccttaattcccggttcgacgccaggcgtccaatcagtgtccgaggccaaagactgtctaggcttttctaaagtgagaagatgattggatatacttgtcgtgtcttactggcagggggagacgagtgaagctattattccctcttgttgtgatccacgctgttttgcctcttcccccctacccgtttcctcccttcttgctggttgtttttctaaattcctgattgccaaccgtccctccttcttccttgccaatactagactctcctcctcctgccactgctaccgctgctcctctcaactggttaactggatcctgatttgttgagaatgttaaactggattcctttccatgtaattaaattcctctttttaccattctactttctact

SEQ ID NO: 38181 - DNA, 370 bp, Zea mays
  Clone ID: LIB3060-043-Q1-K1-E1
attcccgggtcgagccgcgcgtccgcagattgttctggagaggttgagcgtcttcttaacatggtggaaggagttcttctagtgggtggttctgtagaggggcctatgccacagacaatgcttgttcttaataaagctctagaatttgcacatgctgttgttgcagttgtaaacaagatcgactgacctactgctcgtcctgagtttgtggtgaattcaacatttgaactatttattgaattaaatgcaactgatgaacattgtgatttccaaacagtctattcaagtggaattaatagaaaagccagtctatctcctgacaatttagctgatgacctaggacccctttttgaagcaattcttagatgca

SEQ ID NO: 38182 - DNA, 261 bp, Zea mays
  Clone ID: LIB3060-043-Q1-K1-E2
cctgaattcccgggtcgacccgcgcgtcacgtcagtgtccgaggccaaagacgggcgaggcttggtgaaagtgataagattattgtatatactgttcgtgtcaaactgtcggagaggaaactagtgaaactattataccctctagttgtgatccatgctctattgcctcttcccctctacccgtatactacttttatgctgcttgttgttctaaattcctgattgccggccgtcccgccttcttccttgccaagactagac

SEQ ID NO: 38183 - DNA, 482 bp, Zea mays
  Clone ID: LIB3060-043-Q1-K1-E3
ccggtcctgaattcccgggtcgagccacgcgtccggcttcgcgtctcctactccttcctgcttccacctattaatccaccccactctcttccctgcccggtccacccgcctctaccgccgcgagatccggctccgcttccagaagcttctggaacgcccgttccatgagcgtctgatcggccgccgccatgggctgcgctggatccacccccaaagtcgacgagaacagcaagaaactgaaaaggcctaaggcttggaagcatacccaaccaattacaccggcacggctgaaacagatgcgtgatgagttctgggacacggctccgcactacggaggccaaaaagagatctgggatgctctgagggttgccgcagagtccgatctagcccttgcccaaaccatcgtggacagtgctggaatcatcgtctcgaaccctgacatgacgctctgctacgacgagagaggcgccaagtacgagctg

SEQ ID NO: 38184 - DNA, 465 bp, Zea mays
  Clone ID: LIB3060-043-Q1-K1-E5
tcggtcctgaattccctggtcgagccgcgcgtccacagatttttgtggagaggttgagcgtgttcttaacatggtggaaggagttcttctagtggttgattctttataggggcctgtgccacatacaatgtttgttcttaataaagctctacaatttgcacatgctgttattgtatttttaaacatgatcgacatacctactgctcgttctgagtttgtggtgaattcaacatttgaactatttattgaattaaatgcaactgattaacagtgtgatttccaaacagtctattcaagttgaattaaaagaaaagccagtctatcttctgacaatttaactgattaccttataccccttttttaagcaattcttatatgcattaccataccacacctttaaaaaaaatgttcccttcaaatgctttgatctaatacttattattattaacacaaatgattaatttc

SEQ ID NO: 38185 - DNA, 443 bp, Zea mays
  unsure at all n locations
  Clone ID: LIB3060-043-Q1-K1-E7
ccggaattcccgggtcgagccgcgcgtgcggacagattcgacatatatagcttgngtctcatattcttacagatggcattcccgtcactacgagctgatgcaacctgatgcaatgtaatcgccaactgaaaagatgtgattatgacttacaagcttggaggaatctggtggagccacgagcgagtgctgagctccggaggggctttgacatcatggatttagacggtggtatcggatgggaactcctcacctcgatggtccggtacaaagcacggcagaggaccagtgctaaggccgcattggcacacccgtacttcaaccgtgaagggctccttggcctctccgtcatgcaaaacgtacggctgcaactgttccgcgcaacccagaaggactacagtgaagcagcgcggtgggttatcggcctcatggcaaggtcaagaact

SEQ ID NO: 38186 - DNA, 442 bp, Zea mays
  Clone ID: LIB3060-043-Q1-K1-E8
ggaattcccggcggacaagcgtgtgggacgacgtggtggccgggcctcgcccggagacggtcctcgagaagctccgcaaggccaccaccgcgcgcgcgctcgtcatcaacgaagacgcggacggcggcagctacaagcgggcgcagtcgacgccgtcgaccccgacgacgccggtgacgccgtcgtcgtcgacgacgccgcgcggcgccggcaacgtgtggcgcagcgtcttccacccggggagcaacctggccaccaagggcatgggcgccaacctcttcgaccggccgcagcccaactcccccaccgtctacgactggctctacagcgacgagaccaggagcaaccaccgctagatcgggcgagatggatggacagtgaaaaggccatggtttgctgtcctttggggtaatctaaacgcacgcatgctctattatagcta

SEQ ID NO: 38187 - DNA, 427 bp, Zea mays
  Clone ID: LIB3060-043-Q1-K1-F12
ccggtccggaattcccgggctcgctggtcgttgcctgctgcggattgcccccaggcgggccccactcattccgctgctgatatttcgtttggttctcctttccgtcttgtccgtcgccgaggccttccgctcgctccccagctccagcaggcagatcagatccatccaaccacgaacaggaaggaaggtaggaggaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatg

SEQ ID NO: 38188 - DNA, 433 bp, Zea mays
  unsure at all n locations
  Clone ID: LIB3060-043-Q1-K1-F2
tccggaattcccgggtcgagccagcgcgtccgctctggtccgtggccatggcgtcgtccatgctctccgctaccaccgtgccactccagcaggggggcggcctgtccgagttcgccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtnccacctgctcaagtacgactncacgctcggcatcttcgatgccgacgtcaaacccgt

SEQ ID NO: 38189 - DNA, 478 bp, Zea mays
  unsure at all n locations
  Clone ID: LIB3060-043-Q1-K1-F5
tccggaattcccgggtcgagccacgcgtccgcggacgcgtgggcttacggtgggccggtagagttactggtattatgtgctttacgttatcagtgtcggcttcttttgcattgtcacccagcgtgtacagggttttagtatgttggtctaggttactttgctgatcaaggttcgaatgtatttgttcttttaaacatatgcactccgatctttatatgatggaccatttctttgtgtctgtgacggcgtttttttcatgctcggcatgttgcacagctcttgtttctgtgcaagattcaaaattttacccagcaaattttgttctttgccaactacgggtgacaggtgacagtgtgctctaaattttacactataaacgctagtttgggagccacanaaccggaaaggattgtacaggctaaaatttatttcttatttaaatttgattaagaaagatattttagtccttccaatccta

SEQ ID NO: 38190 - DNA, 342 bp, Zea mays
  Clone ID: LIB3060-043-Q1-K1-G12
cggaattcccgggtcgacgccacgcgtccgaccagcgactcccgtagctggaactcgctcgtcaaaaggagagctcagatccttcagcttttcctttcactctgcttctagctgctgcattcgacgcatatgctgaccaaaacatccagttctagtttctccactatagtttgatatatatacatatgtatagaaggtgtaataatctatcactcttgctcgttacccaggaaaaggaaacacttcgcttcagctcgttgacagacgacgactcagagcaaaatgggtatactggtgattacggtggacctagactgctgtcgctgcagagccaagatcacc

SEQ ID NO: 38191 - DNA, 371 bp, Zea mays
  Clone ID: LIB3060-043-Q1-K1-G2
accggtcctgaattcccgggtcgagccacgcgtccgcgaggaagagctcggtgatgccgcggtctacgccggagcaaagttcagggcaccagtggagccgtactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacaggaaatcttgctggtcttgcc

SEQ ID NO: 38192 - DNA, 434 bp, Zea mays
  Clone ID: LIB3060-043-Q1-K1-G5
ctgaattcccgggtcggcccacgcgtccgtgacgctgccgccgtccgccgtcctgcgtccttcaattcttaaggaaagatcaatttgatgtccgattacgcgggccagaagcgctgcctcaaaaaaagtgaagctgataattgcaatgatgaagacattggctctccgacctctatagatgcagaagttgggaaggaagcaaaattgaagaatcacaataaggaaaggaagaagaaaaagactaagttgttggaatcccagcataacaaagaagaagaggagatgcggcagctggagagctcattgtttggttccctttatgctccactggagtttggcactgaggtaagggctgcaataactcctgaccgggatgcgccttttgttttcacagataggtctgctggtggtggcatggattatcttcctacata

SEQ ID NO: 38193 - DNA, 478 bp, Zea mays
  Clone ID: LIB3060-043-Q1-K1-G7
ccggtcctgaattcccgggtcgagccacgcgtccgctcgatcgctcatcaatcgccagaggagttgttgatcgaggtgagtgaggttgaaaagcacacgatcgtcatggacggcggatactacggctgtcgcgatcagcgctacaggagagggtactacggcggcggtggcatatcaacgccggggtacgctccggcggtcccgtacgggatgtctcaagtgaacatcgagggcaacgggtgcggtcgggcgctgccgccgcagccgaccgtgaaggtgtactgccgagccaaccccaactacgccatgagcgtacgcgacgggaaggtggtgctggcgccggcgaaccccaaggacgagtaccagcactggatcaaggacatgcagtggagcacgagcatcaaggacgaggaaggttacccggcgttcgcgctggtgaacaaggcgaccgtggaggccatcaagcactcgctggggc

SEQ ID NO: 38194 - DNA, 324 bp, Zea mays
  unsure at all n locations
  Clone ID: LIB3060-043-Q1-K1-G8
tcccgggtcgagccgcgcgtccgcgcaagcaatccttcggacttcggtgggggaaatggaggccgccgccgccgccgagacggggcgcgcgcagaaaccggttgtgctgtacccttcgccggggatgggccacctggtctccatgatcgagcttggcaagatcctcggcgcgcggngactgtccgtaataattgtcgtcgtcgagcctcccttcaacacgggcgctacggcgcctttcctcgccggcgtctccgcggccaacccgtccatctccttccaccgnctgcccaaagtcgagcgcctnnccgccgtcaagaccaagca

SEQ ID NO: 38195 - DNA, 427 bp, Zea mays
  Clone ID: LIB3060-043-Q1-K1-G9
tcggtccggaattcccgggtctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcaaggaggttcttgctctttgtgatcatccatgcctcttggaaaaagaggaaaccaaatcattgttcagtgctgatgctatttctcgagc

SEQ ID NO: 38196 - DNA, 475 bp, Zea mays
  Clone ID: LIB3060-043-Q1-K1-H3
cggaattcccgggtcgacccaggcgtccggattcatctatgcccatttaaggatctatggcgtgccttcaatgcaattggtgaaggcagtgcggtgaaggaaattgtcatgctgccaaagcccatcaaggacaatgcaaacaaggccagaggaagaccggacatgccatttccaggtggtgacatttctattcttacgcgcccacccaacattttggctttactaaatgactatgtgcacgaatgctttgtggatgttgagagggattatctgtgcttgacaaaacagtatcccagacttgcaattactccagaattttctaaggttgggcattttgtacattgaacttttgttgctgatcgatattcaatgtggcttttggcattctctgtcactctagctaggtccttggatgagccacactattgacatgggtttaggtgagtgactcatcacggtgcctttatatggctcg

SEQ ID NO: 38197 - DNA, 422 bp, Zea mays
  Clone ID: LIB3060-043-Q1-K1-H9
ctcggttcggaattcccgggctggcgttctcctccccctgttaccaagtcctcctcgggttatgtgttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggctgcggctatggtggcgggcgccgtg

SEQ ID NO: 38198 - DNA, 429 bp, Zea mays
  Clone ID: LIB3060-044-Q1-K1-A10
accggtccggaattcccggggggacccacgcgtccgcccggcgaaatccttcttcggcgcgccgctggccgccaccgcggcctccgtcgcgtggccgctcccgcgcaagccggccacctccaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaactgagagctacggggtcttcaaaaaatcattaagtttcgttccaccaaattggaatt

SEQ ID NO: 38199 - DNA, 483 bp, Zea mays
  unsure at all n locations
  Clone ID: LIB3060-044-Q1-K1-B8
ctcgtaccggtccggaattcccgggctgcaagctaaggagagtgtgatcaccaacagctagtgctagtcccccttccttccatccatccatgggatgggtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgagcgagaccatgtccacacccgtgctggtggccacagcagaccagaccctgnaggacgtcgagtgccacttcgaggccgtgtcgg

SEQ ID NO: 38200 - DNA, 438 bp, Zea mays
  Clone ID: LIB3060-044-Q1-K1-B9
cggtccggaattcccgggtgcgacgccacgcgtccgcagagtttctggctcttaacaaatgcctacagaaggtatgtatgtggcttctctaagttgggtctgttgcgcatttaggaattaggattagatgattagtggattactcactcagacaagcatcttctgcaacaggcaatttttctgtttcataatcaactgggtctgaaatgtctcatatcaactaatggccgtgagaatgttatttaggcttatataagttatacagaagatatttcgttatgataatgcacaaaagttatggtgtgcaatgaaaggtatatttgagagtaatagaaatagactcattgtgctgcatccttaactgtaagtttcttgtgtgcgactcatcgtaatcgcaggtgtttcctgtttccaatttgcaggtgcaaaatgtgtttt

SEQ ID NO: 38201 - DNA, 473 bp, Zea mays
  unsure at all n locations
  Clone ID: LIB3060-044-Q1-K1-C1
ggtccggaattcccgggcacacacagcaatccacacaagcacttcgacgtcacacgggcgctgcacacagacacaccaagcgtcggcacgaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcagggagagcttcctcgccagggctaactgagcagccccggcggccggcatccacgcncgttcgtgcctgcctgcgtgccttatgtatgtctgtgattgtgcagggtcatcgtacttggctagcgtacgta

SEQ ID NO: 38202 - DNA, 428 bp, Zea mays
  Clone ID: LIB3060-044-Q1-K1-C10
ggtccggaattcccgggtggacccacgcgtccgctgcgcggtggcactgccgtcctcgtgccgggcccggccggcggggggcagccggagggcgcggatggtggtgacgcgcgcggcggcgtcgagcccgaagctgccgaacgggcggcggctgcgggtggctgtggtgggaggcggccccgccggtggcgccgcggcggaggcgctggccaagggcggcgtggagacggtgctaatcgagcggaagatggacaactgcaagccctgcggcggcgccatcccgctgtgcatggtgtcggagttcgacctgccgctcgaccttgtggaccgcaaggtgaggaagatgaagatgatttcgccgtccaacgtcgccgtcgacatcggccgcacgctcgcgccccacgagtacatcgggatggtcaggcgcg

SEQ ID NO: 38203 - DNA, 427 bp, Zea mays
  Clone ID: LIB3060-044-Q1-K1-C3
ggaattcccgcggcgagccacgcatccacgtaactaatttccagccacacaaaatactgattctaaatcctaaatcaggcaacagcacgcctacacagctggtcacacacaccttatatcaagaattcatttccaaagcaataactttgcctggtcaacgcgagattatggatatgatggaagttgcaaatcctgatgcagttcatgctgtccgtaactttattaacaacgaccttgccatgcaacttaaagatgatcttcttgccactgttaaaagcaacacgagttctgaggcttacacatttaaccatcatactatggctcggcgcacattcaaaaatacatgcctctcataccttgcatcattgaatgacccacattctcgttagcttgcactgcatgactacaagtctgccactaacatgac

SEQ ID NO: 38204 - DNA, 413 bp, Zea mays
  Clone ID: LIB3060-044-Q1-K1-C9
ggtccggaattcccgggtggacgcacgcgtccggccatgaacgttctggtcaccgcggcatcaggtggcgtcggcctctacgccgtgcagctggggaaacgggctggtctccacgtcactgccacctgcggcgcgcgtaacgtagagctggtgaagagcctgggcgccgacgaggtgcttgactacaggacgccggagggtgccagcctgcagagcccctcgggcaagaagtacgatggcgtcgtccactgcactgtcgggaccagctggtcgacgttcgagcctgtgctggctgccacggggaaggtgatcgacatcaccccgaacttgactgccatcctcaaatcggcgctgcacagtgtgaccttcgccaggaagcggctcgtgccactgctcctgtcgcccaacaaggc

SEQ ID NO: 38205 - DNA, 430 bp, Zea mays
  Clone ID: LIB3060-044-Q1-K1-D10
cggccggaattcccggtggagcacgcgtccggtgtctggcggcgcatagatagatagccatggcgaagaagccagtggaggaagcgcgcctggcagcggcggacgagcacgaggaggagagcctgagcgtgcgcgaggagctgaagaagcagctatggctggctgggcccatgatcgccggcgcgctcctgcagaacgtgatccagatgatctccgtcatgtacgtgggacaccttggagagctgcccctcgctggcgcatccatggccaactccttcgccaccgtcaccggcctcagcctgctgctaggcatggcaagcgctctagacacactgtgcggccaagcgttcggcgcgaggcagtactatctcctgggcatctacaagcagcgcgccatgttcctgctgaccctggtgagcgtccctctgtc

SEQ ID NO: 38206 - DNA, 449 bp, Zea mays
  Clone ID: LIB3060-044-Q1-K1-D9
accggtccggattcccggtggcgcccgcgtccgcctccgcgttcctcaacgctctcgtcctccgatcgccatcaccgtcgctctcgtccgcgtcgaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcgggtccgctgtcacgggggccgcggtggcggaggcgccggaggcgagagaggtcgcggagctcaaggcgcagctaaaggacgcgctgtacggcacggagcggggcctgcgggcgttcagcgagtcgcgggccaaagtgctggagctcatcacgcagcttgagacgcgcaaccccacgccggctcctacggaggcgcttacgctc

SEQ ID NO: 38207 - DNA, 408 bp, Zea mays
  Clone ID: LIB3060-044-Q1-K1-E11
gtccggattcccggtggacgccacgcgtccggtgaggtacctgatcgagagcatggatcatcgctcagatttgcggaagaagatggcggaggaatctcgtaattcagtaccatccggctcccaggggcaaactgcaaagccaaggccattccccgtgcctgatgggataccgaaaacacaggaagagctcacctaataagaggaagcgttgatgccagagtctccatacacaaggttgctgagaaggatgggtagataccctgaatggtacaccccacgccctgatcatgagactgactgaatcaagtcatctaccatccaagtgtcccttttggaagttttgcagcatgataatctgaagctgaaactcggtttatgagatattgtaatattttagtgttgcaccta

SEQ ID NO: 38208 - DNA, 446 bp, Zea mays
  Clone ID: LIB3060-044-Q1-K1-F2
ggtccggaattcccgggtcgacgccacgcgtccgctaatatatagataatcgaaatcgaaaagaactgtcttttctgtatactttccccgtgctgttgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaaagttctctattgatgcaaacgctgtacctagaggatagggatagaagaagagggaaaaatcgaaatgaaataaattaagaataaagcccaaaaaataagtcg

SEQ ID NO: 38209 - DNA, 455 bp, Zea mays
  Clone ID: LIB3060-044-Q1-K1-F4
ggcccggaattcccgggtcgacgccacgcgtccgctgagctcgcccctcccctcagccatggacacgacgacctgcagcccttcttggtggccgagcccatcttcctgctcgcgccccctctttttccacctctgcgcgtatcagctcgtccaacccccatggtgtttcctccctctcggctcccttgctccctccccatggcgttccccctggatgttggtgatctgttccccacggtgcaggcaaatgttctttccctccctgcagcagcaccttggtggttgtcgagcagcacgtcgcgcttgcgcagcctcggtcatgacgttgttcaccccgctaaccattggtgtcatacctcacgtgtcatgtgttcgccgaaatgcctaaacatgtagtctgtcgtcgtcgtatccacagtcaattttagtcatggtacgctagtgatcgagatgcg

SEQ ID NO: 38210 - DNA, 429 bp, Zea mays
  unsure at all n locations
  Clone ID: LIB3060-044-Q1-K1-G12
gtccggaattcccgggtggacgccacgcgtccgatcgatctaaaccaatccattntatatatacatacgacatgccaacggttaaacaagttagtagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctaaatgctgtcgcagtaaagaatcgtcaacaagggcggtctaaatatggggccc

SEQ ID NO: 38211 - DNA, 411 bp, Zea mays
  unsure at all n locations
  Clone ID: LIB3060-044-Q1-K1-G9
tccggaattcccgggtggacgcacgcgtccgcgggcgctgcacacagacacaccaagcgtcggcaccaatggcttactaccaggagggggagtactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcanggagagcttccttcccagggctaactgagcagcccgggcggccggcatccacgcccgttcgtgccttcctgcgtgccttatgtatgtct

SEQ ID NO: 38212 - DNA, 251 bp, Zea mays
  Clone ID: LIB3060-044-Q1-K1-H11
tcccggtcgacgcacgcatccggcgactgctagtgctaggaggccatttttaatggcacacactttttttttataaatgtacgggtagccaatttgacttgtcctgccaattccgctcaaccccctccaaatccatctataaaacacacaataataaccataaagtcaatgttcgtggattgccatcatcccttactacaactatgcgctccatcaactaataattgattccactgccaatacctactatg

SEQ ID NO: 38213 - DNA, 365 bp, Zea mays
  Clone ID: LIB3060-044-Q1-K1-H12
tgcgcttcggccgttgcggaccgcaggagtgacgattccatggcggaggagatggggcaggcgcaaccgagactcacggcgccacgttcggtccgctgtattgtcaagctaggtggagcggcgattaccaacaagggcgagctggagagcatcaacgaggagaacctacggtcggcatgtgcgcagctgcggcatgccatgtccgaatctgacggcgatggcgccatggagaaggttctgggaatggactggagtaagaagcccggagatcctgtcgacccggcccgtgacgcggagtggatcgcggggatagctaggctggggctcgacactaacttcgtcgtcgtgcacggggcccgggtctt

SEQ ID NO: 38214 - DNA, 380 bp, Zea mays
  Clone ID: LIB3060-045-Q1-K1-A10
ccggaattcccgggtcgacccacgcgttcgctcgaagagtttttcaagagcttaattatgttcaggaaggccaaaatgcacgaaggtgtaagaaactatatgccgataagcaagatgtattagtgcctgatatattttgggattacacaagtgcaaaggttctaacaatggagtggattgagggtgtaaaattaaaccatcaagcagttattgaaagtcaaggattgaaggttctggatttggtcaacattggtatccactgtagcttgagacagcttctggagtatggttactatcatgcagaccctgatcctggtaatatattagcaacacctgaggggaagctggcttttcttgattttggcatgatgagtgaaaca

SEQ ID NO: 38215 - DNA, 370 bp, Zea mays
  Clone ID: LIB3060-045-Q1-K1-A12
taccggtccggaattcccgggaggaagaaacacattggaggggctcatccggttcatctacaaggccatcaaggagcggcgggcccggagctacgggtactactactcgcggtgcaactccaccggctcgtcgcgcggccggctcggggcccgcgtggaggacagctcgtgggacctgcagcagaagcagtgggagtccgccgtcggtggcaaggcgccggcggtggcggcggcggagcgggagattgcgcaggcgcaccgtcgccaccggtccctcgacgagctggcgtgtgggggtgggcgcctagccccagtgcatcctgctcgactgctacgagtccctcatgtgcccgtcggtgacactgggcct

SEQ ID NO: 38216 - DNA, 390 bp, Zea mays
  Clone ID: LIB3060-045-Q1-K1-A5
cgggtcgagccacgcgtccgctttctcttctcccattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgctcgccgcctgccgctcgccccgctcgccgcctccgactccgccttcgagtcctccgtcggagttaactacgcggagcccgacgactcggagaaggataaggaggtggagttgttcggatcgggtgacgacgagggggcgggtgagttggtggatgaccattccgtagaggtctcagccgctgtcg

SEQ ID NO: 38217 - DNA, 72 bp, Zea mays
  unsure at all n locations
  Clone ID: LIB3060-045-Q1-K1-A7
taccggttccggaattcccgggtgcgagccacgcgtnccgtgcacctgcatcttcggccctgtgatcccttg

SEQ ID NO: 38218 - DNA, 407 bp, Zea mays
  Clone ID: LIB3060-045-Q1-K1-A8
accgtccggattcccggtcgagccacgcgtccgcgctcgttccctttcgaaagcccgcgcacgcacgtcggtcgtcccgagcaggacctggatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtc

SEQ ID NO: 38219 - DNA, 371 bp, Zea mays
  unsure at all n locations
  Clone ID: LIB3060-045-Q1-K1-B1
ggaattcccgggtcgagccacgcgtccgcttcgtgttcgtgccgaagagctccacagttcgtctggttccaaagttaccaagtaggacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcngcgacaaggccatcgcggacgggagcctnctggacctnctgcgccaggttgttcacgttcggggctcttccctggtga

SEQ ID NO: 38220 - DNA, 413 bp, Zea mays
  Clone ID: LIB3060-045-Q1-K1-B2
tgctcgtaccggtccggaattcccgggccttgagccacttgagctgtgctacaaatcactgtgtgactgcggcgacaaggccatcgcggacgggagccggctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccct

SEQ ID NO: 38221 - DNA, 439 bp, Zea mays
  Clone ID: LIB3060-045-Q1-K1-C10
tccggaattcccgggtcgacgccacgcgtccgctcctcccagccggcagcacctaacccgtcacgagcgcaccgccgcacgttccggatgcccgaccgccgccgggatcccgaccggatccctaattccaaggggtaaacgatgaggccgcacgcggtggggacgggcggcggtggcgtggggaggcggaaggcggaggccgccgctgctgccgcaagccgggagtggatggtggtgccggcgtcgggtccggctcgggtggaggaagccgggaagcacgcggtgatggcgcgtacagggcttcccgcgcgcgatctcagggtactcgacccgttactctcgtacccgtccacgatcctgggccgtgagcgcgccatcgtcgtcaacctggagcgcgtcaaagccctgatcacagccacagaggtgctgcttccaaaca

SEQ ID NO: 38222 - DNA, 350 bp, Zea mays
  Clone ID: LIB3060-045-Q1-K1-C12
ggtgcacagcatgggaacaattaattccccacagctgaaaaaccgatgctgaaccgaacgaggaagaagcctgagcagcacagacagtgagtaagcaaacacttgacatgtcttgcctcgcgagctcctgcaccggaacagtataaaccagcgaccgccgtggccttgattattctataagaacggcgctcgccgtcgccgcttacccgaacgcactcgacgctgtcactctccgtcgacgaactcaaactcgtcctcacggaggtgggcgaagaaccggacgggcttgggctggccctcgacggcgagctcgaactcgaccttgaaggggaagttggccgtgacgcgct

SEQ ID NO: 38223 - DNA, 411 bp, Zea mays
  Clone ID: LIB3060-045-Q1-K1-D8
gtccggaattcccgggtcgacgccacgcgtccgtcaatatataattgctccagtgaataactaaaaaaaaaaaatagaaggacggtagagagtagagaaaaggactaatcataatatctatctttaaaagattcaataaaaagacagttggcgggtctctttgtatgtcttgtccggaaagaggaggacttaatgattattcgttcgtcggaaccagaagttaaaattgctgtggatagggatcctataaaaacatcttttgaggaatgggccagacccgggcatttctcaagaacaatagctaagggccccgatactaccacttggatctggaacctacatgctgatgctcacgatttcgatagtcataccggtgatttggaggagatctcccgaaaagtctttagtgct

SEQ ID NO: 38224 - DNA, 414 bp, Zea mays
  Clone ID: LIB3060-045-Q1-K1-E1
cggattcccgggtcgacgccacgcgtccgaaacactggacgcgcccgcgcgtgcgagaggcccaagaaacccacagcagccgctaggcgtgaggatggcggacaccggtgacgtcgccgccgccgccgaggcctcggcgcgaccggcgggcagcagcagcacccagccgctggcggggcgcgtggcgatcgtgacgggcgcgtcgcggggcatcggccgcgccatcgccacgcacctgtcctccctcggcgcgagcctggtgctgggctacgcggcgcgcgccgacgaggcgggcgcgctggcggcgtcgctcccgcgcgcggtggccgtgcgggcggacgtctcggacgaggccggcgcgcggtcgctcttcgacccggcgacgaggccttcggcggctcgcacattctggtg

SEQ ID NO: 38225 - DNA, 454 bp, Zea mays
  unsure at all n locations
  Clone ID: LIB3060-045-Q1-K1-E11
tgctcgtaccggtccggaattcccgggttctctggcaaccggtaaacctcctctccctttcttttctgtggtgcggtgcgttcaagatgtccggatgtacgtgcgcatcgggttttgggatcggattgcgcctcctgcgacatagggagtataccgtgctcttttgtttctccatggattgatactttctctgtcgattcttatcaggtcggaagatgttggatcttccgcttcaaatcgacgcataaaggacgcagattagttttattcgcgtcaaatttattttgctcggtgtagttctgttcattaattaataattttgtactggatttaaggtgcttttattttgaaggtttcttctcccggaaattttcacatcccgaaacgactggaaattgaagtagccatttgatgctgttacctgngttcataagttgttagacttgttatttgg

SEQ ID NO: 38226 - DNA, 444 bp, Zea mays
  Clone ID: LIB3060-045-Q1-K1-E7
taccgttccggattcccgggtgcgcgccacgcgtccgctcgtcacttcgctaccagctcgagtccatccacgcggatctgattgctccggttcgttcctttgcgatcttgctctgctctgctctgctcccgagctctgctgattgctggtacttcttgtgtaagaaccccgctttggaaagaaccatgctgtatgtccatgtccaccaaactgaccaccagcttccgtatcggtatgcatcttcagtgcttatctgcataagcaacaacaacttcggtccagagtcttatattgcgctgccttcagatgtacatggaccagaaagaagtggtcgatgccctatgccaccactcgaagatagagccctgcattactgaacttgcatgcctacaacttgagcatcaaaatccttctgttttcaaggcgtactatatgagactaatg

SEQ ID NO: 38227 - DNA, 434 bp, Zea mays
  unsure at all n locations
  Clone ID: LIB3060-045-Q1-K1-F12
tcccggttgaagcaacccttccgcggcaaccgtccccgcccgcggcggttccagcgcttgctgccccgccgttccttggggaaggtaaccaggaagggccccgtcccgtgcccgctgcaacccgcgctgctggcgcccccgctcgtgcccggcttcctcgggccgncggccgagcccacggttgagccggcatcgactccgacgtccgtgcccgactccggcctgggggtcctcggtctcgaacctgaaaggattgctgaaggttccatcgataacacagtagttgtggcaagtgagcaagattctgacattgtggttggaaaggaacaagctcgagctaaagtaacacaaaacattgtctttgtaactggcgaagcttctccttatgcaaagtctgggggtctaggagaatgttgtggttcattgccatttgc

SEQ ID NO: 38228 - DNA, 458 bp, Zea mays
  unsure at all n locations
  Clone ID: LIB3060-045-Q1-K1-F8
tccggaattcccgggtcgagccacgcgtccgctcgcctcggcctcttttaaatatcgcgcatcccggcgccgcaaatggctcacgcggcgctgctccattgctcccagtcctccaggagcctcgcagcctgccgccgcggcagccactaccgcgccccttcgcacgtcccgcgccactcccgccgtctccgacgcgccgtcgtcagcctgcgtccgatggcctcgtcgacggctcaggcccccgcgacggcgccgccgggtctgaaggaaggcatcgcggggctgtacgacgagtcgtcggggctgtgggagaacatctggggcgaccacatgcaccacggcttctacgactcgagcgaggccgnctncatggccgatcaccgtcgcgcccagatccgcatgatcgaggaggcgctcgccttcgccggtgtcccagcctcagatgatccagagaagac

SEQ ID NO: 38229 - DNA, 427 bp, Zea mays
  Clone ID: LIB3060-045-Q1-K1-G10
ccggaattcccgggtcgacccacgcgttcggagcgcacaccacacacaatcagatctcccccaaaaccaacccgtgggaacctccgcttgaagaggcaaaccttggggaaaaccctgacctggcaaggactatcaccctcgaggggggagtcgtctgacaccattgacaacgtttaggccaagatccatgacaaggagggcattcgcccagaccagcagcggctcatctttgctggcaaacagcttgaggacgggcgcacgcttgctgactacaacatccagaatgagagcaccctacaccttgtgctccgtctcaagggaggcatgcagatctttgtgaaaaccctgaccggcaagactatcaccctcgaggtggaatactctgacaccattgacaacgtcaaggccaagatccaggacaaggaag

SEQ ID NO: 38230 - DNA, 237 bp, Zea mays
  Clone ID: LIB3060-045-Q1-K1-G12
ccggaattcccgggtcgaccaacccttcggccaattatttcggttgttgaaattcgattgggtcctcctttccgcttggtccgtggcgaaggccttcggttggttcccaagttcaaccaggcaaataaaatccttccaaccccgaccaggaaggaaggtagaagaagggcctaaagttgacccttaattgccgccgcggtttcatggtagttgaacccaaaggccccgtttttaatc

SEQ ID NO: 38231 - DNA, 323 bp, Zea mays
  Clone ID: LIB3060-045-Q1-K1-G3
tccggaattcccggtccggtgctcagcggaacagctagctatagcctgtagctagcagctagcttcagtcacaggccggacggtcgggtcacgggcagctagctagctagccgcgcgccggcgccatgatgaacctgaacctgaagcagccgctcgtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagc

SEQ ID NO: 38232 - DNA, 275 bp, Zea mays
  Clone ID: LIB3060-045-Q1-K1-G4
cggttcggaattcccgggtcgagccacgcgtccgctgactcttatcgagttgatctaggtatccatctcttactaatctaaataggatgagacattgtctatagggggccgtctacatagccagcgatatcaacacaaatgacattctgatcctgaagatggttcacattgaaaatgaccacgatctgtagctattcacctattttaacttaatagatcattctgcagcgtttccaccatgtcttacatcgacgatctacaagcacgtcagtacc

SEQ ID NO: 38233 - DNA, 393 bp, Zea mays
  Clone ID: LIB3060-045-Q1-K1-H12
taccggtccggaattcccgggctagcgtccggtaaacgggggcgacgacgcgcgcgaacccggagccgacgctggtgacgaagcgcgccgccgtgagcgcggcgaagctggtgccgagcgacatggcgagcgcgccggccatgaggaaggcgttggcgagcacgagggtgcggcggcggcccaggtggtcggccacccagccggcggcgaggatggacgcgagcatgaacacgttcatggatcccgccagcacctcgacctcgccgtcggtgagccccacgtcctcccgcatgaacagctccgcgccgctcatcagcgtcaggtctgcagggcacgtatatgggtcggtcgtaagcccatgtagcatggtggtgacggaggcgagcgtggcgc

SEQ ID NO: 38234 - DNA, 441 bp, Zea mays
  unsure at all n locations
  Clone ID: LIB3060-045-Q1-K1-H7
tccggaattcccgggtcgagccacgcgtccggtgcattaggttcataggaattgcttgaaaccctttgatgcattgctttccttgatgtccggacctttatagatacttctgtgaagtatcaaaatatgatttacaaaaatgcttagccttgcttagatcttgtggatagaggttgtcctcagtctaacccgggagaggatggcttctacctgcaagaatattttcatttggagcaatagtgggatcttactgcaaagttccctgtgatgctctttcatcctaaggaacagacacaatcctaaggatggaaatacttanattgagacttgngttaggaacaggtgacgttctacccaggttggttaaggattaatgcgtatgtaggcgtgctgaccgaggaccctttaactggtcacatgcctcgtcatgggtaagccttg

SEQ ID NO: 38235 - DNA, 443 bp, Zea mays
  Clone ID: LIB3060-046-Q1-K1-A11
accggtccggaattcgcggggggagccacgcgtgcgcaaaatgagctcgtagaatcagctgcagagatgctttatggtctgatacatggactgtacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatactgccccaagtgtgaagacatctactacccacggtccaagtaccaaggcaacatcgacggcgcatactttgggacaacgttccctcatctgttcctgatgacatacgagcacctcaagccacagaagctctcgcagcgctatggtcctcgtgtctttggcttcaagctccacaagccatgaacctcatgtatttgtctttt

SEQ ID NO: 38236 - DNA, 287 bp, Zea mays
  Clone ID: LIB3060-046-Q1-K1-B10
accggtccggaattcccggggggagccacgcgtccgcgaaggcgtgcaggacgtgacggtggacgcctcgcagcacaaggtgactgtgaggggcaccgtggacgccgacacgctcatcaagaggctgtacaagtccggcaagaagggagtgccctggcagtgtcacccgcccgccaagaacagcgagcccgcgccggaggccccgccggctccgcagcctgccggcgacggcggcaaggatgctgctgctgctgctgctgtggccgcggcggacaagaagtccgagg

SEQ ID NO: 38237 - DNA, 425 bp, Zea mays
  unsure at all n locations
  Clone ID: LIB3060-046-Q1-K1-B4
tcccgggtcgacccacgcctgccggggacccgaacccccaacccacggttccaaggtggccaatccagccccagccgaccgaaacctctccggtctcccggctctcgaccggcgaccgccatggccgccgcgacagacaagaccgctgaggacatccgccgcgagctccaggagctccagcgtcagcaccgcgagatcaccgagcgcctgcgcgacccccgtggccttcgccgcggcgcccccggccctggtcctggacccggggccccacgcccgctccgcggctttgcgagacccgctgtgggtccggaatcgggggatcaacctncgcagaagcgtcggctgctatcagccgtagttaaggtggatggggctgaacataacgaggaaggcacaaaggatgcggatgccgaggggcatgggac

SEQ ID NO: 38238 - DNA, 395 bp, Zea mays
  Clone ID: LIB3060-046-Q1-K1-C1
tcccgggtcgacccacgcgtgcgcgacacgatcgcgagcgcacgcacgtaagcacgttgtcggaagctcaagttagaagaggcaccagtgggtgatcgatggcggcccaagctctcctctccggccggcagctgctgggccgccccgtgcagtcggccgtctctaggtcgtcggcgaaggaaggcgccccttcgtcgtaagggccagctccagccctccagccaagcaaggtgccgacaggcagctgtggttcgcgtccaagcagtccctctcctacctcgatggcaccctgcccggcgactatggcttcgacccgctgggcctttcggacccgaagggcaccgggggcttaatcaaccccaattgcttggcctacggcaaggtgatcaacggcc

SEQ ID NO: 38239 - DNA, 430 bp, Zea mays
  Clone ID: LIB3060-046-Q1-K1-C10
accggtccggaattcccgggatccgcttgcggcaaaaccttgcgcgcaacaatggccgcctccctcccgaccaccgccgcgcgcctcggggcggcggccttcgcctaccggtcgcccaaggctccctccgccaccgccctcccgcgtgccgccgccttccctgcaatcgccgtcgcggcggcgcccctgcgcccgcgccgcgcgccgaggccggtggcggcccgggccgggggcgaggagcgggagacgatactgctccccgggtgcgactacaaccactggctgatcgtcatggagttccccaaagaccccgcgcccacccgcgagcagatgatcgacacctacctcaacacactcgccaccgtcctcggcagcatggaagaagccaagaagaacatgtacgcattcagcacgaccacctacaccgggt

SEQ ID NO: 38240 - DNA, 440 bp, Zea mays
  Clone ID: LIB3060-046-Q1-K1-C5
taccgtccggattcccgggtcgagccacgcgtccgggattcttgaacctctttcacgctcatgtcacgtcgaggtactgcggaaaaaaagaggcgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtag

SEQ ID NO: 38241 - DNA, 318 bp, Zea mays
  Clone ID: LIB3060-046-Q1-K1-C9
gtatcactatcaacagtgcagaatttccttagagttgcaataattatatccccaatagctcaattgaagcaatttaagcaacaaggacaatggggagccggacgtttccataaccataataacaaggttaaccttgtatagtaagaattgaacctttggatctaacaacaaacaacacatccacaggatgaggaaggatttcacctttgaggccaatcctcacaccgcggaaagttcctcgacgtcccttccccgtccgtcgacaacgccaccgaacctgggcacatccaggccttcaccgattccgtcgggcatgaa

SEQ ID NO: 38242 - DNA, 402 bp, Zea mays
  Clone ID: LIB3060-046-Q1-K1-D10
accggtccggaattcccggggcgagccacgcgtccgcagaattattcaagtggcaatcagggccctgtcctgctacctggccttgtgcggctgcaggagagtgacaaaactggacaagattgtccatctagtgatgacaagccatctcactcccagaagagtgggtatgaacacaattttgccgttccagtccatctaccgaattttgcaatgatgccagccgctcaacctgctgtcagtcagagtgagaagaagttaagtgaccaccagcaccaccagcaacagcagcagccacaagtcagccgaggccagagtgtgaggattgatcttgcctcttctcagccttttgtgatgccctttggctccattggtcctgctggatctaccccaagtggtcttgac

SEQ ID NO: 38243 - DNA, 435 bp, Zea mays
  unsure at all n locations
  Clone ID: LIB3060-046-Q1-K1-D12
accgtccggattcccgggtcgacnacgcgtccgcgaagcttcggattgccgcgccgatggccgagcccggcccgcgccttccctgtcctgtgtacgcgcgcagctcgccccctcagctcgtcgcgcgcctgggatgcttgccggcgctcagctccaccgcgctgtgaagtctctgcgcgcaagctatctgttggccgcgcacgaactcctctgcttggcccgtcgtcgttctccagctccttaccgcactcgatcgtttcgtcgtctcgtcttaatgccagtccccacgtgacatctctgacgtatgttcacgccgacaaaagaatcccaagaaaatgtagagaagcaagcctttggtcgatgttcaagtggtcgacgaaaggccagaacaagaatcatcactgtttatgcggagttatacttaatatgaaaaga

SEQ ID NO: 38244 - DNA, 276 bp, Zea mays
  Clone ID: LIB3060-046-Q1-K1-D9
acatacaaaaaccaggaacgcttgttattaactactaatacacaccagtgtatttcttatctaacagcggttttcttgcataatacttctatgtttcctcgtaacaaatgctatatttctaacctattaacccgcagcgggctgcactacagcaacacttgttttgtgttgtgccgctggatctttccgtccaccgttacaccgtaccttaccgcttcctagccctcctgcaaaccttctggcagtgccgaacatgactgcctttgtcaacaaccc

SEQ ID NO: 38245 - DNA, 415 bp, Zea mays
  Clone ID: LIB3060-046-Q1-K1-E10
accggtccggaattcccggggggagccacgcgtccgcacgcgcgcagtcactcacgcacgcccccagctctctccttctccctgctcggtcggtcgccatggacgctccgagcagctggaagagtcctgcgcgcgccaagtgaccggagaagctgcgagatcagagtagttgcttgccgctcccgtgccaccaaattagattggacgtagctagcagctagctgagccgtagtgcgtagcggcagctaggctgctagctcgatcgttatagctgcgtactagtggtgtcgcagcagaagcagtagccagcttcagtagccgatccggtggtaaaagcaactttttttggacatggcggcggagggagccccggtgctggtgaggcatgctggcggcgtggaggagctgcggcagc

SEQ ID NO: 38246 - DNA, 429 bp, Zea mays
  Clone ID: LIB3060-046-Q1-K1-E7
ttccctctcatcctctcgacctcgcttcctccctcccaccgtgccctgccttttcctgacgacctcgccgccacgctcgcgtctcgccgctgattgcggtcccccatggaaccgtcgtcctctcaatccgtccgccgctccatcgtcttcctgtatttgtgctgctgatatgtgtaacttgtgtttctccaggtgaaggcggccgagcacgcggccgagatggaggcgacggtggtcgtcgcggctgccgtggaggccgaggaggaggaggctgctgctgctgcggcttcgacgccgcagcggtctgggaggaaacggccccgcgcgattgggagtgggcggtaccgctcggtgtccaggtgtttctcccaatctcccctgctttcctcatcctgctgccgcttttgcttttaatcgctgtgacagcat

SEQ ID NO: 38247 - DNA, 372 bp, Zea mays
  Clone ID: LIB3060-046-Q1-K1-E9
taccgtccggattcccggtcgagccacgcgtccggtgtcattgattcttgaagagatcgagcttcttttgcaccacaaggtcgaggaggtgttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgctgcggagtccggcgaaggccgccacggctgcagctgcggtggcaactgcaagtgcgacccctgcaacttgtgatcacatcgatcgacgaccatggatatgattattatctatctaacttgtggtggtg

SEQ ID NO: 38248 - DNA, 439 bp, Zea mays
  Clone ID: LIB3060-046-Q1-K1-F6
taccggtccggaattcccgggcttgtgaagaggcacgcaacagagattttcacatcaattgccatcgcgtcgacattctctgggtactcaactggtatcatagggcgcctgattgggctagagccatcgttaaccatatcaatactgccaaggtgtattactctggcgctggctttgagcatagtgtctttctttgaaggtgtaaactcttcggtaactgctgtcgtggttgtccttaccgggctcatcggtgcgaactttgtgctagcagccatggagaaacttggtctgaacgaccccatctccagaggagtagggacagcttccagcgctcaaggactgggaacagcagcactggcggccaaggaacctgaagcgctccctttctgcgccatcgcttatagtttcacggggattttcggcacgctgatctgctcgg

SEQ ID NO: 38249 - DNA, 433 bp, Zea mays
  Clone ID: LIB3060-046-Q1-K1-F8
cccacacatacgcggcatagcaaatcacctccattcctattccaccctccttccaccggtactcaactcgctaccatacaacatcccttcccgctcccaacaatcccaaccatacaaacacacacacactaaaccactgtcgccctctctatcatcataatctctaaccactacaaccaccaactccccgctcactcctcacctcctttcccctaccatgctcatccatcctacccttcccctaactcccattaccactctacctctgaactaactcatatcaatacgaatacccaccgctactctcactcagagcactctctcacctactttctctactccaccaacttgaaccactcgttctttcccccatccctcatcttccacctagccaacaagctatgctcatccactctcctcttcacactcctct

SEQ ID NO: 38250 - DNA, 382 bp, Zea mays
  Clone ID: LIB3060-046-Q1-K1-G1
tcccgggtcgacccacgcgtgcgcatacttgcacttagctgcaaagatgccaattattcacagagatgtcaagtcgtccagcatactcctagatgacaacttcactgccaaggtgtccgatttcggtgcctcaaggccaataccgcacaaccagacccatgtgacaacattggtgcaagggacactagggtacatggaccctgagtacttccagacaagccaactgactgagaagagtgatgtgtacagctttggcgtcgtactcatcgagctactgacaagaaagaagcctatcatggatgatatcgcggaagacattagaagcctagcgcttcaatttagtatgctattccatggaaataagctgttggaaatcgttgat

SEQ ID NO: 38251 - DNA, 413 bp, Zea mays
  Clone ID: LIB3060-046-Q1-K1-G10
accggtccggaattccggaggggagccacgcgtccgggaggaggatcggtaccagctcacggcggcgtcagcaccacacgccgccgagccggccaccctcttccggacaggcacgcttcttgcgcctcttgtgctatgctactacggataacgtacgcccaacccacgccttcggcggcagtccatttgaggctccctgagccgcgtttacgccgacgccgcgtcactgcttccgcggcagactgcgccttcaattcaagctctccgctacattgcgacccttcgccccacgcgtaccttctgggtccgagcgtccaacccagtggctcactctcactgagtacatatccaattacagagaagggaaagccgatgtcttgagtctttccaagtgggcagtactaccgtgagct

SEQ ID NO: 38252 - DNA, 450 bp, Zea mays
  Clone ID: LIB3060-046-Q1-K1-G9
accggtccggaattcccgggggtcatcctcggcggtggcgccgggaccaggctcttgccgcttaccagacgcagggccaagcccgcggggccgattggcggcacgtacaggctcatcgacgtgccgatgagcaactgcataaacagcgggatcaacaaggtctacatcctcacgcagttcaactcgcaatccctcaatcgccacctctccagagcctacgatttcagcaatggcgtggccatcggagacggattcgtcgaggttctagcagcaacccagaggcctggaacggaagggaaaaagtggtttcagagtactgctgatgcaattcggcagttcgactggcttttcgatgatgcaaaatctaaagacattgaagatgtgctgattctttctggtgaccatctttaccgtatggactacatggactttgttcagagtcatcggcaa

SEQ ID NO: 38253 - DNA, 285 bp, Zea mays
  Clone ID: LIB3060-046-Q1-K1-H11
accgtccggattcccggtcgagcacgcgtccgcggacgcgtgggttgcattgcattctcaggagtgggtactccatctcaaggagggggtccatggcgtcgctgatggcgcccatggcgggcgccttcttcctgctgatgaactcgagcgacttcttcctgtacctgagcacggccgtgatcggcacgtgcacgggcgccatcgcgtcagtggccgtgtcggcgacgagcgagctgttcggggccgagaacttcggcgtgaaccacaacgtggtggtgagcaaca

SEQ ID NO: 38254 - DNA, 438 bp, Zea mays
  Clone ID: LIB3060-046-Q1-K1-H4
cccgggtcgacccacgcgtgcgcctagttgttggtttagtttatgcatggcgaaaaggagccttggaatggtcttaactgaatattcagggaaaaaaaaaaaaaagaaggaaaagattccattgagacaattatgagtttgattgagtttccgttactcgaccaaacaagttccaattccgttatttcaactacactaaacgatctttcaaattggtcaagactctcaagtttatggccccttctatatggtaccagttgttgtttcattgaatttgcttcattaataggctcacgattcgactttgatcgttatggattggtaccaagatcaagtcctagacaagcggacctaattttaacagctggtacggtaacaatgaaaatggctccatctttagtgcgattatatgagcaaatgcctgaaccgaaatacgtc

SEQ ID NO: 38255 - DNA, 432 bp, Zea mays
  unsure at all n locations
  Clone ID: LIB3060-046-Q1-K1-H6
aattcccggggcgagccacgcgtccgcgggcagccaccgcagacgatccctagttccgcgtccccgacccggaccctcgagtgcgcacgggctccggccagattcgcgcggtctaagcttcgaatcggcgcatggaggcagcagtagccgccgcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtccccctcggagtctctgccaccgtcctcgtcgatggcgccgctcaggatggaatcgcccgcggngcagctactctcccagattcttcacacgcacccgcacctgc

SEQ ID NO: 38256 - DNA, 435 bp, Zea mays
  Clone ID: LIB3060-046-Q1-K1-H7
taccggttcggaattcccggcgggagccacgcgtccgcgggcagccaccgcagacgatccctagttccgcgtccccgaccctgaccctctagtgggcacgggctccggccagattcgcgcggtctaagcttcgaatcggcgcatggaggcagcagtagccgccgtactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaagcgaaacagtgtggtcagggcctactggtccccctcggagtctctgccaccgtcctcgtcgatggcgccgctcaggatggaatcgcccgcggggcagctactctcccagattcttcacacgcaccc

SEQ ID NO: 38257 - DNA, 449 bp, Zea mays
  unsure at all n locations
  Clone ID: LIB3060-047-Q1-K1-A1
tccgggttgaaccaagccttccggccaggccaggaattaaggctttgcaggcccaaaaagcggtgggaaaagcagcgaccatggcctaggcgggtttgagatccgagggaacagatggattactagggagtgacagctaggagcaatctgtggagatactatgtaaatgtcacaggagttggcctgtggtgatgtgcgataaccgggccagtgggttctgagcgtaagacgaggtctctagcaatgatatgttgtagcgtgactaaatcgagatgagcaatcaggttgttgtctgttgattctttcggctgaccatttcggctgctgaggccttgatcctgtatttgagatgtcaggcctacttagagcaaatgctggaaggaagcaatgtgcctgttctgaggtcccttcagcatcacttgtaattngtaaagtactcaagtacagac

SEQ ID NO: 38258 - DNA, 452 bp, Zea mays
  Clone ID: LIB3060-047-Q1-K1-A2
cgggtcgaaccaagccttcggtcaaattcctttcgggccttttctttttggccccttttcttccaaaactgcgattggggcaggaacccttgaccacaatcgcaaccgcaggcacttccttttccggaagctcaagttagaaaaaccaccagtgctgatcgatggcggccaaggctctcctttccggccggcagctgctgggccgccccgtgcagtcggccgtctctaggtcgtcggcgaggaaggcgcccttcgtcgtcagggccagctccagccctccagccaagcaaggtgcctacaggcagctgtggttcgcgtccaagcagtccctctcctacctcgatggcacgctgcccggcgactatggcttcgacccgctgggcctctcggacccggagggcaccgtgggcttcatcgagcccaatggctggcctatggcgaggtgatcaacg

SEQ ID NO: 38259 - DNA, 434 bp, Zea mays
  Clone ID: LIB3060-047-Q1-K1-A7
cggttccgaattgccggctggacccactcgtccgcgctgatatgcccttgagccacgccttccttcttatcccctgcgcctgcccgcgccggctgcatcgcccgtcgcctccctttccccttccctccctccctctccccgcgggccgccagaggcaatttcgccctcgattcgacccctattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctaccagcgctttcttcgtgttcatggaggaatttcgcaaggag

SEQ ID NO: 38260 - DNA, 445 bp, Zea mays
  Clone ID: LIB3060-047-Q1-K1-B1
attccgggttggaccaacgcgtccgcccacgcgtccgcgcgaagtgcacagagggggggaaggaaggagacaccacccagagggagtgaccgtctgcgaggaggaaggagaagaggctgattcgatcgagcagcatggcgcggcggccacggccgtgtgcccacctgacggccacgctccttctgctcgccgtcgccgcggcggtcgccagagccgtcgacggcgacgagaagtgcggcagcccgtgcgggaacccctgcggcgagccgtgcgtgtacgcgagcccgccgtcgtcgtcggtctactacccgtcgtcgtcgtcgcccgtgtactcgccaccgtcgccgtcggagtactacccgccgacgaccccgaccccgaccacgccctactgcccgccgtcgtcgtcgggcggcggctacgagccgtcgcccggatacacgcc

SEQ ID NO: 38261 - DNA, 415 bp, Zea mays
  unsure at all n locations
  Clone ID: LIB3060-047-Q1-K1-C1
caagccttccgatctcctcaacggcgatggccggtacccccatcaaggtgggctccttcggcaaggggggcgtgaccatgcgcaagaccgtgggcaagcccaaggtggcggcgtacgtcagcccctgatacggtcactaccgaatcaggttcctataaaacgttctcggcgagcccccgagctacctcaccggcgagttccccggcgactacggctgggacaccgncgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaagccgtctggttcaaggccggctcccagatcttcagcgaaggcgggctggacta

SEQ ID NO: 38262 - DNA, 314 bp, Zea mays
  Clone ID: LIB3060-047-Q1-K1-C12
gcctcagatcatccaccatagctcgcgaattccaaattttccccaaatcgaccggaacaccgccgtgaggcatcgcgccgtgtccagccgttctcaggtgatgaaactgctgagctctgctgtttctgttccaaggtggttcccaagcaggaggaggaaaactaaggcttacctgggaaggtgtttttccttccagtgatgtaataataagtttatacccgtatatgtaataatcaactctttctatattttacttatgaatgtgaactatgttattgtaaaaaaaacatcaacaaggacaaaataaacatatg

SEQ ID NO: 38263 - DNA, 463 bp, Zea mays
  Clone ID: LIB3060-047-Q1-K1-C8
taccggtccggaattcccggggttgatcgaggtgagtgaggttgaaaagcacaccatcgtcatggacggcggatactacggcggtcgcgatcagggctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggtgaggccatcaagcactcgctggggcagtcccacccggtgcgcctggtgccctac

SEQ ID NO: 38264 - DNA, 455 bp, Zea mays
  Clone ID: LIB3060-047-Q1-K1-D2
ccgggtcgaaccaagccttccgggggaacccaattgggaatcaagatttccatatgctggtggcaaatcctcgcaaacggaagtggaccattcaagtgaaggattcaattggtctaactgacatcactattggcaccggagaggtggagctagggtcacttaaagatacagtacctacggacaaaatcgtgactctatatggaggatggggtttgtttgggaagcgagaggctggggaagttctacttcggctgacatacaaggcatatgtcgaggatgaagaggaagaagacgaggcggtgagaagcgagattggtgcgggttacgcctcagacgaggatgtgctggactacgttagtggcatgagcaaggggactgatttcgtgggtaaagaaagggaaactttcatggatcttctcgccgcgctgctggtgagcgaggagttccaaggcata

SEQ ID NO: 38265 - DNA, 409 bp, Zea mays
  Clone ID: LIB3060-047-Q1-K1-D8
gattcccggctcgacccactcgtccgtactctggtactaatatgacctatgattgccaggagaatacaggctttattagtatagacagaactcatgctcactgactactattgactcactgtagcgatcggccaccgacttaaacaaatgacactccatcttgtaccacatcacattcatcacctgatctaatactcacctcatactcctacagctcaactccatgctcgattgtctcagaatataccaagtgtacatcaacatcgtgctgccgtccaaccttccagacatctacgatatacaaatatgcgaacccattagcggatccttactctacaacactatcattctcctgatctcacgcactatctgcatacttgttcgtcactccggctacaagctcttattc

SEQ ID NO: 38266 - DNA, 446 bp, Zea mays
  Clone ID: LIB3060-047-Q1-K1-E10
gctcgtaccggtccggaattcccgggtttcagaacaagtccgaacgaactgaaggagaggaggaggaggaggaggaatggcggacgcagccagaggccgggggtcttcgtctctcccggtggctaacgtgcaggcgcttgcggagtcttgcaacgacaacggagccgatgcgccggtgcccgggaggtacctcatcaaggatcctagcgccgaggaggtcgtagccgccggcgacagcgcctgcgcgattccggtcatcgatttccgcaagctgctcgatccggggtcgtccgaggaggagtgcgccaggctgggagccgcgtgccaccactggggattcttccagctcatcaaccatggcgttccggccgaggtgactgggaacctgatgaaggacgtagctgggttcttcaggcagccgctggaagccaagaaggagtgcgcgc

SEQ ID NO: 38267 - DNA, 456 bp, Zea mays
  unsure at all n locations
  Clone ID: LIB3060-047-Q1-K1-E3
ccgggtcgaaccaagccttccaacacgtccaacaaggtccttcctggtcaacaatctcgtaccggcggcgcacatggcgggcgacggcccggcggctacgccagcgaaggttaccccaaagaaggccaatctcctcgacccgcactccatcaagcaccttctcgacgagaccatctccgaggtcgtgaagagtaagggctacaccgaggacacgcggctgggcaactggaagctggggatcggagccgccgtgattgctgtcgccctcctcgctcagttttaccccaagaagttcccgcagaaccgcgatttcctccttggctgcatcgccctgtatgtggtgctgaatgtggtgctgctgatccttagctacaccaaggagaaggatgccatcctattcacgcaccctnctatgggttctttcagcagcactggcctcactatttcttctaaata

SEQ ID NO: 38268 - DNA, 392 bp, Zea mays
  unsure at all n locations
  Clone ID: LIB3060-047-Q1-K1-E5
ccttgatgcttgtcgtcgatccgtcgcctcgcctcgatgctggctcctacatgacgtctcgaacttgtgtttacactaaaaatccgagaagattaggcgtagaaggaaaaaaatcagtacgcagccggaaaattcttgatgtggatcgagaaggcagtgaagtccgtgtggtgctcaccacgtgctcgacgtaatggcgaaattggaaatcgtagttgtgctcgtggctgtcaagacggattaaattattagtgagctgtcgtcgctctcgctcttcgttttaatatttctcatcagtttagtatacttgcggtgttaatgtggaccgatgatgtgcgcgtaaatcgcactagtgacactacaaganactgataaaaaaaaaaaaacatatt

SEQ ID NO: 38269 - DNA, 444 bp, Zea mays
  Clone ID: LIB3060-047-Q1-K1-E9
tccggaattcccgggtcgacccacgcgccggtgtttggagtgccccagccagggtggtacagggtttattacatcattaataatattcaagagttagtaaccgctctgacccaagagcatccggtggtgctgatgttctgggcggactggaaccagccaagcaaggccacgtactgggatctggccatcgctaaaaaggatgaggccgtattctgccagctggactttgataagtttaaagatgtcgtagagaagttcagagtgaaggctctgccgacgttcctcctgatcaaggagggcgaggagcagcgcatggtcgtcggtgccaaggtcgaggagctcaacatggcattatcagatatcggataatctaggcagctatagcgctcacattctaacttcatcaaattattctaataaattaataagctggaaataagtctt

SEQ ID NO: 38270 - DNA, 153 bp, Zea mays
  Clone ID: LIB3060-047-Q1-K1-F12
ggttggggtttttttttttttttttttaaaattgcagacgaaaaaaaggaaaaagaaggagtagagaaggagcaaaaaacacgggaaaacgataggagtaattaacttacacgcacgcccacgtacgggcccaggggccgaataaaaatcaag

SEQ ID NO: 38271 - DNA, 424 bp, Zea mays
  Clone ID: LIB3060-047-Q1-K1-F2
gggtggcctattcttccccctccggttcgggttcgggttcgagaggttctccggggttcggtttcgtggatgaggggagggagatggcggcgtcggatgctgagtacacgatgctttgtcggcggactaaactgggccacggactaccacttcttacactacgccttgatcacctacgtgcaggtactcgagtacaagatcatactgaatcgggagacgcataggttcacgagcttgtgctgtcgtaacttctacacagatgaggcaatgcggaacgccatctagggcatgaactgctaggagctggactgccgcaacattaccgtctacgaggccacatccctgtgcagacgtggatgcgcaagcagcagcagatacggtggtggccgtggacgctgcagctacagctgtggctggcgccgtg

SEQ ID NO: 38272 - DNA, 292 bp, Zea mays
  Clone ID: LIB3060-047-Q1-K1-F4
tccggaattcccgggagcttcaacctccatatttgttgtaccggaacgcttcacaagaagtcaatggaatttggttttacaaccaacgggactgtgaagctgttgcaagtctatttggaaggatactgaatgcttacgccaaagtacctccaaaacctaaagtgccttccacaaaaagtgagtttgaggaactggaggctgttcctacatctgctgctatagacggcccccttgaacctccgccagcgtctgccgctgtagtccttgatacccctgatgaatcattaatcag

SEQ ID NO: 38273 - DNA, 404 bp, Zea mays
  Clone ID: LIB3060-047-Q1-K1-G1
tccgggtcgacccaagccttccggtggcttcttcttccccttccggttcggtttcgggttcttgaggttctccggggttgggttgcgtgggtgaacggatcgagatggcggcgtcggatgttgagtaccgctgcttcgtcggcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggt

SEQ ID NO: 38274 - DNA, 415 bp, Zea mays
  Clone ID: LIB3060-047-Q1-K1-G10
gacgcctgatcggaaagcaacgtcgttgccccgcccccccacctcgtcacgagtcagagagctacacaacaaccatcctgttcccgcccgcatacaggactctagctagctagctagcgttgttccgttgtggttgctctcgctcgctctcgttcggtcgatcatggagtggagggacagcttcttggacctggcgctcatcccgctcagcctgctcctgcccatggcgtaccacgcctggctgtggcgcgaggtccgtctccgaccgctgcgcacggccgtcggcatcaacgccgccacgcgccgactatgggccatcggcatgatgaaggacaacgccaagaacgcggtgacggtggtgcaatcggtgcggaacgtcatcatggggtcgacgctgatggccacgacggcgatc

SEQ ID NO: 38275 - DNA, 357 bp, Zea mays
  Clone ID: LIB3060-047-Q1-K1-G12
gaattccaggctcgagccactcatccgatacacttaatacaatcctaacaactttaacattatactaatcattcccaggtacgagtactcatacatactgagcaacagcctcaatataccacaccaatcactacaaacatccatcattatccatccaacctctgacattcatacataaaactcctcatcgtatactaaactccttatatcctaacactccttattcacatatctccacgatccattctctccaagtaaatattctccaatcctttaatcttataccttcttactccaacactgactaccactattataaaaattacacagaactacctcagtgccattaacatctcc

SEQ ID NO: 38276 - DNA, 461 bp, Zea mays
  Clone ID: LIB3060-047-Q1-K1-G5
taccggtccggaattcccgggctcttccacgtccttccgggtcctatcgctcctctccgtcgccggtggagctcatggcatcctccatggccggcgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctgatgag

SEQ ID NO: 38277 - DNA, 425 bp, Zea mays
  Clone ID: LIB3060-047-Q1-K1-H6
cggtccggaattcccgggcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgccggagaccgcgct

SEQ ID NO: 38278 - DNA, 228 bp, Zea mays
  unsure at all n locations
  Clone ID: LIB3060-047-Q1-K1-H9
taccggtccggaattcccgggtttgtatgtgctgcccgtgcctgcaatgtcagctctaccggtcccgcgcttcgctgggcaagccggtgaaggggcttggcctgagcatgggccgcgagcgcgcccagcggagcattgtgtgccaggcggcgagcagcatctccgncgaccgcgttctcgacatggagaagcggaagctgatgaacctcctgctgctcgcgccatctc

SEQ ID NO: 38279 - DNA, 418 bp, Zea mays
  Clone ID: LIB3060-048-Q1-K1-A1
cggaattcccggctcgaccctcgtggacggcgatgcactacactacactacaccacacccacccgacgacgatcacacacgcagaagagcgagttcgttcgatcgtgaccgtgacgcaagaagctataagctagccaagacaggaataataatggcggcgtcaacgggggcgagcctactctgtcccggtgacgacgacgaccttcgcggcggcggcggcagcgggcggcgccgacgtgctgatcgtcgtgccgaggaaggcggtcgctgcgcgcgttatggttccccgtggctgatcgccagggcagatgcagcacactggcggtagccgcgcggtccatcaggccggtcacgccagctgagatctgcgacaagggcgtggacagcctgaaccaggccgatgaaaccagctcagacg

SEQ ID NO: 38280 - DNA, 450 bp, Zea mays
  Clone ID: LIB3060-048-Q1-K1-A3
ggaattcccggctcgacccacgcgttcgatgatattggtctaacacgtgccaattaatggggcattgttcttgggaaactaagcggatggcatgctgtgagatctaagctagtagagctaggatatgaaatccgtgacaaggaatttgaggacttctttcagctctacacagaggttgcagagacgaaaaagcgcgtgacctgtgaagacttagaagcgatattgtctgatgagatattccagcctaaggttatgtggtgcccttgctgatgtacaggcgacatgtgatacacttgctgtatgtacggcaacagtgaaattgatagcaccagacggagaggcgaaaatagcatgttcagacggaacatgtccagtcgatgcatcttacaaagctgttgacaaaatcatccagattccaaccgctctgcgagaatacaggatgacatcagt

SEQ ID NO: 38281 - DNA, 346 bp, Zea mays
  Clone ID: LIB3060-048-Q1-K1-A8
cccggctcgacccacgcgtgcgttgttctccatcacctcctccccgccttaaggggacatcgctgccgattcccaccggctatctacccgccatcagagccccatactcgcccaacctgaaatccttcacctactcacgcctgaatacctcatctcacctccaccactcctcacacgccttgtacttcgtcgacctaaccgcacccttccaatgacagggcgctagcgaagccgcgcatactccctgcatcttcaccgctcgtcaccctaaccgagcccttccaacgacgaagtcgctaccaaaacgccgctcatcctcctcacatcttcctcgctcctgcgccgc

SEQ ID NO: 38282 - DNA, 454 bp, Zea mays
  unsure at all n locations
  Clone ID: LIB3060-048-Q1-K1-A9
cggaattcccggctcgagccacgcgcccgcgtgcgggacgtcaggaacttccaggtcctcatagagatgtacaacgagtggccattgttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcangggctggtgctgcgcaacccctacatcaccaccctgaacgtgttccaggcctacacgctgaagcggataaggaaccccaacttcaaggtgacgccccagccgacgctgtccaaggagttcgccgacgagaacaagcccgncggactggtcaagctgaacccgc

SEQ ID NO: 38283 - DNA, 433 bp, Zea mays
  Clone ID: LIB3060-048-Q1-K1-D10
taccggttcggaattcccggctggacccacgcgtccgaagtcacacaccaaccaaccaacctgttttgactgccgatcctactgatgggggcgggggcacctgcaagttctacaggaggacattcgcttccattactgcgactgccgacgatcacatgaaccagtagcggaggcttagattgcccacgaccgcaataaatttcccgcatggctcgtacggccgcgtcctcgctcgtctcccgctgcctcctgacgagggcccctgccggcgcgccgcccgatgtcccctatgcgctgcgcaagacagtgcctgcagatgggatgcacaggctgttgccaggtgtccttcacaggttcagcactgcagcagcagtagaggagcccatcacgccgtcaagacatgtgaactacacaaagctgctcattaatggca

SEQ ID NO: 38284 - DNA, 394 bp, Zea mays
  Clone ID: LIB3060-048-Q1-K1-E8
tcaaccatgccgatctttccagttatccggcaaagtcaaacaaacttttattcattctagttacagtattacacagtaacaaaaaagaaaaaaatatatcatatacaaggagactaaattcaactgcaaatatatacaatatgtctatgtttgtatctgttatttttccagaaacaccagccttctccatatacagacattcccttccatacacaagctacagactctacagtcctggaaaaaaaacggtgcccagccacccaggagaaaatcacaaactcatgatcagatatacaggaaaggacagtcatgatctaaagctaaatccttgcaaagaaacatgatggattccatgtacagacctcttcgtatgtgtcgccactaactatactct

SEQ ID NO: 38285 - DNA, 387 bp, Zea mays
  Clone ID: LIB3060-048-Q1-K1-F12
ccggctggagccacgcgtccgggggatcggaagcactaggctgtgacctctaacttcagcctcaatattgcgcctcctggatctggttgctctttttacacgcgctgctacggcctaccaattttgtccacaagtgctgcacacagctcctactcctctctttcttgacgccgtaccttttaccacctgtcagctcagtatgcgaaaacccactctttcaaccctatatgctccaacacggaatcctacttggcatcctagctttatcacccttgggtcttgaacattcattatccctacaacagccattaccttagacgcatttattggcgcagaacataagggctcaacagctgccacaactcgtgctagcacaccttgctgcct

SEQ ID NO: 38286 - DNA, 190 bp, Zea mays
  Clone ID: LIB3060-048-Q1-K1-G12
cggctcgagccacgcgtccggaggcataggaagttcactgaaactgtttaactttagattggtctgaacaactatgggccacagaatgtcatgcgtccttatgcttcttgctatttgtacatatattgctaacgcaacaataatgcctgcatgctcacaagctcctatcacttccattattcccccatac

SEQ ID NO: 38287 - DNA, 363 bp, Zea mays
  Clone ID: LIB3060-048-Q1-K1-G9
ccggttcggaattcgcgggtcgacgccacgcgtgcgcctgttcagacacaggtggcgacggttgttgcgagaatgaagacgaagtagggaagaggatgcacctacatgcctgcgacaacaatggctgcaacagattgtgccagctctgactcatctagctatggcataccctgcttgctactttcaacagctgcttgcatttaaccaactgactgggtcgcactgtgatgggtgcctgcaactgtgacttccgagacttattacactagctgtgcctaacccatgggacactgaatttctacagcagcaacatattgctaccatacagacagttctctttgatgaaccctggcttgccgtggc

SEQ ID NO: 38288 - DNA, 381 bp, Zea mays
  Clone ID: LIB3060-048-Q1-K1-H10
cagcagtgcgacaagcaagatttaccttcccatttatcatatcgtcaactggtccgggagttggcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaat

SEQ ID NO: 38289 - DNA, 448 bp, Zea mays
  Clone ID: LIB3060-048-Q1-K1-H11
ccggaattcccgggctttcagccgagcaccatcgtcacagtcagtagccaagcatatttctttctccgagtgatttgcgctgagcgggcagtgcatccagagcgagcggagctgagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgttcgacaccggcggctacctgggaaagaagaccgacgaggccaagcacaaggccggcgagacgacggatgccaccaagcagaaggccagcgagacg

SEQ ID NO: 38290 - DNA, 376 bp, Zea mays
  Clone ID: LIB3060-048-Q1-K1-H2
gttgttttttctttttttttttttgtttctttttttttttttttgtttttttttttttaaatgaatgttgatgccggatgcctaaccaaatgggcaacctttttatagatcatcccttaacttagcttttctacatcccacattttgcagctacttttccataaccctttacattcctagggccaatttcctttggggtcaaatttccatgagggactagtgtactgttggcccccaaattatccattcctttacattaaggggcaatacctttgaaaaacggaaataaggcttttcttcaaaatgcctatgcccaaagagcttatacccacctagaagccgatccaagccccaaggcaatgtaacacgccttttt

SEQ ID NO: 38291 - DNA, 116 bp, Zea mays
  Clone ID: LIB3060-049-Q1-K1-A10
aaagcctatacacgtgtcatcataacgttcattagactctaagtagcatataatacatctcttactatcttaaagtcactacttcaataaatcttacacaaaaaattgtcactgca

SEQ ID NO: 38292 - DNA, 293 bp, Zea mays
  Clone ID: LIB3060-049-Q1-K1-A2
ttcccgcgttgagccacgcgtacctacattgcatacgatgcaggcccgctccacctggctccggggcttttcggccatggtcctacatattgcaccattgatatacgcacgttcgaccatagcttgaccactatctccgtcacctcctacacaccttacaactttgacaatctggtcaagtctctcatatttgtcaccaacaaacctacttacgtaccgtacgatctatacgacgccaccccgtcctacctcaacgtaattaacaacgaccacgtcgatgcatattaagatca

SEQ ID NO: 38293 - DNA, 470 bp, Zea mays
  Clone ID: LIB3060-049-Q1-K1-A3
gtcgacgcacgcgtccgttcccctgctcggcctctgaggtttcccagtagcggctcctagcatcttctccgcgcggagcttgcttcctcggtctgccgctcgtctccatctctccatctcccagcagaccgcgcccagctccagccatgagcgccgacgtcctctctctgtgcttgatctcccagtcctccgctccctgaaaccttcacccacatgtttgtgaaggtccggtagtggagatcttgcgaggtccactgctctgcgctcctattccacctgtctcatcccctcatcatgctcgacacttgctccctggcagcatgccgtagcagcatctgtgcttggtccatgctccactgtgccgtgcctgttctctgcacgcgtcaagctcacgcgctgaatccagccccatgttgacgcgttcatgttccaacttgtcgtgccgcgtcgtcatcactttctgtcacgag

SEQ ID NO: 38294 - DNA, 472 bp, Zea mays
  unsure at all n locations
  Clone ID: LIB3060-049-Q1-K1-A6
tcccgggtcgacgcacgcgtccgccttgatgctgaagcctctggtttattgtcaccctctaaaggcggacaataaacctggggatacaaatactaggagccttgatgctgaagcctctgaaccttctccaaagcgtagaagagaatccagtatagaatcagagaggactaagagtatggatgtggaagagccgtcggcaagtcgaatgagggattcaacagttgctgcatctactgagaaaaatgctgctgatgtttcatcacatgctaaagagatcccacaaaacattcagccagcaaaggttactgatgatcactacaagagaagtgatggcgcacttgctgctgctagagcgcgagcactggcccgaaagaaaagcgaagaccagcaattgtgaagtacaaggcagaaaagtttaccgatccttgaggtacaatntcatgttntattcaataggatcgtgntaagatgt

SEQ ID NO: 38295 - DNA, 461 bp, Zea mays
  Clone ID: LIB3060-049-Q1-K1-A7
ggaattcccggcgcgagccacgcgtccgtagaaagttcttctttccctcaattccccaacttccctcccggtatctctcgccggggccagggcagagccaccgtgagatctgcccgattccgccgcccggacccggggactccctcccctcctcgatccgttcgggcggccggccggcctagcttcaagtgcggggatggtgttctacttcaaggcgcggcccgaggccggcgactacaccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgaaggtttgctggaagactgtgcgcagcttgtcaaagctaattccattcaaggtaataaagtcaataacattgatg

SEQ ID NO: 38296 - DNA, 358 bp, Zea mays
  Clone ID: LIB3060-049-Q1-K1-A9
cccgggtcgacgcacgcgtccgctcgttcaattgtctttattgatgagattgatgctgttgggacaaagaggtacgatggggattctggtggcgagcgtgagattcagagaaccatgttggagttgttaaatcagctggatggttttgattcaagaggagatgttaaagttattctagcaacaaatcgtattgagagtcttgatccagccttgcttcgcccaggtcgaattgacagaaagattgaattccctttacctgatgtcaagactaggcggcgcatcttccagatacacacatcgaaaatgacactggctgatgatgtaaacctagaagagtttattatgtcaaaagatgagt

SEQ ID NO: 38297 - DNA, 448 bp, Zea mays
  Clone ID: LIB3060-049-Q1-K1-B10
cccgggtcgacgcacgcgtccgcccaggttttatcctagcaacaggatttggtgcatcactgtatttcctggcaaagaaagatatgaacttaggtaaggctgcattgatcactgtcgggggacttgcagctggtgcaactgtcggatctgcagtggaaaatttcctgcaggttgatatcgtgccctttctaggcatccactcccccgccgtcgttgtcagtgaatttattctgttctcccagttgttggtatcactgtttgttaggtaggatctgaaatcaagctgtcatcctgatcatggcatgtaagtaactgaaatggttcgtgttcaaacttcaaagggtcagggaaatgcttattttccgctcaaggtgcaagcagctgtgtatagcaaacaatacatggacatctctgtcccttataaagatcacttgtatctagttctctc

SEQ ID NO: 38298 - DNA, 457 bp, Zea mays
  Clone ID: LIB3060-049-Q1-K1-B12
cccgggtcgacgcacgcgtccgcgctgccacatctctcctcgtccaaagactccaagctcctgtgcggcctgtgttctgcggccgcctctggtgcacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatag

SEQ ID NO: 38299 - DNA, 449 bp, Zea mays
  Clone ID: LIB3060-049-Q1-K1-B6
cgacgcacgcgtccggttgccatgctgatttttttaggcggctgctggcctgcctgtctccactggaagctcgggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcg

SEQ ID NO: 38300 - DNA, 323 bp, Zea mays
  Clone ID: LIB3060-049-Q1-K1-B9
cccgggtcgacgcacgcgtccggttgtaacaccgccgcccatgcccgctcctcgatggcccttccccaccaggccacgacggtctccgtggaggccgcctttgcgttctgctcagagtaggtccacaccgacgggggcggctccaccttccgcttccccggcttctactcctccgcgtcctcctcggtccttgccaccgtcgcgtcgccgcctcagcaatccaatgtccccgatgaggcgctgaaggtttcgaaccagctgcctcgcataacatcaatagaaggggactgatggggagctcaccagtgtggccctgtttggcg

SEQ ID NO: 38301 - DNA, 451 bp, Zea mays
  Clone ID: LIB3060-049-Q1-K1-C10
cccgggtcgacgcacgcgtccgcccttccccaccaaaccggagcacttcggaggccggacccggcgagaagcgaccgaccgcagccagctcacgtctccctcttcatccaccatgctgagggtcgcgggcaggcgcctctcgtccgctctcgcctggcgccccgccgccgccgcctcaggctcccggggccctctcgccggtacactacccggccgcgacgacgacgacacacgcgactgcagggcgcgtttcgccatcgaatctcccttcttcgccgctgccagagggttttcagcagagactcttgctccaagaaaccaggatgtgggcttatctgagctcccagcaactgtggcagctgtgaagaatccaagtggaaaaatcgtgtatgatgagtataaccatgagcgctacccacctggagaccccagcaagcgtgcatttgcctac

SEQ ID NO: 38302 - DNA, 459 bp, Zea mays
  unsure at all n locations
  Clone ID: LIB3060-049-Q1-K1-C11
acctcccgggtcgacgcacgcgtccggagctgagctgagctcaccaccaccacacacgggagatagctatagctagcatagcaggccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgncgacttcaccgcgctcttcgacccggacctcgtggacaagcgcgacatcctcatcgggccctattaccccgggcg

SEQ ID NO: 38303 - DNA, 450 bp, Zea mays
  unsure at all n locations
  Clone ID: LIB3060-049-Q1-K1-C12
cccgggtcgacgcacgcgtccgaattaatcgcgcgatgcggaagaagagccaagtcgatctcaagcgcgggctaatccgcaggatgatgctgatggacgaaccggaagatggataatctgaacaatgccaaaacaaaaggctgatcgtcaagtggtcgtcgtctaacaacactaacctagtgttacccaggttctaactttgtgctgttgttgatggtgttaagtgccggtgggctcggccttcttataagtctaagtaactcttctatacttcttattgagaatgttcacttgagctagcatatatttcaaaactataaaataattattataagttaaaggtaatcctttgaaccacttctgtaaccactccgataaatctaatgtaaaacttgatgtaacttgtaaaatttggtaaaaagatttccgctgcaaaatgttngtgtgtga

SEQ ID NO: 38304 - DNA, 457 bp, Zea mays
  Clone ID: LIB3060-049-Q1-K1-C8
gtcgacgcacgcgtccgattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggatccggagtgaagttaccatggcatcgttgctaagattaagaaagtaatgtggttatgaggagatgtgtaattttgt

SEQ ID NO: 38305 - DNA, 455 bp, Zea mays
  unsure at all n locations
  Clone ID: LIB3060-049-Q1-K1-C9
cccgggtcgacgcacgcgtccgttatgggccactctccataaattcgttgaaccagttatgatgcattggcctggcagcagattgagggagaaagctctggaaacagtcatgcaacatgttcattatgaagatgagaacactcgttatatttgcattggtcctgtaaacaaggtattgaatatgcttgcttgctggattgaagatccaaactcggaggccttcaaacttcatatcccacgagtctatgattacttgtggcttgctgaagatggcatgaagatgcanggttataatggcagccaactttgggatacagctttcacagttcaagccattgtggctaccaaccttattgaagagtttggtcctacccttaaactagcacacaactatatcaagaattcacaggttcttgatgactgccctggtgatctgaatgactggtaccgncaca

SEQ ID NO: 38306 - DNA, 456 bp, Zea mays
  Clone ID: LIB3060-049-Q1-K1-D10
cccgggtcgacgcacgcgtccgcggacgcgtgggcttttgtaggctatattgcaagctttttcctcactacagagatctggtgaggagattgcgttgttagagtcgtatgcttcagttaagtcgaatatggttttgggtcaacagaaaaaccaatcaaggaaaagacgtttttcacgttctagtgatgataccgacaattcagatctaccatgtcctcaatgccgtaatgaatttggtggatttagatgcagcccaggatctgtgcacttgcaatgcagtggatgtggaggaatgatgccagccagatctaacatcagtataccacaaaaatgcttggggtgtgataaagcgttttgtggggcttattggtattcgcaaggtgtgagttcaagtcattgcaatctgatctgcaaccaggatactttgaagagtatttatcagcgacatatctctgc

SEQ ID NO: 38307 - DNA, 449 bp, Zea mays
  Clone ID: LIB3060-049-Q1-K1-D11
cccgggtcgacgcacgcgtccgctttgtgctcccattgtttatccatgaaggagaagaagatgctcctatcggagctatggcagggtgctataggcttgggtggaggcacgggctgcttgacgaggtttacaaggcccgcgatgttggtgttaatagtttcgttctctttcctaaagttcccgatgcattgaagtctccaacaggagatgaagcgtacaacgataatggtctggttccacgtacaatccgcttgctcaaggacaagttccctgatattgttatctacacagacgtcgcgttagacccttattcatctgatggtcatgatggtattgtgagggaagatggtgtaattatgaatgatgaaacagtttatcagttgtgcaaacaggctgtttcacaggctcgtgccggtgctgatgttgtcagccctagtgacatgatggat

SEQ ID NO: 38308 - DNA, 458 bp, Zea mays
  unsure at all n locations
  Clone ID: LIB3060-049-Q1-K1-D12
ccgggtcgacgcacgcgtccggctcctcctcctcctcccccccagtccctcccaggctcccaccccgccttgctcgcaggctccccaaaacgcggagccctagccctagccctagctctcccacacccgcactgggagatggacggcggcggcacgcaccgcacgccggaagacgtgttccgggatttccgcgcgcggcgggctggtatgatcaaagcgctcaccaccgacgtggagaagttctaccagcagtgtgacccagagaaagagaatctgtgtttgtatggtcttcccaatgaaacatgggaagtgaacttgcctgcagaggaggttcctgctgaacttccaaagcccagctctggaattaattctgctcgtgacgggatggatgaaaaagattggctgtcactagtcgcggtgcacagtgatgctnggttgctggctgtggccttttactt

SEQ ID NO: 38309 - DNA, 412 bp, Zea mays
  Clone ID: LIB3060-049-Q1-K1-D3
tcgactcacgcgtccgcaacgaggtgcccaagaccgcggagaacttccgcgcgctgtgcactggcgagaagggcgggggcaagtccggggagccgctccactacaagggctgcaccttccaccgcgtcatccccgagttcatgtgccagggcggcgacttcacccgcggcaacggcaccggcggcgagtccatctaccgcgagaagttccccgacgagaagttcgtgcccaagcaacaacggcccccgtgtgctctccatggccaacgccgggccaaacaccaacggctcccagtccttcatctgcaaccgtcgcaaccccttgcttcgacggcaagcacgtcgtcttcggccaggtcgtcgagggcatggacgtcgtcaaggccatcgagaaggtgggcacccgcaacggc

SEQ ID NO: 38310 - DNA, 459 bp, Zea mays
  Clone ID: LIB3060-049-Q1-K1-D9
cccgggtcgacgcacgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggc

SEQ ID NO: 38311 - DNA, 460 bp, Zea mays
  unsure at all n locations
  Clone ID: LIB3060-049-Q1-K1-E11
cccgggtcgacgcacgcgtccgtctctcgctccgtccatccccgtcgccagcatcgcttccacttcggtctcagcgacgggcgccaccaccgctcccctccgtctccccctcctcgcccagcggcaattaccacagcctccccagcaagccgggatggctgcactcaaggcatcgttccggggtgagctcagcgccgcttccttcctcgactccagcaggggacctctcgtccagcacaaagtggattttacgtttcaaaggaagggcaaacgagctatttcactgagaaggacatgctgttctatgcaacaggctccaccaccagcatggcctgngcgagctgttgctgagcctggccggaggtcatgggatggcccaaagcctatctcgattgttggttcaactggttccataggaacacagacattggacattgttgcggagaatcctgataagttc

SEQ ID NO: 38312 - DNA, 454 bp, Zea mays
  Clone ID: LIB3060-049-Q1-K1-E12
ccgggtcgacgcacgcgtccgcccacgcgtccgccatcagcagctatcgtattgcatcacacagtttgttgagaaggactgcaaacttgctgacacagttattaggggtttacttaaatattggcctgtgacgaacagttcaaaggaggtgatgttcttgggtgagttagaggaggttttagaggcaacacagcttgcagagttccaaagatgcatggttccactcttccgtcagattagccgtagcatgaacagctttcatttccaggtggcagagcgggctctgtttctctggaacaatgaccatattgaaaccctaattaagcaaaactacaaggtgctgttaccgatcatctatccagcactcgagagaaactccagagatcactggaaccaagctgtccgtagcctgacactgaacgtacgcaagatcttctcagaccatgattccaca

SEQ ID NO: 38313 - DNA, 304 bp, Zea mays
  Clone ID: LIB3060-049-Q1-K1-E2
accggtttcggaattcccgggtcgacgccacgcgtccgctggaccgaatcgtcagccgtgcgtgccagggaacactaacgcgccatgaaaaaactggcagagctcatgctcatcctaggtggagctttgcgcgtgtgccatgtgttgctggtggtgctgctgccgctgcctggagtgcatccataacatcgtccctcccctcagcagccttcccttcctccgcttctccggcccagctctcccaggtggaggtggaggtggagcagcggcggcggtggtggcttctccacctgtagtctccatg

SEQ ID NO: 38314 - DNA, 453 bp, Zea mays
  Clone ID: LIB3060-049-Q1-K1-F10
cccgggtcgacgcacgcgtccgtgcacgattcgaacggcggcgaatcgcaaaaaattgggagggagaggtcgagtgcgagaggcctcctcctcggcgccaccggcaccgccaccgccgccgccaccaccacaaccggcgtctcgtcggctataaaaccctaccccttctagtcttcccgtcgccaccagccgcctcgttgaaaccctaaacctctctccccgttaggtctcccccagcgccccgacgatggcggaggacgcaccgcctgcagcccctgtgatgacgccggaggaagtgcaggctgagaccgagctgcggatgcgcgacataggccagcgctttggtgctatcccagaggaccccgacgagctgctccggttactcgaagaagccgaaatctggttgtccagggtggatcaatctccgcccgagagcatgtacaatgctcttcg

SEQ ID NO: 38315 - DNA, 461 bp, Zea mays
  Clone ID: LIB3060-049-Q1-K1-F11
ggcaggacttcccgggtcgacgcacgcgtccgatcgtactggaccaatctgccaccacactttgatcacacacaggaagttgagatcagagaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttcccgatggaggcctgcgacctgcttggtggcgacgcgtgcaacgggcccatgttcccggaggccaagcccgcctcggcggcggcggcggcgagcaggagtgtggtcggggtggacagggactacctgtcctacgacgagccaaagacggtgttcccgggcgaggcgtgcgatgaccttggcggcgagttctg

SEQ ID NO: 38316 - DNA, 470 bp, Zea mays
  Clone ID: LIB3060-049-Q1-K1-F2
accggttcggaattcccgggccttggtttttttttttatatggtttcaatgtgtgtctgtatgtactgaactgtacaggcttatcgagaaagagcactgcgagtctacaacaatgcacacccaacacaggcggtggacacaacccatccaataatctttcatgagtacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagcctactccttctgcgcctcgaggttggcgagcgcctctacgagctcggcctccacacggctgcgcccctcgtccagcttggccttcagctccgcggtggtctccttcttcatcttgttaagcgccgccgc

SEQ ID NO: 38317 - DNA, 242 bp, Zea mays
  Clone ID: LIB3060-049-Q1-K1-F4
cggattcccgggtcgcccacgcgtccggccatcgacacgatcgcgagcgcagcacgtacgttgtcggaagctcaagttagaagaggcaccagtgcctgatcgatggcggcccaggctctcctctccggccggcagctgctgggccgccccgtgcagtcggccgtctctaggtcgtcggccaggaaggcgcccttcgtcgtcagggccagcttcaggccttcagcccagccaggtgcccacag

SEQ ID NO: 38318 - DNA, 255 bp, Zea mays
  Clone ID: LIB3060-049-Q1-K1-F5
tgtccatggcgtccacgttcgtgctacgtagtgcccatggtgctgtgcagtgattttttaccttttctttatgttggccatgattctcttgtttagctacaaagtagggtcgtgtatctacagccagacctgtgggctgtttattttagttcaacatgtggatgattccctcactgatgggggctgttgttgtttgtaatatgtgctattgaatagccttttattttatgaactggccaatggcctttgtggttc

SEQ ID NO: 38319 - DNA, 455 bp, Zea mays
  Clone ID: LIB3060-049-Q1-K1-F9
cccgggtcgacgcacgcgtccgcactcatcgatctacacacatacatagtttcttctactacacgacgacaaacatgggggggcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtcaaggtgatgaacaac

SEQ ID NO: 38320 - DNA, 430 bp, Zea mays
  unsure at all n locations
  Clone ID: LIB3060-049-Q1-K1-G10
cccgggtcgacgcacgcgtccggccgcggcgcgtcgcgacccgggccgacaagatagggtcggaaagccccgccgccgacggcgtcggcgacgccgcgcgcaagcggcccagcggcgatgttggccccaccccggggccagccgacaagcgccgccgcccggagcacccttcttcctcctccgcgggctcccgcgaccgccaccaccaccaccacggccgccgcccgccgtcctcggccgacgagaaggtgcgcgcctctcacatcctgatcaagcacgagggctcccgccgcaaggcctcgtggcgggatcccgaaggcgtcgccatctccgccacgacacgcgacgacgcggccgacctcgcgcgcgcgctccgcgaccagatcgtctncggtgaccgcgagttcgaggacgtcgctgccgagaactc

SEQ ID NO: 38321 - DNA, 255 bp, Zea mays
  Clone ID: LIB3060-049-Q1-K1-G11
cccggctcgacgcacgcgtccggccgatgatcttcgagaccctctccgattagaactcggcgaaaaacaccgtcccctggggcctcatcatcgcgctgccgcacgcccgccaccatcgattttgtccacaacccgaaggcctacaacaagccctgccgcccctagatctcttcttactactccgccggctccgaccacagccaccatcagcaccacggtcgccaaccgccgttgccacggcgccacaaactgcac

SEQ ID NO: 38322 - DNA, 395 bp, Zea mays
  unsure at all n locations
  Clone ID: LIB3060-049-Q1-K1-G12
ccgggtcgacgcacgcgtccggaggatgatactggccgtgctcttcgccaactccgatggaaacatccttgtcgagcgagtccatggggttcccgcggaggagaggctccactggcgctccttcctggtgaagctcgggtccgagaacctcaaagggtccaagaacgaggagctccacgttgcctcccacaagtctgtgtctattgtttataccacggtcggggatgtctgcctctacattgttggcaaggatgaatatgatgagcttgctttggctgaggtgatctttgcaattacatcagcagtcaaggatgtttgtgcgaaacctnctaccgagcgcctcttccttgacaaatacgggaggatctgcttgtgccttgatgagattggttgga

SEQ ID NO: 38323 - DNA, 352 bp, Zea mays
  unsure at all n locations
  Clone ID: LIB3060-049-Q1-K1-G2
accggttccggaattcccgggtgcgagccacgccgtccggcgtnngtgtttcgtagtttctgcccttgatagtctgcgtttacgttgcgtctctctcatctttgagtttattactgttatgacaaggngacatgcatacccaattcattcccgaagatgggtgacccagttggattcctgaagatgtatttagtatggagcctttcgttcgcaacttttttgagaacacatctacagtacagctcaatcatcgaattcttgccgcaacaacattactctctgtgggtggattatggttggctgcaaggaaaatagacatgcacccagcagtcaagtcactgatcggaagcac

SEQ ID NO: 38324 - DNA, 323 bp, Zea mays
  Clone ID: LIB3060-049-Q1-K1-G5
gtcgacgcacgcgtccgctttcattcgccgccgccgcctcctctctgctgccgtcgccatggggagaaggcctgcgagatgctatcgccggatcaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcggg

SEQ ID NO: 38325 - DNA, 382 bp, Zea mays
  unsure at all n locations
  Clone ID: LIB3060-049-Q1-K1-G6
cgacctacgcgtccggcgctttgcaacgcctccgctgcaatcagcccccgcggcgagattgccctgcccctgagtgctagttctcgccggtacgtaaggcttcttggccttgcgtcctccgtctttcgttgctgatacatcgaggtattaaagaagctgcctggttccgggcagcagaggtcgccgccgactgcagcaatggccgacttctcctggctcacggtgcttggcttcctattcctcaccttcaactcatgcatggcgatntatcggtccaacggtgacgcccgctccgtcgctttcgtcgtggtatcttatctcgacctngtgccccctgtcgcctgcttgcgctactacgagcagttggatcagcagcactccc

SEQ ID NO: 38326 - DNA, 434 bp, Zea mays
  Clone ID: LIB3060-049-Q1-K1-G9
gacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaggacctcatcgtcaggggagggcgcgtcggcggcgtcgtcaccaactgggcgctcgtgtccatgaaccacgacacgcagtcctgcatggacccca

SEQ ID NO: 38327 - DNA, 459 bp, Zea mays
  Clone ID: LIB3060-049-Q1-K1-H11
cccgggtcgacgcacgcgtccggatccttggacacctgcgcgccgccagcccgtcaccgcttggagacccgcgcagccgcgcttccctgcgcgccgccagccgtcgccgatccgtggccgcgtccgccgccgccagccctaaggtcgcgccgtcagccagcccgtctgccgtcgtgaggtactgaggaatttttctggtaatcagcatggcactgtcatcaatgtttaagagaataaatgtgaaagatttgacctccaaggtttcagtctataccagtgctacaggcgctgggccacgaaaaggactgctggatcaacaaaaaatggtcgcgattccaatccaaagtatttgggggtaaagaagtttggtggagagaaagtactaccagggaacatcattgtccgccaaagagggacccgcttccatcctggaaactatgttggcatgggcaaggatca

SEQ ID NO: 38328 - DNA, 433 bp, Zea mays
  Clone ID: LIB3060-049-Q1-K1-H12
cccgggtcgacgcacgcgtccgcggacgcgtgggcgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaact

SEQ ID NO: 38329 - DNA, 463 bp, Zea mays
  Clone ID: LIB3060-049-Q1-K1-H4
aattcccgggtcgacgcacgcgtccggggagaaggatcctactccaatacttgacacaattgatgcggccattcatttgaaaaagctatctagtaaggagctcaagcagttagccgatgaagttcgttcagaaatagctttcataatgtccagaaaatgccaaccgtgtggtgctgatcgctcagttgtggagctgacaattgctatacattatgtgttcaatgccccaatggataagatactatgggatgctggtcaacatgcatatgcgcacaagattctcacaggaaggcgctctctcttccatactattacacagaaaaatggcctttctgggttcacgtcgcgttttgagagcgagtatgatccctttggtgctggacatggatgcaatagtctatccgctggccttgggatggcggttgcaagggatataaatgggagaaaaaatcgaatagtgaca

SEQ ID NO: 38330 - DNA, 80 bp, Zea mays
  Clone ID: LIB3060-050-Q1-K1-A2
accggctcggaattcccgactcgacgccacgcgtccgcagttgagcagctatttaatggagggataagagggaggatttc

SEQ ID NO: 38331 - DNA, 237 bp, Zea mays
  unsure at all n locations
  Clone ID: LIB3060-050-Q1-K1-B10
tactcggttctcggaattcccgggtgctacccacgcgttccgcgacaacaagcctcctgggtcgtcatcctgctgcggtgggcgtcgccaaggacgctcttcatcgcgggtggccgacgttcctgtctggaccgcgccgggtcgtcggctctctgcttgctgaccagctacgggttggaatgatntgtctcgctcgtcgtgtctcgtgttcgtgtcctcactcgtcttgggtgcacc

SEQ ID NO: 38332 - DNA, 471 bp, Zea mays
  Clone ID: LIB3060-050-Q1-K1-B2
accggtttcggaattcccggctggacgccacgcgtccggaagacactattctgtcactcagatgctacctattcaggttacacgtgctacactgggattttttattttgtgccgcctgatatcgatacggttgggtaccgggtatttctgggccacaaacagtacttcgtctcttcggatgtcggtgccggtaaaatgcaatggtattctttttacaaggaagaggctggtggcactgaccttgagaacggcttatagaaaatgtttgcttgagttatttgatgggtggtgtgttaatttcattttatttttttatgtcatcttatttttttcttttttttttttttattttttttctttttttcttttattaatttatttttttttatgtttttttttttatttcttttatttatcttttttttttatttattattattttttatttgtaatatatttttttattactat

SEQ ID NO: 38333 - DNA, 411 bp, Zea mays
  Clone ID: LIB3060-050-Q1-K1-B4
cggttcggattcccggctcgacgcacgcgtccggagttccgtgctcttcttctccctccttctatctctatctctgcgcgcgagctcgccgctgctctccctgctctcccatggccgcgcccaactccgtgcgctcgccggatcccctgctcggcttctactgccgttccccgtgctcgcgttatctccctcctctctgccgcatctcgctgagtccctctgtttcctcccatggcacggttttccttgcatgcttttcgtggcacccattttcttttctctaccgttatctcttttcatgttcattcttttatctttccttatattgtgtttttgctctctttttcatttatattttttttttttatttttttatcttatatttttttttatttttattttatttttttt

SEQ ID NO: 38334 - DNA, 412 bp, Zea mays
  Clone ID: LIB3060-050-Q1-K1-D10
tcaaccgaatgatcgtagcctacacttatccttctaatgctatctatatatgcttgatggtgtgtagggttgtctccagaaagcttgcttgttacttatatcccacacacttgcgcgcacgcaacccggcctttgtccctctcttgcctctcactgctgctgcccctcgctattcttctctgatcgatttctgtcatggcttcattctggttcagctgccgctgtagctgtatgacccatgtttgccgcagatgacccatgtgggactattcgggggccttctttcccatatttagttgttgtttgtttagtttgttttttttttgtcttttttttattttattctttttttttattgatttttctttttttttgtttttttttgtatttttttttattttatttatttttt

SEQ ID NO: 38335 - DNA, 457 bp, Zea mays
  Clone ID: LIB3060-050-Q1-K1-D11
attcccgactcgacccactcgtccgctcactggaatctttttttctcaatgttctctctgtcgaagctttgtaccctttaaaggttcatttggctattttcttggttcttgactaatttatattttctatcttttctttttttttttattctcattattttttatttatttttaattatttttatattattttttcttatttaatttattcttatttttattttttatttattattttttatatttatttttttttctttatattctatattttttatttttttttttttttttatttttttcatatattatatattatttttcttctatttttataattttatttattctatatttttttatttatatttttttttttttctattttttatttattttttttattatcattatttttattttatttattttatttttattattttttttatatatt

SEQ ID NO: 38336 - DNA, 468 bp, Zea mays
  Clone ID: LIB3060-050-Q1-K1-D4
taccggttcggaattcccgggctctggagtttatgaatgagcaaaaccgtggtgccacgtgctacaaaaccaaagatacaagaggcagagaactcgtgagatgagaaaagcgagaaaactgttcttctaattgatagtgaactgtacaatcgctctgattttatcactgagtacaaggatgccaaattctttgtaataaagtcctacaccgaggaccatgtacataggagcattaagtataatgtttgggctagcacagccagcggaaacaggaagctggattctgcttaccgtgcggccagagagaaagaagagcattgccctattttcttgtttttttcggttaatgtaagtggccaattttgttgcttttttttatatttattgtttttgtttatttttttttgatttttttatatttttgttatttatgttttttttgtttttttatttctttttttttatttt

SEQ ID NO: 38337 - DNA, 193 bp, Zea mays
  unsure at all n locations
  Clone ID: LIB3060-050-Q1-K1-D9
tggaggctattcagttgttttggctggttttggagccggtgagaggggcacactacgggggtattcggacgatatatgggcntctgatgttgagtaccgctgcttcatcggcggcctcacctgggccacggacgaccactccctccacaacgccttcagcacctactgcgaggtcctcgagtccaagatcatc

SEQ ID NO: 38338 - DNA, 466 bp, Zea mays
  Clone ID: LIB3060-050-Q1-K1-E9
ggaattcccggctcgacccactcgtccgagggatccttggtttcttttgaagattttgcactacttcttatgtgcttcttaatgcgggggatagaggtatgttgttggtccaaccattgcatgatgtttactatggtcaaattttttttatctattatatactgtgtttattttctattttttttttcttttttttttattcttttttatattcttatttttttttttttctattttttttttatttttttattttttttttttttcttatttctttttttttttatttttaatttactatattattttaatatttttttttttcttttgatttatctttttttttttttttttatttattttttcttttttttttttttttttctttttatttttattttattttatttttctttatttttttttttttcattattttttcttttttattttttttttttttttt

SEQ ID NO: 38339 - DNA, 255 bp, Zea mays
  unsure at all n locations
  Clone ID: LIB3060-050-Q1-K1-F10
tcccggccgttactttagattagaagcaaagggaagcttagcaagaatcgttcgagtcgagaacatggtgcanntttacatgtgcctttggcacctttctctggcgcctccaccaccacaaccttcgtctcgtcttctataaatccctaccccttctagtcttcccttctccaccttcctccttgtttaaacccttatcctctcttcccgttaggtctcccccatctccccttctatttcttatgactctccttc

SEQ ID NO: 38340 - DNA, 79 bp, Zea mays
  Clone ID: LIB3060-050-Q1-K1-F3
accggtttcggaattcccgaccgcgatcttttcgccttcgtctcttcgtcctctttctccggcttctccgacacgggcc

SEQ ID NO: 38341 - DNA, 148 bp, Zea mays
  Clone ID: LIB3060-050-Q1-K1-F9
cggaattcccgggcccgatcttttcgccttcttctcttcgtccgctttctccggcttctccgacacgggccgcggcttctacaaggtgtactgtgacgtcttctacaaggtattcgcgcaggagcttgcctatgctcgccggatgggg

SEQ ID NO: 38342 - DNA, 232 bp, Zea mays
  Clone ID: LIB3060-050-Q1-K1-G10
cccggtcgacccagcgtccgaaaaccctaaccctttcaccgccgccttttccgccacccagcgctggagctcctcgcgggctgctatcgcgcgccgcaacgccaccatgaagttcaacatcgcgaacccttccaccgggtgccaaaagaagctggaaatcgatgacgaccagaatctgcgtgccttttatgaccgaaagatatcccaggaggtcagtggtgatgctctgggt

SEQ ID NO: 38343 - DNA, 62 bp, Zea mays
  Clone ID: LIB3060-050-Q1-K1-G2
accggtccggaattcccgactgcgacccactcgtccgcaaatagtgaggtttttcttctgga

SEQ ID NO: 38344 - DNA, 358 bp, Zea mays
  Clone ID: LIB3060-050-Q1-K1-G8
cgggttgacccacgcgtccgctcgagctccgccgcttgcccgcttttgttctctccctccctgctctcggcttcttctacacgctaccgtcgcacagccgtaaacgcccctgccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtctcatcctcattgtggcttaactaacttcaactacactgatctggcctatctctactagtagtacatggaccaatgcttt

SEQ ID NO: 38345 - DNA, 338 bp, Zea mays
  Clone ID: LIB3060-050-Q1-K1-H5
accggttcggaattcccggctcgacgccacgcgtccgcgtcgagcttgcaactccttacgccttttacactcaacagtcatggtgttcatgttcagggagcatcagcaacacgaggaggaggaggtgcaagggaaggtcgtccaagaagaagtgcatgtttttcaataatacttgtttctttttcctttttatttattttttattattatttatatttcctatttatttttttaattttttttttaattttttttcttttttattttttttttttttattttttttttttttttattttttttattttattttttttttttatatttatttttttatt

SEQ ID NO: 38346 - DNA, 427 bp, Zea mays
  Clone ID: LIB3060-051-Q1-K1-A11
ggtccggaattcctggctacgccagacggtcggaacctcagcttagaggaccggatgatcggacgacggcgagatggcaagcggggaagaaggcaagggcgagacggtgctggtcaccggggccagcggcttcatcggttcgaccctcgtccgcggcctcctcggccgcggctacaacgtccgcgccggcgtcctcgaccccgacgacagggcggagacggaccacctcctcgcgctcgccgccggcgccggccgcctcagcttcttccgctgcgacctcctggacagcgccgcgctgctcgacgcggcaagggggtgctcgggcgtcttccacctcgcgtcaccctgcaccgtcgaccccgtcaaggacccccagaatcagctgatggtgcctgcggtggaagggacgctgaacgtggtgcgcgcg

SEQ ID NO: 38347 - DNA, 419 bp, Zea mays
  Clone ID: LIB3060-051-Q1-K1-A7
tgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcggcgtaccccggcaccggcccgctggagaacctcgccttccacctcgccgacccgtggcacaacaacatcggcgaca

SEQ ID NO: 38348 - DNA, 399 bp, Zea mays
  Clone ID: LIB3060-051-Q1-K1-A9
tcccgggctgaaatacgatgaatcacgagaatgctatacatatcgcactcctcttgagcaaacagaaaagtactggaaaggatggtatgaaggtctttcagacaagttcctatcttgcccagtgcaaaagatcctgttgttagctggtaccgacagactggacagagctttaacaatcggtcaaatgcaaggaaaatttcaaatggtggtgattcggcacactggacatgctatacaggaagatgtacctgaagaatttgcatcgcacatactgaagttcatatcccgcaacaaaatagggcctaatggtgtcgagatacctgggctcattaaaaaatggcaacagtagacataatgtacaaggtaccgatctggaaaatgttcaggaaaatgatgagt

SEQ ID NO: 38349 - DNA, 444 bp, Zea mays
  Clone ID: LIB3060-051-Q1-K1-B1
ttcccgggtcgacccacgccgtccggtgctatgtcatcttatgaagatgaagcatatgagatcatgcagtcacttgatgtgaactatgtgcttgttgtatttggaggtgttactggatattcttcagatgatatcaacaagttcttatggatggtacgtattggtggaggggttttccctgtaatcaaagagccagattaccttgttaacggggaatatcgtattgacaagggggcagcaccaaaaatgctgaactgcctaatgtacaagctttgttactaccgatttggagaacttaccacagaatatggaaaacctccagggtatgaccgtgtactaggagtggagattggcaacaaagatataaagcttgaatacttggaggaggcatttacaacttcaaactggatagtgcgcatatacaaggtgaaacccccaaaagac

SEQ ID NO: 38350 - DNA, 107 bp, Zea mays
  Clone ID: LIB3060-051-Q1-K1-B3
tcccgacccacgcagtctcactagccggtctccgttctacagagctttcttttcctacacgatcatgcgacgtcagggcggttctatagggtcacctagaggcaatt

SEQ ID NO: 38351 - DNA, 428 bp, Zea mays
  Clone ID: LIB3060-051-Q1-K1-B4
tactggagctctttttctattatttctttctacgctatccttaatagggggttggttacatctacaacccaaatggaagccaagcctttcgtggttcaaaaacgccgaatctcgtctgaatcatcatttgtcaggacttttcggagtaagttctttggcttggacaggacatttagttcatgttgctattcccggatccaggggggagtacgttcgatggaataatttcttagatgtattaccctatccccaggggttgggtccccttctgacgggtcagtggaatctttatgcccaaaatcctgattcgagtaatcatttatttggtaccactcaaggagcgggaactgccattctgacccttcttgggggattccatccacaaacacaaagtttgtggctgaccgatattgctcatcatcatttag

SEQ ID NO: 38352 - DNA, 445 bp, Zea mays
  unsure at all n locations
  Clone ID: LIB3060-051-Q1-K1-D12
ggtctcggaattccgggtcggcccaaggcttccggcaaacattttgggttccttgggtaagggaaccggccaagatggggttccaccggcacaagccttggccggggttattcctattggctttgggccggaaccaagcagaaggcctgtggtgatgatggccttgggacataacttccagggcaggaagaaggcccagaagacgaactcaaaggttcaagaattcaccttgcaatgtgggactttggtcagtgtgatgttaaaagatgcactggtcgtaaactttcaagatttgggcttttgaaggagttgagagtgaccatnggttctgcgtggtgttgttctcagccctgttggaacacagtgtgtatccaaggaagatcatcctattgtgcaaagaaaaggattggctgtggttgattgttcctgggcacgtttaagtgat

SEQ ID NO: 38353 - DNA, 427 bp, Zea mays
  Clone ID: LIB3060-051-Q1-K1-E12
cggtctcggaattcccggcgggtcaccacggtgggagtgtgagtggaggtgggtgctgcgtggaaaggcacatcgagcccggagagttgacagcgcgggcacaggcatgagagccggatcgattgcgggagagcagcagggaagacatgaagtactgccttcttagttacttgcagcttatctggcacccgctgcacatagctttgtacagctccttgtagaagcagtctgggtcttgctttggaggtgaccgtgcgctggtcctttgctccaagaattcctttagtctgtagattgtttatcttcttaagctgattgggaatctaaccagtgaaatcgttgttcgcaacattcctagaggcaagcaggttatgagctatggtactggacatgcaaatgaagcaccaaaaatacccatcatcatctc

SEQ ID NO: 38354 - DNA, 450 bp, Zea mays
  Clone ID: LIB3060-051-Q1-K1-E7
accggtccggaattcccgggctgaactactgaagcaatggccatgagagctctcccgctgacctcttccaggagctcctcgtttggagctcaccgaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccagaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaggttgacaagct

SEQ ID NO: 38355 - DNA, 210 bp, Zea mays
  Clone ID: LIB3060-051-Q1-K1-F1
ttcccgggctgaactactcatgcgatggccatgagagctctcccgctttctttttccaggagctgctcgtttggagctgaggataccatgcccagctgcgggggccccagatcattgagagcttattcgaagggatactaagacggctacaagcagtccctcttcagaagcatcaccgaggcgctatacttctcataggtccggtcggag

SEQ ID NO: 38356 - DNA, 382 bp, Zea mays
  Clone ID: LIB3060-051-Q1-K1-F10
ctgactttccttctggttaaggccacaaggatcccggactgttttggttcaatgtgtgtctgtactgacctgtacaagcttatctggccagaatactggctgcctacatcatgcacacccatcacaggccgtggccacaacccatccaataatctctcatgagtacagtgtctgaagcatcatccaatatcttcagaaatatcatgaatagatgatgttcatgtaactatagtcataggacaaggcaaggcctgtttggttgcatcacgcagatggaagcaccttcttgacgatctcatcactgagcgaggcgatctgagcgtagagcgccttgacagactcctacttctgcgcctcgacgttggctagcgcctatacgagc

SEQ ID NO: 38357 - DNA, 79 bp, Zea mays
  Clone ID: LIB3060-051-Q1-K1-F11
cgtcttaaaggtcccagcttaactaccccttccttccaaggtcttacttttttattagggtaacttaaattaaattaat

SEQ ID NO: 38358 - DNA, 461 bp, Zea mays
  Clone ID: LIB3060-051-Q1-K1-F3
ctcggttcggaattcccgggtcgacccacgcgtgcgctcgacaatggcactccaggcagcctactagtacctgcagcaggccgtcggccatggcgcgtggtcgtccacgcagacgctgacgctgctgctcatcgacgtacccaccgtactactgctgctagcgtccctcgccaagagcacgtcgtcgtccggtaggggcaagccgtcgctccctccctcgccgccgggcaccctccccatcgtggggcacctacaccacatcgggccccagacccacatctcgctccaggagctggtggccaagtacgggcacaacgggttacgtttcctccgcgccggcgccgtgcccaccctgatcgtgtcgtcgcccagcgccgtcgaagccgtgatgcgcacccacgaccacatcttcgcgtgccggccgtggtccatggcctatcacattctccgctacaacacct

SEQ ID NO: 38359 - DNA, 179 bp, Zea mays
  Clone ID: LIB3060-051-Q1-K1-F8
gaattcccggctcgacccacgcgtgcgagcttctgcataccttctctagtttattctacgccacagtagtcgacaccgtgggcgagtacctcccatggccgctggtatcgtggcctgtggtgagccggatgttacgatggggttaggggatggacactagcctgaacgaggaggcgatg

SEQ ID NO: 38360 - DNA, 460 bp, Zea mays
  Clone ID: LIB3060-051-Q1-K1-G1
agtttcggttcggaattcccgggcgccgttttccacgtcggagatctgggcatggtcagctatattcgtcgcgtcgttcggcgtcgcatgtttcaatcccacggcgtttggtaccacggcaagaacatgccttcctttcctgcttgctgctaatgtgctgggatacatggttggttctgggttaccacctggcgtcaagaaagtgctgtatccgatcatctcctgcgcactctgtgcagatttcgcggcgctagcctatgggtacatctcagggtttggacttgatgccgtgctaggtgcttacctcacaaaggtgccctctaatcctggagccggtgacgtactaatgactttccttgggtctgtgatcatatcatttgcattctcgatcttcaagcagagaaagcttgtgaagaggcacgcaacagagattttcacatcaattgccatcgcgtcgaca

SEQ ID NO: 38361 - DNA, 291 bp, Zea mays
  Clone ID: LIB3060-051-Q1-K1-G2
cagcagttcacacaagcacgctatcgtcgcacgggcgctgaacacagactcaccaagcggcactgccaatggcttactaccacgacgtggactactgctctgaggaggcgaagtcggaggtcacagacggttatggacctcacggaagcagtgtacagaagtacgtactcaatgagaaattcacagaggtcgacactgcctgacgcgccggggtcgaccaccaccacctctaccatggtcaacacgacagtcacgggttcatacagcgcgagaacacggtcgttgaggaca

SEQ ID NO: 38362 - DNA, 431 bp, Zea mays
  Clone ID: LIB3060-051-Q1-K1-H1
ggaattcccgggtcgacccacgcgtgcgtacagcactccacacaagcacttcgacgttacacgggcgctggacacagacacaccaagcgtcggcaccaatggcttactaccacgaggtggactactgctcggaggaggtgaggtcggcggccccggacggcttgcgccgccacgtcggtggcattcagcatcacatgcgcaaggagaagatccaggaggtcgacactgtcggacgctgcctcgccaaccaccagcaacaacatggtcaccacagcagccactgctttgtggctcgcgagactcactgtgaggaggacatcatcacctgcaccggccaggtccacgatcgcacggagagcttcctagtcagggctaactgagcagcccggacggtcggaatctacgcgcgttcgtgcctgcctgcgtgcctt

SEQ ID NO: 38363 - DNA, 278 bp, Zea mays
  Clone ID: LIB3060-051-Q1-K1-H11
ctcggtctcggtattcccgggattcgaataattttgctacttacctggatatatgttacgtatagatatatagtaaagggcggttattatggcacaaattcgtagggtgtaggtacaggttttgaatttgacatttgatgaacactgtataaaaaccgacttttctatattccaaacgaacatcctaatcagatagacccatccttctcgccaaaaaaaaaacaaaacataaaaataagaaaaaaaaaaaaaaaaaaacaaaaaaaaaaaacaaagac

SEQ ID NO: 38364 - DNA, 321 bp, Zea mays
  unsure at all n locations
  Clone ID: LIB3060-052-Q1-K1-A4
ggaattcccgggctcctctatcggtgacgcacgcacccgccacctctgatctgatctctccccctggatctcgacctccgnctggctgctccgctctgcgtcgctcgccatggcgtcctcgacggggagcttggagcacggcgggttcacgttcacgccgncgnccttcatcacctcgttcacggagctgctctctggggcagcagcggacatggtaggagccgcgggcgccgatcatcaggagcggtcgccgagggggctgttccaccgcggcgccaccaggggcggcggcgtatgcgtgcccaagttcaagtccgcgca

SEQ ID NO: 38365 - DNA, 427 bp, Zea mays
  unsure at all n locations
  Clone ID: LIB3060-052-Q1-K1-A5
cggaattcccgggtcgacccacgcgtgcggagagatctcgatccgcacaccttacgcctctcttcctctcgccccaaggacaacgaaaacatcaaacaagagaaccaaaggaaacagagcaagagcatcgctctcgaagcaaaacgcgcaccacgccgtcgccggccggccacttcgcacgtacgtaggacgcgcacgcaccggtgcatatatggggctcctgaaccagctgtgggacgacacggtggccgggccgcgcccggactccggcctcggcaagctccgcaagtacgcctncttctccccctcgtcgtcgtcgtcggcggcggtggcggcggcggcggcggcgggctccgcgccgnctncgggcgccgtgacgcggagctggaccatgctgcggcggcccgcggcgctgtccgtcgtcacg

SEQ ID NO: 38366 - DNA, 143 bp, Zea mays
  Clone ID: LIB3060-052-Q1-K1-A7
ccggtccggaattcccgggccgagtgcgaaccaagcagaccacagcaagaagcgtagtcttttccggaaggaaaggcgcggagcaagatgtcgtggcaggcgtacgtcgatgagcacctgatgtgcgagatcgaaagacaaca

SEQ ID NO: 38367 - DNA, 476 bp, Zea mays
  Clone ID: LIB3060-052-Q1-K1-B11
accggtctcggaattcccgggccgacccacgcgtgcggcacctcttattccttcctctctccgagctcctcagccgaggtggcgaggaccctccctgtacatcgtctcctccatgtcgacatcttccctcatctctccaacgtcgtccagccattgagcagctcatcggagcagcaacgctcgacactgagtagcccaccgtggagtcacctcatcagcgtctgctcgctcctcgtccgttcgtcgagctcggcaagcccctcctcagccgtgccgagtctccaagccggctgtcgacgctcgcctttgtttctgtgttactggtatccattcttgctcgccaatcgagcaccccacccaccgttccagttccgattccgctagttgtcgttcgcctcgccatcgtctcttgggaaagattataatgtctttggcttaattagttacttcatgtggaggtcttgaagcttagatta

SEQ ID NO: 38368 - DNA, 431 bp, Zea mays
  Clone ID: LIB3060-052-Q1-K1-B9
ggaattcccgggctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgtcgggctgtccgccgaccccgagaccttcgccaagaaccgcgagctggaggtgatccactcccgctgggccatgctcggcgcgctcggctgcgtcttccccgagctgctctcccgcaacggcgtcaagttcggcg

SEQ ID NO: 38369 - DNA, 321 bp, Zea mays
  unsure at all n locations
  Clone ID: LIB3060-052-Q1-K1-C7
caaggaagctagaagcgcgcgctttattgccatgagcgcatcacaccagactagttatttacaaaactctgccacacggcggaacagagcgcccgatcgatcgggccggcggagacgacgaccacaacatcatcacgactaccacgctgctagtacttgcaactcctactgctactaccggctagtataatacacggaggcgcgcgcggggggaccaggacggccgccgttaatcaggcgctggccttgttgaccttcttgccggcaccggaagcggcggcgcgggctggcttgggcttgggctgcncgggccgccggggc

SEQ ID NO: 38370 - DNA, 353 bp, Zea mays
  Clone ID: LIB3060-052-Q1-K1-C8
aattcccggctcaacctacgcgtccgactgaacctatggctgcagcgcttgctttcgccttatcctcccggcccgccgggccggggtcacaagcgcaagcagtgaacacggcgcctcctcgctcgcgcggccacgcccccgtcgtcgtcttctcccggcaggtactacagcgcataaatacgcagcaccgccgcccggctcggatcccgtctggccacccatccgatcccacccggcagcggcgctgcgcaatggccacccacgcagctctcgccgccttccgcatccccgccggcgcccggctgcacagcagggcgccggcgtcgtccaggcacggcgtgcagaggctggac

SEQ ID NO: 38371 - DNA, 453 bp, Zea mays
  Clone ID: LIB3060-052-Q1-K1-E10
cggaattcccggggcttcagcatcctatggtgaacttgcagctgcagggatggaaagagcttcacatacaacagtagtatcaacattgctatagcagtggccatagatggtgggttgattacatcggttcttcactggtgggctaggggttatctagagatgacaaggccctcaagttggctttccagcactggatcgaagcgatgagtacaaacgggcagtggggattgactccaactgacaaagttaaaagcaaagatgaagcttcaccttaaagagacaggtgacgactctttcagttcatggaatcagcatggcacaaagaagttttcggcctgtcattgtcaatatcattttgagacccagcttcttcagatgctatcaatgagctaagatcagcaactgcacatgccttaccctcagcaactccaggagataccgcactctcttctg

SEQ ID NO: 38372 - DNA, 358 bp, Zea mays
  Clone ID: LIB3060-052-Q1-K1-E3
ctaatgttatacgttacttttctactcacgctctgaactttgcatttaagggctagttcaatacgttcttcagctccaagaaggacttggatggctatagcaagcggtctgctggcaacctggcctatggtcggagctgctcggtgctctctctctgcttgttgcatactccctggactacccaagagcacagttggctaatgacgcaaaggctgctcatggatgaacgtgaaaggcaagccaatggacttgtcgatgtctaccgcacgacactcaagtctgatagtcttgctgggctctaccacggatttaacatcttctgcgttggcatcattggctatcgtggtctgtactttgg

SEQ ID NO: 38373 - DNA, 365 bp, Zea mays
  Clone ID: LIB3060-052-Q1-K1-F1
cggctcgacccacgcgtacgacagcattcatatcccgggagctctctctttctcgcacctaactctgccttcaagggcgaccctacctcaccagctgcataaccgaaggccagataccgctctcgccagccacctgctggcaaagtcgcctacataaaccactaatcgaccacttctctgaccaaaccacacaccctggaatacccaatagcatgcaagcttcattacgccaaggctgaacactactacgtgaaaggcacctgaatgggcttgcctatgtctaccgcaagacactcaaagctcaccgtatctgcgggctttaccgtcgatttaacatctgctgtgttcgaatcattggttatcgc

SEQ ID NO: 38374 - DNA, 451 bp, Zea mays
  Clone ID: LIB3060-052-Q1-K1-F10
aggggggggagatgggaaatgttctaccggtccggaattccaggcacgcctacgaccctagctctatagctcgaggattgcttgctctccacaagaaacaaggcagagcaccaacaatggccgccgcctactcgtcctcggtcctcctgctgctcctggccgccgccttggctggcatgagcgccaacgccgacaccttcaccatcaccaacaactgcgggttcaccgtgtggcccgcggacaccccggtgggcggtggcacgcagctgaacccggtcgggacgtggaccgtcaacgtgccggctggcaccagctccggccgcgtgtggggccgcaccggctgctccttcaacggcaacagcgggagctgccagacaggcgactgcggcggcgcgctggcctgcacgctgtcggggcagccgccgctgacgctggccgagttcaccatcgg

SEQ ID NO: 38375 - DNA, 382 bp, Zea mays
  Clone ID: LIB3060-052-Q1-K1-F6
aattcccggctcgacccacgcgtgcggggcaaaagccaaaaggcattttcgtcgcgacgacgatggcagcctcgctcgaagcggcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccatagcaaaacgtacatggaggtgaagggcacgggcac

SEQ ID NO: 38376 - DNA, 401 bp, Zea mays
  Clone ID: LIB3060-052-Q1-K1-G10
cgggtcgacccacgcgtacggctcgcctcgggtcaaaccctaagcaggtagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttg

SEQ ID NO: 38377 - DNA, 460 bp, Zea mays
  Clone ID: LIB3060-052-Q1-K1-H5
taccggtccggaattcccgggttttgaccaaagatggtacggtcgaacaaacaattaaccatatccaattttgtacaccactacacaaatctaggacttccagttcaagaatacttcggatgatactttgcctgcaacatatgtgtgtacgtgcaggttttccatctagagatcaagtgttctagctatatgtacaagaccatgttcatctccgacctcgaccaagctactacttctttcgttttgttttagttgtcgctggatagtgcaaaattgaactatccagcaacaactaaaaagaaacgaagaaacggagggagtacttccgatccaaagacgaagagcttgtagaagtggagctgaacgagctaagctaagctaccaattaaagaataggcagcgcgggccgggcatgcagatgcaggtgttgtggtgttggcgccacactactgcacgcgcg

SEQ ID NO: 38378 - DNA, 328 bp, Zea mays
  Clone ID: LIB3060-052-Q1-K1-H8
ggaattcccgggtagacctacgcgtccgatctgaggccatgtgctgcgctaaggtgagtggctgtcactcgaatgggttgactggtgaggtgatccttgggaagcaggcgttttccccaccgatcattagtggtgatctgggaactttcatggcctgcatggatgatgttcgaatgctcaaggtcctggctaacgccgataccacgtgatgatgcattgactcgtcgaaacactggggcacaaggaattggattatgccggacagagcacatgttcaccgcttcatacgagaggatttaggctgctaggcctatgattatggctccca

SEQ ID NO: 38379 - DNA, 161 bp, Zea mays
  Clone ID: LIB3060-053-Q1-K1-A1
aagatggaaggcgatcggccacctatgtacacggacggatacgccaattaggtgcggacgtgcggaggtgcggtatcctgtatcggatacttaacagatagggataccccatgatacgtacgaataaaaaaagaaaaaaaaaaaaaaaagagaaaaagaag

SEQ ID NO: 38380 - DNA, 331 bp, Zea mays
  Clone ID: LIB3060-053-Q1-K1-A10
tgacggttgctctagatccgttcatcctggtggttctgtgaggccgaaagcggcgagcgaattataagatgctggacaagctgtgggacgacgtggtggccgggcctcgcccggagacgggcctcgagaagctccgcaaggccaccaccgcccgtgcgctcgtcatcaacaaagacgcggacggcggcagctacaagcgggcgcagtcgatgccgtagaccccgacgacgccggtgacgccgtcgtcgtcctcgtcgtcgacgacgccgcgcggggccgtgaacgtgtggcgcaacgtcctacagccggggagcaacctggccaacgaggg

SEQ ID NO: 38381 - DNA, 435 bp, Zea mays
  Clone ID: LIB3060-053-Q1-K1-A3
ccggtccggaattcctgggccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcatgaagctgattgtccagaagaggagggctgcgctcagtgactttgacaggttcaaggtcatgctggcaaggatcaagaagggtggtgc

SEQ ID NO: 38382 - DNA, 348 bp, Zea mays
  Clone ID: LIB3060-053-Q1-K1-A9
tgacggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccacctgccgtccggtcgtcatcaacaaagacgcggacggcggcagctacaagcgggcgcagtcgatgccgtcgaccccgacgacgccggtgacgccgtcgtcgtcgtcctcgtcgacgacgccgcgcggcgccggcaacgtgtggcgcaacgtcttccaaccggggagcaacctggccaacaagggcatgggccccaaccttt

SEQ ID NO: 38383 - DNA, 453 bp, Zea mays
  Clone ID: LIB3060-053-Q1-K1-D10
accggtccggaattcccggggaagctttcgcaagctggccagctagctccctaccgactagataccgaggagtgacggatcaggatgggaggggtgacctcgagtgtggcggcgaagatggccttcttcccgccgacgccgccgtcgtacgcgctggtggaggacgccggtgcgggggtcaccacgctcagcggccagccgcaccgggagaacgtcgagttgctgcgcttccgcacccgcaaagggaacacgctggcggcgatgtacgtgcgccacccggacgccgcgtccacggtgctctattcccacggcaacgccgcggacctgggccacctctaccagctcttcctgcatctgtccttcaacctccgcgttaacatcctcgggtatgactattcaggatatgggcaatcatcaggaaaggtatgatcaaatcttgaagttgaacaatgt

SEQ ID NO: 38384 - DNA, 375 bp, Zea mays
  Clone ID: LIB3060-053-Q1-K1-D7
attattgtactagtaaatgtccatcggatttcaatttagctgactaacgacccaaacaatacaatagcttatgcttaatattgcagagtactggagtagcgagttcaccacgagagcagcaagacacaaacgagaagaaaatagcggcagagcacagggctcgcaatcatatacggacctttatttaaccgaccacggactcacggtaggacgaggcacccttcagcgacgggcagatgggtaaccttgacaggaacataggccgtagggccctcaccgtcgctggcttcctcctgttcctcatcatactgaaccaggccagcagcgctgaagatgtacgccttcacttactcgaagcgctcctcggagagagag

SEQ ID NO: 38385 - DNA, 245 bp, Zea mays
  Clone ID: LIB3060-053-Q1-K1-D8
cgtccggaatcccgggtcgacccatcgtccggacgtatacggcaagaaagatcctcttttcataactgtatgattcagattacagcgcgttccaattcagcagcctaatgaacctaatactccaatagttcacgtttaatctctcactgtacaagatcaacatgctaaccaagtgagcaccaagcaacgaactaatcgacaatatcaccacacaacagggcttacactcatacccggagttgtat

SEQ ID NO: 38386 - DNA, 249 bp, Zea mays
  Clone ID: LIB3060-053-Q1-K1-E1
cggtccggaattcccggctcgacccacgcgtgcggggcaagcacacatgctttaatctgttttaccatttttacttccgaacgcgcggcgggggagctttaatccgggtaccttgactaccatttcaaaccccacaagctaatcattgacagcagcgccgtctcgacgtcagaatacatggcgtcagcctcatccgcgcagatcgcggcggcacccctcaggattgggtaccgtaagccggcgtccatt

SEQ ID NO: 38387 - DNA, 409 bp, Zea mays
  Clone ID: LIB3060-053-Q1-K1-E10
tgtgcacgaggctgaggattctgctattatcatgagacataggtcatcgggaaccggggtcaatgctgcatacatgcagacattcatcagaagcgtgtcatgcgcatacatatgaggcacgcacctcgaccatggtgttcgagttggcggatatggtactactggcttcgcgcccactcgcctgaatgacaagccttactggatcatcaagaactcgtggtgctagaactggggggagaacggatactacaagatatgcaggggttgcaacgttcgcaacaagtgccgcgtacattccatggtctctaccgcgtcctgagtagacgcatcgaaggagtagactctggtcagcggtgataatcgtgattccatatattgtagaactataatccctgctagtaatccattt

SEQ ID NO: 38388 - DNA, 442 bp, Zea mays
  unsure at all n locations
  Clone ID: LIB3060-053-Q1-K1-E2
ttcccgggtcgacccacgtctctcgggaatgtaccttgggtcagttacaggtctngcattttcccccttgctgatacataagtgcggttggccatcagtcttcttttcatttggatccctagggcttgtttggttcacgacatgggcaaccaaggcatatagttccccacttgaagatcctggaatcagcgctgcagaaaagaatcttattgctagtcagagcacagcaggcgaacctgttaaaacaattccatggagattaatactatcaaaaccacctgtctgggcacttatagtttctcatttctgccataactggggaactttcattttgctcacatggatgcccacatactacaatcagggtctgaaattcaacctcatggaatctggccttatctgtgttcctccctggttcaccatggcggtttctgcaaatgtt

SEQ ID NO: 38389 - DNA, 251 bp, Zea mays
  Clone ID: LIB3060-053-Q1-K1-E7
gaaaactgtatcatatttagtggcacctcagattgaggaaaaatcaaaccctggttgtcaaatactcctattgacagattcagattacaatgttaatgtcaattttcgaaggcaaaaaaaacaaaaaaaaaaaaaaaaaaaaaaaaaaaacgactacagctctaacaaatccaaggtcacaggactcctgcattcaagttcatatactcttctatagtgacacctacatttacttcagtggcacttaattc

SEQ ID NO: 38390 - DNA, 409 bp, Zea mays
  Clone ID: LIB3060-053-Q1-K1-E9
tgtggacgaggctgaaatttctgctaacctcatcaaacatgggccattggcaatagggatcaatgctgcctacatgcagacatacatcggaggcgtgtcatgcccatacatctgtggcaggcaccttgaccatggtgatctccttgctggatatggtgctactggtttcgcccccattcgcctgaaggacaagccttactggatcatcaagaactcctggggctagaactggggtgagaacggatactacaagatatgcaggggttccaacgttcgcaacaagtgcggcgtccattccatggtctctaccgcgtccgtagtagacgcctggaaggagtagactctggtcagcggagataatcgtgattccatatattgtagaactatgatccctgctagtaacccattt

SEQ ID NO: 38391 - DNA, 365 bp, Zea mays
  Clone ID: LIB3060-053-Q1-K1-F6
gtccgcttgttcgcagggtttacaagacttctctgtttaaccagtaatcacgcactgtgtgggtcccttaaaccatcattcttgacgaaaggtgactaatctactacgccaatttgttaattccacttggtctccggtctaatccacgtttttgtcatctctttcgagatgaaaatttgatttagcaccattagcagctgtcattatcctcatgcaatatctatttcttattgcttagcacctaacaactcatcatctcttggacatttcaacatgaaattatcttcatgataagaatgtcctactgacttcagtataccactacaaactaatttgaaaatgcttgatcatttctgagatgatta

SEQ ID NO: 38392 - DNA, 418 bp, Zea mays
  Clone ID: LIB3060-053-Q1-K1-H4
aagcaaccatggcggcaaccggaatgtccccctccccctcggccgcaataactcgccacatccatgctcgtcgttcctgtgctgctgcttccttgtccctccgtcgctcgggcttcctggggcgcgtcgtgctggccgcggtgccagtggccgtggacgccacccggcgccgccgcgtctccgtgtcggtgcggatggcctgggacggtccgctctcgtcggtgcgcctgatcatgcatagcaggaacgcgaagctgagcgagaagctcaaggagcacatcgaggacaaggtgggtcgggcggtgtccaagcactggcacctggtccgggaggtagacgtgcgcctctccgcgcgcggcggcgagctcggtcggagccccaagacgtcgcgctgcgagatcaccctgttcaccaagcg

SEQ ID NO: 38393 - DNA, 434 bp, Zea mays
  Clone ID: LIB3060-054-Q1-K1-A12
accggtccggaattcccgggccgctttacttagacctgggcgttttgatagacaggtgtctgtctacgttcctgatgtacgtggaaggacagagattctaaaagtgcatggtagcaacaagaaatttgattctgatgtttctcttgatgtcatagcaatgagaacacctgggttcagcggagcagacttggcaaaccttctgaatgaagcagccattctggctggaagacggggaaggacagcaatttcttcaaaagagattgatgattctattgacagaattgtagctggtatggaagggaccgtgatgacagacgggaagagcaaaagtcttgttgcttaccatgaagttgggcatgcaatttgcggaactttgacgcctggccatgatcctgtccaaaaggttaccttagttccaaggggtcaagctcgtg

SEQ ID NO: 38394 - DNA, 283 bp, Zea mays
  Clone ID: LIB3060-054-Q1-K1-A3
accgaatcggagggtcgacccacgcgtacgctggtacagggaggactacagcgtgcactgcttttgcgaggacgacttgaagaacgactgccgcgtgggttctctgaagaaccacttcatcgagcactgcctgtccacggtggacacggaagcaccagccgcggcatcatgttctacacgcaccgcgtgctcggctactccatcaacgcttgggacaacatggaatgatagttggacgagcccgaggacgatgagaacctgaaccacctgaggtataagtacc

SEQ ID NO: 38395 - DNA, 452 bp, Zea mays
  Clone ID: LIB3060-054-Q1-K1-A5
gacagtatgagccatccctcatatgggtttatacctgttccaattcctgttggtgccacgatgccgtaccattatggtgcgattctgcagcccgtatactacccacagagtcctcttatgcactgtgattcagctggaatcaacaaggcagcaatccagcatgcctctgggcaacctaattaccatgaagctcccggtaaaccatctcatgttcttattgaacacaaacagtcagaggaaaaccaccagttgcatcattcaagacaaattcttcgggaatcaggagaaccaattgacatggcgagagctcacgtggatcgtgctaaccagactgcaagctgcagccaaggtatctgtaaaggaagtggatgcacatgtagtggtgaagccgatatcaacgcaaacacaatggttgccctagagagtggcaacgagagtggaatccaaaatgg

SEQ ID NO: 38396 - DNA, 378 bp, Zea mays
  Clone ID: LIB3060-054-Q1-K1-A6
ggaattcccgggcacggctaaacatccaaccgtgctaacttaccataacaacaactcaattcctatcgaattacttcctatcgaattgctatagctaaactcctataggatagaacgtacacaaggtgtacacatcatatatgaatgaaacatattcattaacttaagcatactccttccttgatctaatgagctgatattaattaaatatctcctgttatagatttttgcacaggtctcatttacgcctaatccatatggagtagacgctgacgttgtgagaattcttaattcatgagttgtagggagggacttatgtcagcactgacagaagctaaagcacgtgttggatttaaagctggtgacacggattataaa

SEQ ID NO: 38397 - DNA, 249 bp, Zea mays
  Clone ID: LIB3060-054-Q1-K1-B10
ggaattacccgggccgacccatcgtacggctgctcttctagcttatctcttcgcttcctcacccaatgtggccatgaccggaccggtacatatagtcctgcatgtctacatagcacctcatatgtccaacttaagccaggcattgatcagaacatctttacacctgcgatagactctgagtcgcccaccgttgcataaactcgtctccttctcctcaatacaaatgcgttccacgagctctacaagccc

SEQ ID NO: 38398 - DNA, 359 bp, Zea mays
  Clone ID: LIB3060-054-Q1-K1-B3
acccacgcgtgcggcggaaaatgtagttttgagcttttagtttccactcatagcgtatcttaactgggcaaggttatataaaccactgcctaggcaccaagctggactatagtacagtgaggcagatgcccattcactatgggtcgtaccgtctgaactatttcacagtctcttcacctatcacaacacaagtcacacatgctagtagaacttgctactcattgaagattgacaagaatgacgcgtgttccatcacatactttggtgacggtggtacaagttgatgtagacttccatgcatcgctcaacttctcgactgttattgatgcaccggtgatcttcttctgcctgaacaatgg

SEQ ID NO: 38399 - DNA, 302 bp, Zea mays
  Clone ID: LIB3060-054-Q1-K1-B5
ttcccgggccgacccactcgttcgcgtgcccgcgcattatagatccaggttaccttcacgtgcacacggctgatacctggccggactgacacctaaaactatctcactagccggtccgatacaactgccgcacttccaaaaccttggcgttaccttactcaatcgccttgctctacaatactctttttccggtcttcccaacagcgattactccatgttccaaaagccttctcatgagacgagtactctgactagcgacttggacacgccctggaatgcatcaccaatcgcgacgactatga

SEQ ID NO: 38400 - DNA, 288 bp, Zea mays
  Clone ID: LIB3060-054-Q1-K1-B6
ggaattcccggttcgacccactcgtccgagtctagcgcgtggcgtcgactgcggtgtttgactgagcggccgaggagccggttcttcgtcggggcatctcagcggtcctgaggtcgcttagcagcacatattcgttgcgctaggctccgactcggctcggtacacctctctacgcgtgctcgcttgtcacttctcagcacctatactcatcaaagccgacactatgcaagtcactatcgctcttctgacgcatctgtatccgctcttgttcctgtatgatcagtgact

SEQ ID NO: 38401 - DNA, 411 bp, Zea mays
  Clone ID: LIB3060-054-Q1-K1-B8
aattaccgggccgacccactcgtacggcggagccgaaaatgtagtacagggaatttggttttcttctatggctaggcttaactgggcaggtattagcaaaccagtgctttgggatcaagctggactatggtaaagggaggcagatgcccattcactatgggtcgaaccgtctgaactatgtcacagactcgtcacctatcgcaacacagtttcggcatgctgatggagctgcctactctctcaagatggactacaaggacgcgtgtgccataacatactttggtgactgtcagacaagtgagggagacttccatgcaatgctcaacttcgtggctgttatggatgcaccggtgatcttcttctgccgtaacaatggctgggccatcaacactccgactactgaacaattca

SEQ ID NO: 38402 - DNA, 481 bp, Zea mays
  Clone ID: LIB3060-054-Q1-K1-C11
gcttgtaccggtccggaattcccgggctgaagttgcactttgaggagagacgagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattgttcacgtgggcccacttccaattatt

SEQ ID NO: 38403 - DNA, 451 bp, Zea mays
  Clone ID: LIB3060-054-Q1-K1-C2
actcggtctcggaattcccgggtcgacccactcgtccgctgccattaagcacacagcaggatttgccttatccggtagcaagcttgttcctaagacgggtgagattgcctctgaacctaactaccaggtcactggtggtatggatagtgagcaaagaatcatcttttcagaaaagatccgttgtgcagtagaacaatcaactgcacaggctaaaggtgcaagccttgactcaatggaggcagttaagcacaaggaaggcgtatggagcaatctatccacaatctcaagaaacaagttatctccagaggtcgaagagaagcttacctcagttgcagcagctgctgaagcagcagtttctgttgcaaaggcagctgcagaagctgccaagatggcgtcagaggctgcattgcaggcgaaaataatggcagaggaaactcttagctcttttaca

SEQ ID NO: 38404 - DNA, 448 bp, Zea mays
  Clone ID: LIB3060-054-Q1-K1-C5
ggaattcccgggtcgacccactcgtccgaaggagggccacatcatggtctgcaagatcgccgagaagtacctgtcggagaaggcggcggcggcggtgcaggcgctgctgccggagtcggcggtcggcgagctgtcgacggtgtgcccgtgggcggaccatgtgcgctggcactaccactgggccagcccgctccactacgccaacaccccccaagtctgcaacttcaagtattctcgggactgccacaattctcgtggccagcaagggatgtgcgtcgtcggggctatcaacaactacacggaccagctctacagctacggccagaagacttcgtataacctgactgagagcctgatgttcctggcacacttcgtcggcgacgtccaccagccgctgcacgtaggcttcgaagatgacgagggcggtaacaccatcaccgttcactgg

SEQ ID NO: 38405 - DNA, 359 bp, Zea mays
  Clone ID: LIB3060-054-Q1-K1-C8
tgcactttgaggagagacgagatcatgttgaatcaatactcccctgttctctccttgtgcctgatggcccttgtcgtaactgctatggtctgtgtcatgtacactacttcagcacaagcaggaaggagtgtctacaactcgtacgaacctgatggaaggggtggatacaactctgtagtcatcaacggctgtggcagaccttagctaggcggtgtatcggagcctgtatcagaaatcgaaataatataagactgacttcaacgtatcacactgactctccgcctagctaaatctgccgtctacagtgcacactctagccgatcaacggttcacgctaccaggcgctctacgcggatgag

SEQ ID NO: 38406 - DNA, 436 bp, Zea mays
  Clone ID: LIB3060-054-Q1-K1-C9
tctccctcctccacgcgctgcgcagcatcacggacgaccagtggttcagggcgcggatcaagaggtacggcccggtgtccaagatgtcggtgctgggctcgccgacggtgctgctggccgggacggaggccaaccacttcatattcaccaaccagggcctcatcctcacgcagacgcgcgcgctccgttccctcctccgccgctccatcctcacgctcaccggcgacgacctgaagcaggtgcgcagcgcgctgcagggctacttaaggcctgagatggtccgggggtacgtggggaagatggacgccgaggtcaggaggcagctcaagctcaactgggttggtcgcagcactgtcaacgtcctgccgatggcgaggagccttacactaggggtcatctgctccgtcgtcttcggcgaagaagcagccgccatagt

SEQ ID NO: 38407 - DNA, 358 bp, Zea mays
  Clone ID: LIB3060-054-Q1-K1-D6
ttcacgcgttcgcccgacccgatccgcttgccaacgacttccggctccactgtcgctcgcgctcccttcaatcccacgcacgacaatggtggccgatcgcctccgcctcgcgctgatgctcttcgcgtgcctctgctccacgtgggcagcgcacacgactggagccgaccatccgcctgacgttagagcgcgcggctgtcgacgacgccgacgggacccggtggtccgtgctgatcgcgctatccaacgggtactacatgtaccgtcacgagtcggacatctgccatgcataccagatcatgatgatgggcgcacttaaggacgtgaacatactcgtctgcatgtaccatgacatctc

SEQ ID NO: 38408 - DNA, 454 bp, Zea mays
  Clone ID: LIB3060-054-Q1-K1-D8
ggaattcccgggtcgacccactcgtccgctgggggataccagcctgtaccatatggtggtcaacaatggcagcagcgaccttatggaggcgggacaccccccacaagacctaactcacaccaatcacaaaaccgttatggtaccttagacagaagttctaacaagaggtcctcaggtcatggccaatactaatccctaaatgcataggcccttattgagtaaaggggaaatgtaatccaaatccttgacaaatcactaagcaatgccttcatccaaacaaaaccccttactgttgtggccctatccttgttagtaatcaccaaacaatgccttagtacaaacaaccccttactgttatagtcctgttcctgttagtaaaaattatcaggtatcatgaatgatgtcaccttagccagtgacctactacaagcttcttggtcgatttatcaagaac

SEQ ID NO: 38409 - DNA, 346 bp, Zea mays
  Clone ID: LIB3060-054-Q1-K1-D9
tgagtctgagaacctcacggtttacatttatcaagtgatcgccactggtatggcagggggatctgttgctgctgcgtgccagtgcgtgatcactgctgatgattctgaagcatgactttctctaggaaatgctgctaatacttgtaagggcggataccagccatgacgacgcagttacacgcacgctgctcgggagatgcttacagtaacgctgacatgacttagcacgctgcagcagtcgcacgtccatgctggaaaagatccttgtagtcatgatatggcttctgcgtaaggaatccgcagaagctagcgacgaccggatgaccattgctgtgcgaatgatatt

SEQ ID NO: 38410 - DNA, 449 bp, Zea mays
  Clone ID: LIB3060-054-Q1-K1-E7
cggaattcccgggtcgacccacgcgtacgccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacattaccaccctgaacgtgttccaggcctacacgctgaagcggataagggaccccaacttcaaggtgacgccccagccgccgatgtccaaggagttcgccgacgagaacaagcccgccggactggtcaagctgaacccggctagcgagtacccgcccggcctggaagacacgctcatcctcaccatg

SEQ ID NO: 38411 - DNA, 328 bp, Zea mays
  Clone ID: LIB3060-054-Q1-K1-F10
taccggtccggaattcccgggtgggttgaaagatgggatcgctgccaaatggaggtactcgattggtgtaaggtaccacgggctagctgttggatcggggaagcttacaatgtcaacggctgtgggctgtcactgcttgaagctgctgatgaaagtcaaatctatctctagacagggaaaactcacctgataaaggctcaacttgctgctataggcgctcctattataggggattctgcatacatgactgcatcaatgacagctattgtcaacccaagcataaacgcattcacagagagaggctcagttacaacagtgaacaggtgaa

SEQ ID NO: 38412 - DNA, 428 bp, Zea mays
  Clone ID: LIB3060-054-Q1-K1-F5
cggaattcccgggtcgacccactcgtccgtgcacaactacatttgcaaatacaatggttcatacaacatacatttccagtgctagccattcagaatgcagcaacggattttgattgtgcatacaaccctagcttatatgttcaagtctcaagaaaacagtttgaactaaaaaaaaaaaacaaaaaaaaataaagaaatataaaaaaaaataaaaaaaaaagaaaaaaaataactaaaataaaaaatgaatacaaatgaaagatagaaagcacattctataacttaaaaaaattgaaagaaccattatatgctccaattacatgaaaagtgattgaagaggtgagggccattttaagtcccggtattacatattggtagcgtatgacatattgtttgcaaactgtcccattcttttaaatcgatcagaa

SEQ ID NO: 38413 - DNA, 485 bp, Zea mays
  Clone ID: LIB3060-054-Q1-K1-F7
cggaattcccgggtgaagcgatacgcacacattacaagctattttccgctgatattcgtgacataccaaaactggattcagttattcgcatggctgaaatggatcctagagtgtgtgcttatttacctggacccaactgccactggtgctattgtgagttgggcatctcaaaagttctccactgctgtctttttcttatatgagcagattcatcctgatgatgcatttggggagcaaatgattagaaatcttgagagtagaggatgcccccttctcggtataaatgctacaccaaccttgagtcacaaggagaaactttttcttggcaatggatggcagagagccgttgcatgggatatgctgaaaatctataatgacttcattgacagtcaagaaagacgcaggatcgaacggttagacctgtttgatgagtttgaagagtggtatatgatgcatgaacactactgtgtggcctatggaatcaa

SEQ ID NO: 38414 - DNA, 139 bp, Zea mays
  Clone ID: LIB3060-054-Q1-K1-F8
ggaattcccgggtcgagccacacgtacgcattccaagctatccttcgctgatatgtttgacttacctcagctggagtcatgcattcgcacggatgacacggatactagagtgacgtacatattcacctggacccgactg

SEQ ID NO: 38415 - DNA, 438 bp, Zea mays
  Clone ID: LIB3060-054-Q1-K1-H5
tcggaattcccgggtcgacctacgcgtccggaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgtcgcgcccaggccgtccaccgtctccatggtcgtccgcgccttcgcctacgccgatgagctcgtgaagaccgctaaaacgatcgcgtcgccggcgcggggcatcctggcgatggacgagtcgaacgcgacgtgcgggaagcggctggcgtccatcgtgctggagaacacg

SEQ ID NO: 38416 - DNA, 393 bp, Zea mays
  Clone ID: LIB3060-054-Q1-K1-H7
gaaatagaactatccaggaagctttatatatccacagccaatagccagacatatgcaccacaactggtgtgtaaaagaaaacatgttgcatgtaaactcttcgaattcaaagtagatcatggcaatctctttaaaaagtagaatgaggtgataatcacatatttgcattgcaaggtatatatacccgttgtaagttggcaagctcaaggacagctgtcatgccatcagatgatatgccctcggttaccagaaaacctttatgtaagaggttgtgcctttgtgaaaacaaatattcccccaccaccaactgaacgacccatgagcatatcacgatcaaggtaagacagataatataatcctccaggtgatcgtctttcaggaccactaacagga

SEQ ID NO: 38417 - DNA, 372 bp, Zea mays
  Clone ID: LIB3060-054-Q1-K1-H8
aattcccgggtcgacccacgcgtgcggcgaagaaggaagccggctagggtttcctcctactttcccctcctctccttcagcgacgagcgctgtccacaccctcgatatccttcccctcggacccggaggcgagcagcagcctccagcgcctgccacgcctgcccgtctcgttattggtcttcattcctgcaggaggattcgccatgtctgacatggagtccgtcgcagctcttatgaactcgacaagctccaagatacagcagcttcaggaggcatttgctgagcttgagagccagagcacggttttcatgaacctcaagtggaagcagctttgagaccactttcggggtcttgaacagtccctcaagaaaa

SEQ ID NO: 38418 - DNA, 653 bp, Zea mays
  Clone ID: LIB3060-058-P1-K6-A11
ctcctctcctctcctcggcggatccggcaccgacccaccgcccctctgctcgctccttccgccggaatcgctgctcctctctgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactgggatgatatggagaaaatctggcaccacaccttctacaatgaactgcgtgttgctcctgaagagcacccagttctgctgacagaagcacctcggaacccaaaggcaaacagagagaagatgacccaaattatgttcgagacattcaatgcaccagcaatgtatgttgctatccaagctgtcctttccctgtatgccagcggtcgcactacaggtattgtgctcgattctggtgatggtgtgacccacaccgtgccaatctacgagggata

SEQ ID NO: 38419 - DNA, 635 bp, Zea mays
  unsure at all n locations
  Clone ID: LIB3060-058-P1-K6-A3
cctgcagtccgggccgacttccgggtcgcccagcgtccggccaaatcaacgccagcacagcaaagcaactacagagagtaggagatgcttactctccacaccattcagtcatgcccctcgctgcgcagatcctctctgttccggcgtgctctgctaggcaggaagagatctttcatttctgccagcagttctgaggatgccgaatccggcactcccccgccgcttggtggcgacaaacaccagcaggaggttcttgcacagatcgccatgcttcagacgcagaaggtgcgcatcacagacttcttggacgagcgctctgcttacctgaccaagttcgccaaggacgccgactcggagttcgacctgattgggcagaacgccatgaaagaacttgatgccgttggtgaccagatactggagaggctcgacagcaagatgcaagccttcgaggagacggctgaggtacaacggcaagagatagaaatgaacgataaggtgttagaggacttcgaagactggattgagaaggagaaaaacgaaggaatgttcttcaaaagccttggcaaggtcaaacctcngaacaagatggaaataaaggtgaaagcccaaggtggaagcacagaaggtcaaagaga

SEQ ID NO: 38420 - DNA, 629 bp, Zea mays
  unsure at all n locations
  Clone ID: LIB3060-058-P1-K6-A4
ctctccaagccacggcgtcaagccgctcctccgctcctccccggcttctcctccgcgcagctcctcctccagcttccctacgcattgctgtagccccttcccatggtcgccgcagcgtcacactcctccctgccgatctctccctctcactgagtccttccccagctcatcacgcccagctcggatttcttcttcccggcgcccggctccagcgcacccacctccccaagctcgtcgcgaacccccagctccctctgcccagctcgcgccctgctcccctgcgcgctggtcggcaatcggcatcctgcgtcgtccacagttcgctggccaagctccatcttccatagtcgcgccctggctccagcttcctccctgcttcccagctcgcggcgcccctgcttttctctctctcctccatggccacgtcttgccgaggtccctgctgtagctggttcgccggtgcccgaacctcgctgtcgacctccctgttcttgccctcccatcacgcccaactgcttgcctgtgctcagctactatctgcggcatcgcgcgacgttcgtcatctatgctagtncatgccgngcgacccatctgcgcgcgatgctccctactcgcattcgtacagaact

SEQ ID NO: 38421 - DNA, 488 bp, Zea mays
  unsure at all n locations
  Clone ID: LIB3060-058-P1-K6-A5
tgcaactgagcttgtagcaaagcttagggcatatcatcatactgctcaaacaaaggccgacaagcaacattattcaagtatgggccttgacctctctaagggtatcattcgcaacaaccttgagtatggcgtgatagagccatcgatgagcaaagtaaagatcattcagtttgccacggaggctgccattactatcctgaggattgacgacatgatcaagcttaccaaggaagaagagggtaacgaagagtaagcagcccaccagtagtgggctagtggactcccatgggatggttgccatagcatgtagcacttgttttttcacttatcgtttacttttgcttgctgtgagcattcgtttgtaggaaaagtgagaacggatgtgtatcaatccgtgttgggtgacgatgactcacggatgaatcaaatatttgcgtatattggggccaaaacagttctatctgaaggatttaagttggaaanaaaaa

SEQ ID NO: 38422 - DNA, 592 bp, Zea mays
  unsure at all n locations
  Clone ID: LIB3060-058-P1-K6-A6
tcccgggtcgacccagcgtccgggtgagcaagctgaacctggcgcagaccatgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggngacgacagcagcctgactgacgagatcctcgcagcaggccccaacttctgaacctaaagcaatggatccggatgaat

SEQ ID NO: 38423 - DNA, 545 bp, Zea mays
  unsure at all n locations
  Clone ID: LIB3060-058-P1-K6-A7
gatcgtcaaggaagtgggttcctacctgaagaaggtggggtacaacccggacaagatccccttcgtgcccatctctgggttcgagggtgacaacatgatcgagaggtcgacgaacctggactggtacaagggccccaccctccttgaggcgctggaccagatcaacgagcccaagcggccctcggacaagcccctgcggcttcctctgcaggacgtgtacaagatcggcggcatcggcaccgtcccggtcggccgcgtggaaactgggctcctgaagcccggcatggtggtcacctttgcgcccacgggcctgacgacggaggtcaagtcggtggagatgcaccacgagacgatgcaggaggcgctgcccggcgacaacgtcggcttcaacgtcaagaacgtggcggtcaaggacctgaagcgcggctacgtggcctccaactccaaggacgaccccgccaaggaggctgccagcttcaccgcgcaagtgatcatcatgaaccacccggngcagatcggccacggctacgccccggtgctggact

SEQ ID NO: 38424 - DNA, 613 bp, Zea mays
  Clone ID: LIB3060-058-P1-K6-A8
cgcgcaccgctcgcaaaacctctcctgctcctacgcccgccccaaaccctagccccgacagcgcggcagctcgtggctatggccgcgtcagtcccgtcggcgggtggggcggggacgatgagccgcgacgcgttccgcgcggccgtgaccaacacgctggagcgccggctcttcttcgtgccctctttcaagatctacggcggcgtcgcggggctctacgactacggacccccaggttgcgctgtcaaagctaacgtcctcgcattctggcgccagcattttgtattggaggaagggatgcttgaggttgactgtccatgtgtgacgccagaagttgtcttgaaagcctctggacatgttgataaatttacagacttaatggttaaagatgaaaagacaggcaactgctaccgtgcggatcatttgctgaaggacttctgtaaggataagcttgagaaagatcacacattgtcaccagagatggcagaagaatacaatagagttcttgctatcctggatgatctcactgcagaacaattgggtgctaagattagggagtataagattgttgctccagacaccaagaactcattatcagatccattacccttta

SEQ ID NO: 38425 - DNA, 618 bp, Zea mays
  unsure at all n locations
  Clone ID: LIB3060-058-P1-K6-A9
actttccgcgcctcttcttctgcgcccctctcctcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacnggcgtcatcccgcccgcgggcacctacaactactgggccgactcctacacgctcttcgtcttaacatggcgctcatgggcttcgncgagca

SEQ ID NO: 38426 - DNA, 611 bp, Zea mays
  unsure at all n locations
  Clone ID: LIB3060-058-P1-K6-B1
cctgcagttccgggccagacttcccgggtcgaccacgcgtccgggtgagcaagctgaacctggcgcagaccatgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaaaaagaactncgaggtgttcgccagctacaagatcggngacgacagcagcctgactgacgagatcctcgcagcaggccccaacttctgaactanagcaatggatcccgatgat

SEQ ID NO: 38427 - DNA, 547 bp, Zea mays
  Clone ID: LIB3060-058-P1-K6-B10
tctcaagcagcatacaacttggtcaaggataggacagcggttcaggatacattcagctatggctcccatgtgatgcaatatggttcattggagttgaatgttaagcatctgttttcgtacattggcacaaaccctgctaacgatgacaacacgttcatagaagacaactcgttgccatcattctcaaaggctgttaatcagcgcgacgctgaccttgtctacttctggcagaagtaccggaaattggcagacagctcacctgagaaaaatgaagctcggagggagttgcttgaagtgatggcccacaggtctcatgttgacagcagcgttgagctcattggaagccttctctttggctctgaggacggtccaagggttctgaaagccgtccgtgcagctggtgagcctctggtcgatgattggagctgtctcaagtccacggttcgtacttttgaggcgcaatgtgggtcgttggcgcagtatgggatgaagcacatgcggtccttcgcaaacatctgcaacgctggcatccttcctgaagcagtgt

SEQ ID NO: 38428 - DNA, 384 bp, Zea mays
  Clone ID: LIB3060-058-P1-K6-B11
cccgggtcgaccacgcgtccgaaatcccgagtccatgatcgttgaagctgaaccgtgaagtagttatactgcttatgcttttctttcttatagtaatatgctccgtctcaaaataagtcaatttctagaatcacttaaagtcaaattatcttaagtttgaccaattttataggaaaggcaccatcgtctatgtctctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacagttcttgtc

SEQ ID NO: 38429 - DNA, 387 bp, Zea mays
  unsure at all n locations
  Clone ID: LIB3060-058-P1-K6-B12
cccgggntcgacccaacgcgtccgaatcaataataatgcaatcgaaagcgagctgttcatacgcaaaaaaaaaaaaaaaaaaaaaaaaaaaaaaaaaaaaaaaaaaaaaaaaaaaaaaaaaaaaaaaaaagaaaaaaaaataaaaaaagaaaaaataaaaaaaaaaaaaataatatataagagaaaactaaataaaattaaataaagagaagaaaaaaaacgaaaaaaagtgggaaaacctttgtaaatagccaaacttaatgaacctagcaaaataaaccccttatggacagcttgcgtaataaccaaaaggcccacaccgggcgcagttccaaaaagttgcgcattctaaaaagctaatgggacccaaaatgtaatggcacataa

SEQ ID NO: 38430 - DNA, 434 bp, Zea mays
  Clone ID: LIB3060-058-P1-K6-B2
cgaatgccagttgggtgagctttttgctagtagctgatctgcgggtggatcggataaatggccttggcagttgtgatcagttcggccggcgtcctatgcattggcatcgcaaaatcaccagcggaagcaaggtgtgcgtgcacatgcgcgcctcttctttccagcaggattttgtgtagcgagggctgatgtggccaggttcgtgatgagccacgagacaaaatactcgtggctagtcagctcgttcgacttgttttagttttgtcacaagttaagctagcatcttagctcgatttgttacaagccagctcgagctaagcttgttagctcgaatgatctagcatttgtaaggataaactaataagtgataaactgtattaattaggtgttgtatttatgtggtatatgaaattacaagtactattactctaaaa

SEQ ID NO: 38431 - DNA, 197 bp, Zea mays
  Clone ID: LIB3060-058-P1-K6-B3
ggctgcattgctactactgtttaatggatctgacaggcttagttattctgagattgtaacacaattaaacctgtcagatgatgatgtagtgcgtttgctccattctctttcttgtgcgaagtacaagatccttaacaaggaaccggctagtagatccatctctcccaatgatgtttttgagttcaattcaaagttta

SEQ ID NO: 38432 - DNA, 555 bp, Zea mays
  unsure at all n locations
  Clone ID: LIB3060-058-P1-K6-B6
gcagcgcgtcctcgcctaaagccctcgccgccctctttcggctcctcgcctctcgtccacgcgcgacgacgtgtcggcaaacactcagtccatcccaagactcgcgaggcgatggtggacgcgtggtggcctctgctgggcgcggcgatcccggcgctggtggggggtcagtttgtccgcatcaagcgccgccgcgacgaggagcagcgcctcaaggcggcgcgcgggcgggagaagagctccgacgaggtattcgtctgcgagcgcgtgtgcacctccaagcgtatgctcaagaaggtaggggccttctccaaggaccccataccggagacctgcgtcaccgtctgcggcgtctctgaactcgacgcctgcgccgacgcttgcgcgcgcaccgtctgcgtcaaccagcaccaggtgcccaattggaacgacgtctgcctcaagaggtgccagaacgagtgcctcaaactctcctcaaanctcatgtaatgaccatctcgctattgtgctgcgctccttatataccaccccggcaagttcttctctgcttctatc

SEQ ID NO: 38433 - DNA, 391 bp, Zea mays
  Clone ID: LIB3060-058-P1-K6-B8
gcctttttccttgtcaaatccattgtgtccactgcattatttgttctggcaatgatgggcctcatatatctcagcttcctggctatgaacccaaaggaggcatccggctctaggctggatgaagcaatgggcaacccatcggaggaccctgttgaagaggcccgtaggataatggagaaatacaagtaattaacctgtgcaaaggtgctgtactctcagaggtatgatttgtctgtagagcttccttgcgtgacgtgaggggtgatggatgggtggatctgattttagcatactacactacactcagtgttttgatatatgtaaatatagttgcacggttggtgaccaaatgaattccgcaaatcaacaagaggttaccaattttccggtc

SEQ ID NO: 38434 - DNA, 535 bp, Zea mays
  Clone ID: LIB3060-058-P1-K6-B9
ggaggcttcacgacgctgttcacggccaccgaggtgccggagctggtccggggcgtcgtgctcctcaactccgccggccagttcgccgaccccaacaagccggccgccgcgccggccgaggaggaggaggggggcagcgcgctgtccaggtacatcgtgcagccgctcaaggaggccttccagcgggtggtgctggggctcctcttctggcagtccaagcagcccgccagggtcgagaaagtcttgaaaagcgtaacgttaactcagcttgatgtctaagtctaatcgcataaagttcatcgtcttagatcgtcacactcatacctgcaggtgtacatagatcccagcaacgtcgacgactacctggtcggctccatcacggcgccggcggcggaccccaacgccggcgaggtgtactacaggctgatggtcgcggttcatgtcgaaccagagccggtacacgctggaccggctgctggggaaagatgtcgtgcccgctgctgctgctgtggggcgacctggacccgtggggtcg

SEQ ID NO: 38435 - DNA, 570 bp, Zea mays
  unsure at all n locations
  Clone ID: LIB3060-058-P1-K6-C1
cttcaatagatggcctttactgtgttggtgacagctgttttcccggacaaggtgtaatagctgtagcattctcagggatcatgtgcgctcaccgagtcgctgcagatattggactagagcaaaaatctccggctctagatgctggtcttcttgggctactcagatggttgagaacacttgcatagaacgatatcagacagttgaaaatggacttcatttttccccccggaaggctgatgtttcaccagagttaggattctgcacgatctgttatgatgatcttgttatctgtaccatctcagcatcgatttcttgaaactcctaacggaaaaaaaaaggaatacgaatgggtgtacaggtttcagattttgaattatatgattacggtgtcagggccatggcatattggtatgcatataaagactacatcatagagtaaccagatggtgtacatcatctgattaccgcaataagcagagcactacatttgggagcaatgtaaatcatgttacctaggattttgaaagttctgttttgagatacccttcaactntctgaatatgcataagc

SEQ ID NO: 38436 - DNA, 484 bp, Zea mays
  Clone ID: LIB3060-058-P1-K6-C10
tgacgatgcttttaaccatatgaatgctacaagggaatcaactgctggcatcagccgactgtcaagggtgtcgtcacagtttcttcctcccgatgcttcacgcaaggttcaggtccctttgggtaactatgacctgagatactccttcctgtctcaaagaggttactacccagaatcactggacaaggcaaatcaagatagctactgcgtacataccccatttggacctagtcctgatgaccacttattcggtgtgtttgatggccatggggaatatggagctcaatgctcgcaatttgtgaagcgaagattatgcgagaacctgctcagagataacaggtttcgtaccgatgctgtgctggctcttcattctgcttttgtggcaacgaacacacagctgcatgccgacaacttggatgactccatgagtggtactactgcagtcactatcttggtcaggggtaaaactatttacgttgcaata

SEQ ID NO: 38437 - DNA, 659 bp, Zea mays
  unsure at all n locations
  Clone ID: LIB3060-058-P1-K6-C11
tttcttttttttttgacacgaggaactcatcatgaatccactaattgctgctgcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttttagtacattggcatttgcttatgtaattctaagtatatcaatactttactttactcctatttattatattatttcttttttatattattccggaaattttgtatttatcgggacagacaataccctaggaaccccaagaagggctgatttgagcatgatcaatttagaggatatgctcgccctcttccttcccgtccttagtttaggacagtggaaagtatttttccttttattttaggaattttgggaacatttcncaaaggagatctttcacaggtcaaacgagacctaagacttaatctaaaagaaattattagattgaatctatttgca

SEQ ID NO: 38438 - DNA, 570 bp, Zea mays
  unsure at all n locations
  Clone ID: LIB3060-058-P1-K6-C2
cctgcggttccggggcagcttcccgggtcgaccacgcgtccgcccagcgtccggccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcggttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgntcccgttcaaggccggcaagtaccagatgaagaagctgtgcctggagncgacgtccttcaccgtcaaggcggagggcatcgccaagaacgccccgcccgagttccagaagaccaagctcatgacccg

SEQ ID NO: 38439 - DNA, 505 bp, Zea mays
  unsure at all n locations
  Clone ID: LIB3060-058-P1-K6-C3
cacacaaacagacaagcatacaacaccgttgccatttagctgttcttgctaggcagttgcgcgcttacattgagccgcagctagctgtctactacggcacaactatctcctgcgcgcgtgctcgatcgatctgaaggccagacctgtgcctgtccaattttgccttgttctacccaccacaccagtagtcgagaaggttccatataagcgcaagcagacagcagcaaaagagctaaggagagtctgagacaaggttcgaacagatggaggatgtggtgaagttcgtctttggagtttccggaaatgtcatcgctctcttcctcttcctttccccagtgcctacngttctggaggatcatcaggaggaagtcgacggaggatttctcgggggtgccgtacagcatgacactcctcaactgcctcttgtcagcttggtacgggctgccgntcgtgtccccgacaacatgctggtgtcgacgatcaacggcgcggcgcgggcgatcga

SEQ ID NO: 38440 - DNA, 556 bp, Zea mays
  Clone ID: LIB3060-058-P1-K6-C4
gatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcattcgtggtcattggccacagctgctgcggtggcatcagggcgctcctctcctcaaggacggggcgcccgacaccttcacttcgtggaggactgggtcaggatc

SEQ ID NO: 38441 - DNA, 390 bp, Zea mays
  Clone ID: LIB3060-058-P1-K6-C5
cagatacagggtctcaaggactccattgagaagcttctcatctgatctgccgaagacctttcagtgtgatgggcctcatcgacacttttttcagaggcttggactggtgatggtgtcttgtttactttgcgcttttcaaactatatttgaacactgttaagtcgatcatacttgaattgtactgcatcttatgtttgtgattgtcatgtaatctgaagatgcctctgtattgtggtggcttgtttctgctgagattccgaccacatcattgtgacggctgattactacgttttgagtactgtatcgtcaccatggttgcaacttccatgtgaccacgtcacgataaaattatatctgggtgcagggattacattattgttttgcattttt

SEQ ID NO: 38442 - DNA, 611 bp, Zea mays
  unsure at all n locations
  Clone ID: LIB3060-058-P1-K6-C8
cgaagggttctgcgtgccctatattcttgtttttttcagtgaatacaagtgggcagtttgttggtgttgctgaaatgacaggggctgtcgattttgagaaaaccctggggtattggcaacaggacaagtggaatggttccttctctgttaagtggcacattgtcaaggacgtgcctaacaacattctcaaacacatcatcctagagaacaacgagaacaagcctgtcacgaacagccgtgacactcaagagatacacctagaacaaggccttcagatgctcaagatatttagggagcatgtcagcaagacgtccatcttggatgacttcgccttctttgagagtcgccagaagctgatgcaggataagaggtcgaaacagcagcaggtccaaaagcaggtctgggacagtaggacccccatttctgtcactggaagcgagcaacagcaggaagctgctaatgggaagcccaatccgtctgtaccaacggtgtccctgcagaggtgaaggcggcgaaggcttctgcagagaacggcaccgncactccagctatttcctacgcggcaaaggtggcccaagcagcaacagagaaacctgtgctcgccaacggag

SEQ ID NO: 38443 - DNA, 548 bp, Zea mays
  unsure at all n locations
  Clone ID: LIB3060-058-P1-K6-C9
cttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggnggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactg

SEQ ID NO: 38444 - DNA, 351 bp, Zea mays
  unsure at all n locations
  Clone ID: LIB3060-058-P1-K6-D1
gccggcacggaggacggcagcaaggagccgcaggccacccccnccgccggcnncggcgcggccancagcaggcnccacccgaccaagnacgccggcangcccgccgagaagaggcgagaagacggcgccaccggggggcncgncaacaccggcggggcgggaggcagggacggcgngggcaagaggaacagagcacccgacaccagaaagaccagcgacgccacccacnccggcgagcgccgcaccgccaaccaccagaagaccgaggcggggggccaggaganccncacggagaacaacggcgcgccgccggaaanacncgacccgaacaacaccnggacggacaaggcc

SEQ ID NO: 38445 - DNA, 619 bp, Zea mays
  unsure at all n locations
  Clone ID: LIB3060-058-P1-K6-D10
aagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacnggcccctcggacgtgctcgccgtggagctcctgcagcgcgagtgcngcgtgcgccagccgctgcccgtggtgccgctgttcgagaggctgg

SEQ ID NO: 38446 - DNA, 546 bp, Zea mays
  Clone ID: LIB3060-058-P1-K6-D11
tcccgggtcgaccacgcgtccggttctgactagccacatccagtcaagcagtaaaggcgcaccatggaggcggcggcggagaataaggaggccgagcaggaggagcagcagctaccgcacgcgcagaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtgggagtaggcgaccagcttgagtatagcgatgatgtc

SEQ ID NO: 38447 - DNA, 345 bp, Zea mays
  Clone ID: LIB3060-058-P1-K6-D12
cctgcgtcttcgggccgaccttcccgggtcgaccccgcgtccggtcaccggaatggaggtcgccgagattgacggcgcccccaggatgggcccgacgtttggcgccatgatgatctccggccagaaggcggcgcacctggcgctcaaggccctgggcaggcccaacgccgtggacgggaccatgtcgccgccgttgcgcgaggagttgatgattgcgtacaaggacgacgaggtcgtggacgcctgagtgcggcaagcagagaggaggatcgacgccagcagcgtcttatcttaattgccttgttgttcaatgatgaatcgatcgaattcccttgggttagcttt

SEQ ID NO: 38448 - DNA, 512 bp, Zea mays
  Clone ID: LIB3060-058-P1-K6-D2
tccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagacatggagagagatgtgtagagaga

SEQ ID NO: 38449 - DNA, 501 bp, Zea mays
  Clone ID: LIB3060-058-P1-K6-D3
acgatgagcttcgtgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgcttgccc

SEQ ID NO: 38450 - DNA, 287 bp, Zea mays
  Clone ID: LIB3060-058-P1-K6-D4
aaaaaaaaaataaaaacggggcattcatttttttcctttgggggggggcaaaaatttcccctggttcccaaggaaggaaattggaacccaaaaggcaaaaggggtggtgatgcagaattaaaaacaaacaaaaggggagagggagggaaaacgggttaaaaacccccaaatcccgggggaaaaaaaaaaaaaatggggccaggcgaatgaggccttggtttgaacgggcaaagggttaaaaccttgcccctgttgggggccaaaatttttctgaaggggcctttaaa

SEQ ID NO: 38451 - DNA, 381 bp, Zea mays
  unsure at all n locations
  Clone ID: LIB3060-058-P1-K6-D6
cgcgaggcntnnatgccnctgcccgnnnacccgggggcggggggaccaccggcgnnccggcgcggggggncaccanganncagncagcaccgcngaggcngcnggcngaccccgangagngcgnggccgnacaacnggcgnaancanggcccnncggggccanggggagncngcggaggaggggaggacgaaagaagaacggacggcccgccnccgcccgcggggggaacaacngaaccggganggcagcccgacggggacgaaagaagaacgggcgcnccgcgggggagagccgaaagaggagcnggangacacgaggccnaagcnnggcacgggccgncgnnnnacaacgncgngaccgggaaaacccnggcgnnaccc

SEQ ID NO: 38452 - DNA, 391 bp, Zea mays; identical to SEQ ID NO: 38433
  Clone ID: LIB3060-058-P1-K6-D7

SEQ ID NO: 38453 - DNA, 566 bp, Zea mays
  unsure at all n locations
  Clone ID: LIB3060-058-P1-K6-D8
ccacccaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctacggcgcctttcctcgccggcgtctccgcggccaacccgtccatctccttccaccgcctgcccaaagtcgagcgcctcccgcccgtcaagaccaagcaccaggaggcgctcaccttcgaggtcacccgcgtctccaacccgcacctccgcgagttcctggccgccgcgtccccagccgtgctcgtcgtcgacttcttctgcagcatcgccctggacgtggcggaggagctccgcgtgcccgcctacttcttcttcacctcgggcgccgaggtcctggccttcttcctgcacctcccggcgatccacgagcggaccgccgcgagcttncaggacatggggaaggagctc

SEQ ID NO: 38454 - DNA, 221 bp, Zea mays
  Clone ID: LIB3060-058-P1-K6-D9
cccgggtcgaccacgcgtccgacctctaccccgcgccccctccgagatcggaatcgcggcgccccgccgccctcctccgcatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgact

SEQ ID NO: 38455 - DNA, 587 bp, Zea mays
  unsure at all n locations
  Clone ID: LIB3060-058-P1-K6-E1
gccacacttgctgctgttgttggtagccaagctgttatttcagcaacattctccattgtgaaacaatgccatgctttgggatgtttcccgcgagtgaaggttgtccacacatcgaggtggatctatgggcagatatatattccagaaataaattggattcttatggttctttgcgtcgctgtcactattgcatttcgtgatactactcttattggcaatgcctacggtattgcatgcatgactgttatgcttgttactacattcttgatggcattaatagtcatctttgtttggcaaaggaacataatattttccctagttttcctggttttctttggatccattgaagctgtatatctttcgtcatctctcatgaaggttcctcagggaggatgggtgcctcttgtgcttgcattcatattcatgtcagtcatgtacatctggcactatgggtcaaggaggaagtaccagtttgacctacagaacaaagtatcaatgagatccatcctatctctcggtccaagccttggcatagntcgngttcctggtgttggattgatttacacagagctggtcactggtgtacc

SEQ ID NO: 38456 - DNA, 535 bp, Zea mays
  Clone ID: LIB3060-058-P1-K6-E10
cactgttcatgcttaccctggagcttaattgtttgggtcagctctctctgtgagcatgcttagtttgggccagcaagtaattaagctgacgcatgtgggtggtaatttgtgacttgcaatacgctgaggtctctgcagctgctcgcccacctcgtcgctgtcgccctgtccattttcttcttgttaatagcggctggagtgttgctgttggtggatgctcttccttccctggccctgctggtagttgatttgagtagcagtggcagtgtcaacagtttcctttgagaggtaggtgctgtgcattattgctcgtctggcatggtatgctgatacatatatcagccagtcaatcacacaccaccacacatcatagccaaacaaaaagatatgggcacaccaagcagcaggcagctgctgctcgtcgcagccgtgtgcctcgtcgtcgtcgccgtggacacggcggcggcggcggcagcggcagcggcagcagcgatgcgcggccggcgtcgcgtgcacctgcgggtgtacatgcacg

SEQ ID NO: 38457 - DNA, 665 bp, Zea mays
  Clone ID: LIB3060-058-P1-K6-E11
cctgcagttccgggccggacttcccgggtcgacccagcgtccgggccacagcccgcagcgcagggggtagcgaggagtgcgagaggaggcgagtgggtccaaacaccagagggaggggagggcaggcgaatgagcgaggaggcggcgcgggcgggagtggaggagtccatcgggcagcggcggcggcgggatgggcgcggggaggcggcggcggcggggcgggtgtgggagttcgagcgggatctggtggccggcgcgctgatggggggcgccgtgcacaccgtggtggcgccgatcgagcgcgtcaagctgctgctgcagacccaggacggcaacgccgcgctgctgggcagggcgcgcaagttccggggcttcgccgactgcgtcgcgcgcaccgttcgggacgaggggggtgctctcgctctggcgcggcaacggcaccgccgtcatccgttactacccctccgtcgccctcaacttctcgctcaaggatctgtacaggagcatactgaaagatgctggaacctcatcagacaataagttcacttctattgctcttagcaacttctttgctggtgctgctgccggatgtacaaccctggtcctcatctatccgctcgacattgctcacactcgtcttgcagctgatatcgggcgtacagaca

SEQ ID NO: 38458 - DNA, 223 bp, Zea mays
  unsure at all n locations
  Clone ID: LIB3060-058-P1-K6-E12
gtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattattgccggacagagcacnatgttctttg

SEQ ID NO: 38459 - DNA, 566 bp, Zea mays
  unsure at all n locations
  Clone ID: LIB3060-058-P1-K6-E2
ctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgncgcctncaggactggtacaacccgggctccatgggcaagcagtac

SEQ ID NO: 38460 - DNA, 201 bp, Zea mays
  Clone ID: LIB3060-058-P1-K6-E3
ctcgcagatgtcgtacctggggtcggaaaggtcgcatataggcttgcgtggcgccgtagctgtgtggcaataatggttcactcatcctcatcaggtaatgaacgaattagctagcagatcggaaatgaaaatttgttgctggaagcaacacgaacctgcaggctccatgatggtatcgttctttttgctgccttgatcgat

SEQ ID NO: 38461 - DNA, 568 bp, Zea mays
  Clone ID: LIB3060-058-P1-K6-E4
cggacgcgtgggcagccaccacacagcaggtcacgtaaatctgcttctcacgtctcttgctcccttgttcttatctcaagccatcgtaatatcccagattcctatacacgtgctacctctggaattctctctgaattctatcactgcacgtcatcggccatgcagatcaagtccatggtaaattttagtgctcgcctccctgtacatcaatgcaccccgcgtaaacgttcagctcgccggtccagcctttggtgctaaccccggccgccgcagcgtcctctactgacgtgccgcacgtctgctccaggccgcaggtttcttcctcgcccagatcatgccgtcgtcactgctcctcgacgctccctgctcggcctccggcggctgtccctcgccacatggcgcagcttgcctccctccccaacaccgggcatgccctctgctcttcatcaccatgcagcaagcccagctttcaaccctagcgccggtagcttaccctccttgttctagtcctcagttcatctctcgccgtctcctagtcgcggagacatcattgctcgaccctgcctca

SEQ ID NO: 38462 - DNA, 127 bp, Zea mays
  unsure at all n locations
  Clone ID: LIB3060-058-P1-K6-E5
aagagatgtacaacgagtggccattcttcagggtcaccctggacctgctggagatggttttcgccaagggagaccccggcnattgccggcttgtattgacgaggctgcnnttgtggcggaagaactc

SEQ ID NO: 38463 - DNA, 192 bp, Zea mays
  Clone ID: LIB3060-058-P1-K6-E6
gctccttcactatatggaatcttcccttactctggtcttaaattctacttctacgagaagatgaagagccacgttcctgaagagcacagaaaaggtatcatagcaaagctcggttgcggatcagttgcaggtttgctaggtcagacaataacataccccctagatgttgttaggcgacaaatgcaggttcaa

SEQ ID NO: 38464 - DNA, 408 bp, Zea mays
  Clone ID: LIB3060-058-P1-K6-E7
ctcgcagatgtcgtacctggggtcggaaaggtcgcatataggcttgcgtggcgccgtagctgtgtggcaataatggttcactcatcctcatcaggtaatgaacgaattagctagcagatcggaaatgaaaatttgttgctggaagcaacacgaacctgcaggctccatgatggtatcgttctttttgctgccttgatcgatttcttgccggataagctcttcctccatcctatcacttgcatcgttcgctgctggttggcctgtctgctcttcattttgcccattattcttgacatctaattaacagtttgtcatttagtaaattgtagtaaaaaagatatgctactagtaaataaaggccgtttaatttgacacaactacagatccatgatcagaaattgctttgag

SEQ ID NO: 38465 - DNA, 530 bp, Zea mays
  Clone ID: LIB3060-058-P1-K6-E8
gttgatcgaggtgagtgaggttgaaaagcacaccatcgtcatggacggcggatactacggcggtcgcgatcagcgctacagcggcgggtactacggcggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggactttttggacgagtcggtgctgtggacggagagccgcgacgtcggcaacgggtttcgctgcgtccgcatggtcaacaaca

SEQ ID NO: 38466 - DNA, 573 bp, Zea mays
  Clone ID: LIB3060-058-P1-K6-F1
ggagagtggagtcattttctcagtataccaatgggaggcagtatgccattggaaccgagggcgcttacttgaccaaaataaggtccggctgtcccatgtccttcctcccctctgagttctccaagtacctctgttaggttggtgcacaagttgtgtactcgaaatatgcaggcacagaattgaaattcaatgacgccgaccatctcattttgaaataagatgacataattggtattcttgacagtgatgatgtgaaggatatgaaaccaccgaatgatcgcattctgattaaggttgctgctggtggtttgctattgacgcaggcaactaaggagaaaccttctgttggatcagaagacttcatcggacttgttaattatgtttatgtcttcctggccaaccattttgctttcttgtaaatatcagatggttccacaagaaaggcttttgtcgtgttggtcaggaaaactgggtgagctatttactaagttgtggcctaggaaagatcttatgttcttactaatatgatgtacgaacgctggataagttgtgtaagttggtggtgtgctcagt

SEQ ID NO: 38467 - DNA, 522 bp, Zea mays
  Clone ID: LIB3060-058-P1-K6-F11
cttgcctcgccgcctctggttgttgcctatgctcttgccggcactgttgacattggttttgaggaagagcccattggagttggaaagggtggcaaggaaattttcttgagggacatatggccttcaaaccaagagatcgatgaggttgtggagtccagcgtgcagactcacttgttcaagaaagtgtacgactccatcatggaacgtaaccctaggtggaaccagctgccggttccaaaggaggcactgtacccatgggacgacaggtccacctacatccgcaagcccacttacctggagggcatgtccatgacgccgcctggcccgcccacggtgacggaggcctactgcctgctcaaccttggagacagcatcaccacggaccacatctcctactcggggaagatccccgagggcacacctgcggccaagtatctgctcgagtatggtgtggagcccaagaacttcagctcctatggtggccgccgcgggaacaatgaggtggtgatgaggggagcgttt

SEQ ID NO: 38468 - DNA, 640 bp, Zea mays
  Clone ID: LIB3060-058-P1-K6-F12
cagcaattccaccgcatgcgttcttcccccctaccgttgctgcaaatccacaggcccatccatacatgtggggggctcagcccatagtgccaccttacgggacaccgccgccaccaccttatgtgatgtatccacctggaacagtatatgcccatccctctacacctcctgccatgcatccatttggccattatcctatgccaacaaatgggcatgttgaaactcatggagctgcgccaagcgctccggaaatgaatgggaaaagcgagcctggccgaacgtctgctccatccgccaacgggattacctcgcacagtgagagtggaagcgagagtgagagcgaaggaagtgacgacaattctcaaaacgattcacactcaaaggacaatgatgggaaggaagatggcaattctcagaacggcatgtcttattcaggatcgcaaggagtggtaaaccaaaccatggcgatgcttccaatgcaaccgggtgcaatggtcggaggagttcctagctccacggcagctaacctgaatatcggagtggactactgggcagctccgggttctgcggctgtccccgcagcgcacggcaaagcgccagctggttcagctcgaggagaccaatgggatgaaagggagct

SEQ ID NO: 38469 - DNA, 541 bp, Zea mays
  Clone ID: LIB3060-058-P1-K6-F2
cactgttcatgcttaccctggagcttaattgtttgggtcagctctctctgtgagcatgcttagtttgggccagcaagtaattaagctgacgcatgtgggtggtaatttgtgacttgcaatacgctgaggtctctgcagctgctcgcccacctcgtcgctgtcgccctgtccattttcttcttgttaatagcggctggagtgttgctgttggtggatgctcttccttccctggccctgctggtagttgatttgagtagcagtggcagtgtcaacagtttcctttgagaggtaggtgctgtgcattattgctcgtctggcatggtatgctgatacatatatcagccagtcaatcacacaccaccacacatcatagccaaacaaaaagatatgggcacaccaagcagcaggcagctgctgctcgtcgcagccgtgtgcctcgtcgtcgtcgccgtggacacggcggcggcggcggcagcggcagcggcagcagcgatgcgcggccggcgtcgcgtgcacctgccggtgtacatgcacgacgtga

SEQ ID NO: 38470 - DNA, 402 bp, Zea mays
  unsure at all n locations
  Clone ID: LIB3060-058-P1-K6-F3
ccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggngggccaca

SEQ ID NO: 38471 - DNA, 490 bp, Zea mays
  unsure at all n locations
  Clone ID: LIB3060-058-P1-K6-F5
ctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcaccttcngcacgctccggg

SEQ ID NO: 38472 - DNA, 466 bp, Zea mays
  unsure at all n locations
  Clone ID: LIB3060-058-P1-K6-F6
cgaatgccagttgggtgagctttttgctagtagctgatctgcgggtggatcggataaatggccttggcagttgtgatcagttcggccggcgtcctatgcattggcatcgcaaaatcaccagcggaagcaaggtgtgcgtgcacatgcgcgcctcttctttccagcaggattttgtgtagcgagggctgatgtggccaggttcgtgatgagccacgagacaaaatactcgtggctagtcagctcgttcgacttgttttagttttgtcacaagttaagctagcatcttagctcgatttgttacaagccagctcgagctaagcttgttagctcgaatgatctagcatttgtaaggataaactaataagtgataaactgtattaattaggtgttgtatttatggtggatatgaaattacaagtactattactctnaaanaaanaaaaaaaaaaanaanaannaaanaaan

SEQ ID NO: 38473 - DNA, 515 bp, Zea mays
  Clone ID: LIB3060-058-P1-K6-F7
ccacgttgtcgacctggctgacggccacatagcagccctgaggaagctctacgaagactccgacaaaataggctgtgaagtgtacaacttggggactggaaaggggacgtccgtgttggaaatggtggctgcattcgagaaggcttctgggaagaaaatccctctggtgttcgctgggcgaagacccggagacgcagagatcgtctacgccgcaactgccaaggcagagaaggagctcaaatggaaggccaagtacgggatcgaggagatgtgcagagatctgtggaactgggcgagcaagaacccgtacgggtacgctgggtcacgcgacaacagcaaatgaaccacccatccatgcatcccatcctgcagtaggagcaagcagcagccttatagcctatatgctaccataattagtaactcatcaatcatgcatacataatcagtcagtcatctgattaggaggtactgcgatgggcctcgcttcttcagtgtatagagggaggaggaagggg

SEQ ID NO: 38474 - DNA, 536 bp, Zea mays
  Clone ID: LIB3060-058-P1-K6-F8
tgaattcttatactttctaaagcttacatctgaaaattctaatttcaacgattcacaacttaatattgagactacttggagtgttccaaccagcaatgctgatgatcttgaactgcattttgggaagttcgagcttggcgagcctgtatcttttgattccctagtggacagtggttccagtgatggtttcaagctgactcggtcttctttaggctggatggagaatgcaatgtcagatgtgacaaaaaggttatctgtgctcttatcagcaactagcctaaggttatttaacagaataaagttcccctttcctggacatgttattgtatatggacctcgaggttctggcaaaactgctttgaccagggcttctgcaaaatactttgaggaccataaagatatcttggcgcacataatatacattgattgttccaaacttgcacttggcaaggctaaggagacaaggcaagaaattgaagacagcatgtctgaagcactgcttcattcaccttcgatcatcatatttgatgatctgg

SEQ ID NO: 38475 - DNA, 566 bp, Zea mays
  Clone ID: LIB3060-058-P1-K6-F9
cggacgcgtgggtgcgaggtccactgctctgcgctcctattccacctgtctcatcccctcatcatgctcgacacttgctccctggcagcatgtcgtagcagcatctgtgcttactgtgccgtgctgtttctctgcacgcgtcaagctctcgcgctgaatccagccccatgttgacgcgttcatgttccagcttgtcgtgccgcgtcgtcatcactttctgtcgcgagctcgattcccgttgtcatcgggctttgtgcgtgctcgcgtttgccgtcgagtcgttgaacccgtcatcctttgctcaaccctaccccgccagctcgctccagatacaatcttgttatcgtcccgcgcgtcatcaagaatcccaagaatcgggtgaaaacgaagctagcagcgcgatattccccaagcgctcgacaattgcctggatcggaaaatcactaccgatctcgcggattcgagtcggctattgaaacggtacgttaattaatcgcgtgatgcggaagatgagccaagtcgaccccaagcgtgggcttcttcgcaaggcgatgctgatggataaa

SEQ ID NO: 38476 - DNA, 597 bp, Zea mays
  Clone ID: LIB3060-058-P1-K6-G11
cccgggtcgacccacgccgtccgatcagtacatatactcaggtagcgcaacctggcctggcccggcccggcccagagaggagcgcgcccatatcgcttccctgagggctgaggccgagagcgaagcggagcgagcaccggacgagaggcatggccatggcgcgggcggagctccgcaccgtgaccgtgcgctcttccccgcttccgcgctgcgtcctctcccggctgctgccgttgctcctctcagtctcagccatcggcgctgcgtcggcggcgccactcaagttcgggatcaactacgggcagattgcgaacaacctcccgcagccgacgcaggtgtcgggcctcctgcagtcgctgaacgtgaaccgcgtcaagctctacgacgccgaccccatcgtgctgacggccttcgccggcacgggcgtcgagttcatcatcggcaacgatgacctctacaacctgaccgacgcacgcaaggcccgggcctgggtggcgcagcacgtccagccggtcctccccagcacgcgcatcacctgcatcaccgtgggcaacgaggtgctcttcggcaggacacgaccgccatgcagagcctcct

SEQ ID NO: 38477 - DNA, 567 bp, Zea mays
  Clone ID: LIB3060-058-P1-K6-G12
ggtgaagcttgtcgggcctgaaggtgaagagcacgagtttgatgctccagacgacgcctacatccttgacgcagccgagactgccggtgtggagttgccatactcgtgccgtgctggggcttgctccacctgtgccggcaaaatcgagtctggttcggttgaccagtcggatgggtccttccttgatgacgggcagcaggaggaaggttatgtgctgacatgcgtctcctacccaaagtccgactgcgtcatccacacccacaaggaaggcgacctgtactagggctagggattttcaatttggcgagggaccaaaaatgctctcgagtggtgctttgtcaagcaaagctccatctgcgcgccctaccccgttgtgcgaactgtttggcatcaaacttgtgtggttgctgtcttctatgttctgctagtttatgttcggagtccgtgggaatatactagctgattaataaaaagaaaaaactgatgtgatgccataatagtataatttcatggctttttgttatgttgggagaagtgattgtgtaagctattgattctgaatgccac

SEQ ID NO: 38478 - DNA, 512 bp, Zea mays
  Clone ID: LIB3060-058-P1-K6-G3
cccgggcgacatcgctaacttctcggagctccggctcactgcgcactccggcacccacgtcgacgcgccgggacacgtcttcgagcactactacgacaccggcttcgacgtcgacaccctcgacctcgctgtcctcaacggaccagcgctgttggttgacgttcccagagataagaacatcacagctgatgttatggcatccctaaacattcctaaaggtgttcgacgtgtactctttcggaccctaaatacagacaggtatgttttaggctgtctccagcagcgtcccctaaatttcgtcccctaaaggaatattctctgtcctttacagaacactctaaaagattctgtcctctatatattctccgtctccagcagcgtcctctaaattccgtcccctaaagctacagtgttaacagattcacattttccatttctttttcatttttctttggtttcttctcatttgacgctacataaatgatacgtaaaaattgtatttattaattttg

SEQ ID NO: 38479 - DNA, 485 bp, Zea mays
  unsure at all n locations
  Clone ID: LIB3060-058-P1-K6-G5
tcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtagaaagcaactcttgctattgctagctaggcgcgaggccggnttaggatcgaggagggcgccaccaanatgcattggagctaacgaacagcgaggggccgatcatggcagctctgccactacatcttc

SEQ ID NO: 38480 - DNA, 511 bp, Zea mays
  Clone ID: LIB3060-058-P1-K6-G7
ctacgccatggccaccaaagcaggctcctcactgtcgccatgcatcaggctcgtggaggaatccctgctcctcccgacgcaagacgccggcctcttcgcaaaggccttcgtgctcatcttcgcccacaccttcctcttcatcgcggtcgccgtccacttcgctcacccactcgccacggacatcctcgccgacatcaaagcacaaaggagcagcagcaggaccactaccactaccggcgccgcgagctcaaaccactccaaggagcttgcgttgctagcgatctacctctgctacctcgcgagcaaactcgccacccagctcgtcaccgccctcgccaccgccacgacctactccggcgagcgcctcacgcgtaaggtggtcatggagaggatcgccggaggcggcggccttctcggcacggctgccgtcgccggcgtgctggagctgtcgttcacggctctactcgcggcgctactcgtatccacgtggacctacgctgacgactcgatc

SEQ ID NO: 38481 - DNA, 510 bp, Zea mays
  Clone ID: LIB3060-058-P1-K6-G8
agatggcctctctgttccggcatcacttaggctgacgcttttgcgtattctggtttctatacacgaggagcatattttttgctgataatctgatgtcaaaggcaagatcatgaaattaagatggccacaatgttctatttctgaagtttattgttggacaccgttcggttggttgatgcagtatagcagtcggtgcagtgatgtagttggtaggtcgacgcagttcagatacaatgcagtaagaggaagaagttgagcggccatgtcactgacatgacgacggttattttgcaggagcatattttgtatctgtaccagcaccatttgggcgcttcatgatctgctggcatctactgcaacatgcagacacagtgaaagaatggattaatcaggcaacttaacagcgaccctcttaccagaggggcgcgaccctactggaaagggttgcctctgcacaaatggtcaaccagtcaacaagagaggtatcgcagcggacgaagccgacgatga

SEQ ID NO: 38482 - DNA, 641 bp, Zea mays
  unsure at all n locations
  Clone ID: LIB3060-058-P1-K6-G9
gctgccgatcacgtctggcacaacataatggaaggagaaggaaagttcaaccgcaacctgctgtgaacgggaattccatgaatgaagatcagtctctaagtagcaccttattccttctgttaaaacaactttccgggctcgagtctggtagctcttctgagcaaatcaaccatcctaattctttggttaaccttttgaagaaccttgctgctattgctagcacacatgcatatcaagatgttctaaagaatgcaacttcaatatcatcaaatgatggtaataatgctgcaaatggctctataatgcatgagcaaaccatacggtcaattcctgtcaggagagaatcattagcagaagagcctgcggtgaaaagacgagtacaggactttgatttgaacgattcatgcattgaagaagccgagagccgaacagataaaattgtgttcaaactctttggaaaagagccaaaagattttcctgtagatctacgggaacagatcctaaactgggttgtcgcattatccaactgatatggaaagttatattagaccttggntgggttattctaactatttaccttcaactncctaattggatgtgggatgagtttaatgatgacccagcttcatggatagaaaatc

SEQ ID NO: 38483 - DNA, 518 bp, Zea mays
  unsure at all n locations
  Clone ID: LIB3060-058-P1-K6-H10
ggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgttgcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctnctctgccagcgcttcggcttccccggcgagtgcatcatcatgctcactgacgaccagagggacccgttcaggctgcccacgaaggagaacatccggatggcgatgcactggctggtgcatggctgcagctacggcgactccctggtgttccacttttcgtgcattagcgcgcaggtggcggactac

SEQ ID NO: 38484 - DNA, 647 bp, Zea mays
  Clone ID: LIB3060-058-P1-K6-H11
gacttgtagaaggagcatgcccaacagaagggtgtactaataaagctgcgcgaggtgatcaatgtgacaattgcagccacatgttgaatccaactgaactaattgatccaaagtgtaaggtctgtaagaatactcctcatattcgtgaaacggatcacttgttcttggatctccctcgaatagaagacaagttggtaaactacattaatgatacttcagtagctggtatgtggagtcaaaatgccattcaagctacaaatgcatggttaaaggaaggactaaaatcacgctgtatcacaagagatcttaaatggggagttcctgttccaattgagaagtataaagataaggttttctatgtctggttcgatgcaccgattggctacgtgtccatcacatcatcttatacacctgagtgggagaggtggtggaagaatcctgataatgtggaattatttcagttcatgggcaaagataatgtgccatttcatacgatcatgtttccttcaacactactaggaactggtgaaaattggacaatgatgaagaccatttgtgtcaccgaatatctaaattacgaaggaggaaaattctccaagagtaagggtatcggagttttcggtaatgatgccaaggataccaatatt

SEQ ID NO: 38485 - DNA, 651 bp, Zea mays
  unsure at all n locations
  Clone ID: LIB3060-058-P1-K6-H12
ggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgccccagccgggatccaaattaaagaacttcttcttctattaattacagtatattgtaatttggctgctggtacggtggtggcatgatttgagatgtgcatgatgatccttgtgtaatnttattaccaagtctcttcttatatttacatgttcatttgcttgcttcttgcataacata

SEQ ID NO: 38486 - DNA, 518 bp, Zea mays
  unsure at all n locations
  Clone ID: LIB3060-058-P1-K6-H2
acggcggcgagggagtgagtgacggcagcgaggcaagatggcgaggaggaggccgatggactacgaggagctgaacgagaaagtcaagaaggcgcagtacgcggtgcgcggggagctgtacctccgcgcctccgagctccagaaggagggcaagaagatcatcttcaccaacgtcggcaacccgcacgccctcggccagaagccgctcaccttcccgcgccaggtggtggcgctgtgccaggctccgttcctcctcgatgaccccaatgtcggcctcatgttcccgcccgatgccatcgtgcgggccaagcgctatctcgccatggcgccgggaggtctaggtgcgtacagtgatgcccgtggtatccccggaatcaggaaggaagttgctgacttcatccacaagcgtgatggatatccgagtgatccagaactcatttacctcacagacggcgccagcaaaggtgtgatgcanatgctgaatgccatcattagaaacgagagggattgggatcttg

SEQ ID NO: 38487 - DNA, 613 bp, Zea mays
  Clone ID: LIB3060-058-P1-K6-H3
cctgcggttccgggccgaacttcccgggtgcaataaatgtcgtgtgctcagcaccagaagttgcagatagggtaaatagccagctgaaacgattggcacgtcccatgtactcgaacccccctattcacggtgccaagatagttgccaacgttgttggtgatccaaccatgtttggtgaatggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaggctgaggtacgatagttgagggtcaagctattgatgtttagttccgtggacgctaggctgggatttttgggtccttccagctatacagctcttccgttgtgctccatcttgtgtaacttggataaataaaatttttgtcgctgaac

SEQ ID NO: 38488 - DNA, 560 bp, Zea mays
  unsure at all n locations
  Clone ID: LIB3060-058-P1-K6-H4
gggccaaccttcccgggtcgaccacgcgtccggtcagtgcagtgcgcgtgtggtcgggtagcgatccgaggagcgcgcagcgatggcggcggcggccgtggcgactgtggcctccccatccctcacctccaggcggctgttcccctccgccggcccgtctcttctccggctcccaaggtcgaccgcgcggctcaggcgcgccctgcggttcgccgctgcgggggatgaagcggacgtgctgcctggcccgggggccgagggggaggccgtggtgcccgggaggctggaggagcagcgggacgagcagctgggcggaagccagctcgacatcggagggctcgccttccagggcgacgtgggcgggggcttcaccggcggcggtgcgggctccggggcctccggcggtggcggcggcaacaagatgctggaccggggcatcaacacggccatcgtgctcggggccagcacctacgctctcaccaagctgctcaccgtcgaccaggactactggcatgggtggacgatcttngagatcctgcgctatatgccggagcacaact

SEQ ID NO: 38489 - DNA, 521 bp, Zea mays
  Clone ID: LIB3060-058-P1-K6-H5
gggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctaacaaggcaggcaagttcccgaccctggttactcaccaggaatccctcgagtccaaggtgaacgagactaaagcaaccgtcaagttccagctcaagaag

SEQ ID NO: 38490 - DNA, 364 bp, Zea mays
  Clone ID: LIB3060-058-P1-K6-H6
aaatcccgagtccatgatcgttgaagctgaaccgtgaagtagttatactgcttatgcttttctttcttatagtaatatgctccgtctcaaaataagtcaatttctagaatcacttaaagtcaaattatcttaagtttgaccaattttataggaaaggcaccatcgtctatgtctctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacagttcttgtca

SEQ ID NO: 38491 - DNA, 639 bp, Zea mays
  Clone ID: LIB3060-058-P1-K6-H8
cttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaaagttcattcccgtctatcttgctcagggcattct

SEQ ID NO: 38492 - DNA, 629 bp, Zea mays
  unsure at all n locations
  Clone ID: LIB3060-058-P1-K6-H9
cgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactntgacctcgtgggtaacaacatgcctgtgtttttcatacgagatgggatgaaattccctgacatggtccacgctttcaagccaatccaaagaccaatttgcaggagaact

SEQ ID NO: 38493 - DNA, 572 bp, Zea mays
  Clone ID: LIB3060-057-P1-K6-A1
ccacgctgtccgtgaattcttatactttctaaagcttacagtctgaaaattctaatttcaacgattcacaacttaatattgagacttacttggagtgttccaaccagcaatgctgatgatcttgaactgcattttgggaagttcgagcttggcgagcctgtatcttttgattccctagtggacagtggttccagtgatggtttcaagctgactcggtcttctttaggctggatggagaatgcaatgtcagatgtgacaaaaaggttatctgtgctcttatcagcaactagcctaaggttatttaacagaataaagttcccctttcctggacatgttattgtatatggacctcgaggttctggcaaaactgctttgaccagggcttctgcaaaatactttgaggaccataaagatatcttggcgcacataatatacattgattgttccaaacttgcacttggcaaggctaaggagacaaggcaagaaattgaagacagcatgtctgaagcactgcttcattcaccttcgatcatcaaatttgatgatctggacagtgtaatttcagtctcctc

SEQ ID NO: 38494 - DNA, 584 bp, Zea mays
  Clone ID: LIB3060-057-P1-K6-A10
gggtgactcgggctgatccttctgtatggccagaggttgaagggcccttagaggttgttctgttcgaaggatggatgcttggatttaaacctcttccaaatgaagttgtgaaagaagtggatccacagctggaggtggttaacaagaaccttgaagcatactctgatgcttgggacaggttcatccagtcatggattgttattaaaataagagaacccggtagcgtttaccagtggagactgcaggcagaggtcgctatgagagcagatggaaagcctggaatgtctgatgaggaggttatggattttgtatcacgctacctaccggcataccatgcatatctgccaacactgtacaaagaggggccgaatggttcgaatccagatcatctgctggtcatcgacatagacgaaaataggaaccctatctgtggtggatcatgggacatctcatgtttgtgaaactacttttatgatgggccgtcaaacaccactggcctcttgttgccctacactctggtagtgtaaatctgtgaattccatgtaaatatgaatttcgcttcttaaggcactttttaatctggc

SEQ ID NO: 38495 - DNA, 611 bp, Zea mays
  Clone ID: LIB3060-057-P1-K6-A11
gaaggtggttccctactcaaagatattcctgcgaccaaggatggaagggttgattggtcacaggatttcttctgcaaaccagcatttctgacagtatctggacagctcaatggtgaaacatatgcttcagctctatctgatatttacacatttggtccaacgtttagggctgaaaattcaaacactgcaaggcatctggctgaattttggatgattgaacctgagcttgcctttgcggatctaaatgatgacatggcttgtgcaactgcatatctccagtatgtagtaaagtatattctagagaactgcaaagaggatatggatttcttcaatacatgggttgagaaaggcatcatagatcgattaaatgatgtagtagagaagaactttgttcacttgtcttacactgatgctgtcgagctactacttgggtccaagaagaaatttgagtttccggtaaagtggggtttggatcttcaaagtgagcacgagcgatatatcacagaagttgcctttgatgggcgccctgtaataatcagagattacccaaaggaaatcaaagctttctatatgagagaaaatgatgatgggaagacagttgctgcaatgga

SEQ ID NO: 38496 - DNA, 507 bp, Zea mays
  Clone ID: LIB3060-057-P1-K6-A12
ttttttatggaaactcgaaaaaggattcggcgtcattgcttgcactacactcgctgtgcattagaactgttttatgaatattttacctctcgggggacatttgcattggcacatagaagagcctccactggtttgcaggtgaacgcagtggtggcagagaaatcttcatggcatggaggaggacttggccaggagaaaggggaggagaagaagaagaagaagaagaagctggtttggggacgaccagcaccgaatatcatggcgattgatgaccgcagaaaaagggaaactagacggatttccttggatctcgcacctcgccgatcggtttgctttgcttctggctcgaatgaagcacgattccaatcgtggcatgcaccgcgcacccgacctaatgtgtggcacctcatgtcttgttcccttgaaggagaggggagcgcggacaaccgcgttggatcatcgttagcatttattcttaatccctagatgaactttatgaattgtcca

SEQ ID NO: 38497 - DNA, 612 bp, Zea mays
  Clone ID: LIB3060-057-P1-K6-A2
ggacctcccgggtcgacccagcgtccgcggctgtgctgtctgtcacgtcgagctcggggcctgctcgcagtccttcctctcacgtttagcccagatcgaatcttgctccagctcgtcgtcgcgcccagccgagcccttcttgcatggtcgtccgccgtttccctgtgccgaggtctcatccggccacagccttgctctcctgcgctgagctcccttgctgtggatttttcccaacgcgcttctttgttggccatcgctgctccctgatgctcgaactcactggtcgccggtctctagctctgtttcatgtgcgcgcgcctttggctcaacttggagcttgttcagccgcggtctcatcccggctctttggtgcactggtccggcgtcttgctccctgctgtgctcgccctggtcccgacgcgcgctcacctctgttcctgtcgggtccggccatggagttcgcagcgacgcccactgttctgcctacttgtgctcgccccagcacttgtgcttgccctcggctcgcattggcgctcgcgtgcctgctcatcgtcaccgctgcgcgctcgctcttcggccatcgggtttcgtgcgtgctcgcatttgccatcg

SEQ ID NO: 38498 - DNA, 623 bp, Zea mays
  Clone ID: LIB3060-057-P1-K6-A3
gggtcgacccacgccgtccgggcagaggggcgaaggagactaggtaggctagacatggccgccaaagctcacgtgctggtgctgccgatgccatgccagggccatgtgacgccgctgatggagctctcccacctcctggtcgaccaaggcttcgaggtcaccttcgtcaacaccgacgtggaccgcgcggccgtggtagccgcgctggaggcctccggcggcggcggcggcgtggcggcgctgggcggcggcatccacctggcgtccatcccggacgggctggccgacgacgaggaccgcaaggacatcagcaagctcgtcgacgcctacacgcgccacatgcctggctacctggagcgcctcctcgccgacatggaggccgccgggcggccgagggccaagtggctcgttgccgacaccaacatgggctggtcgttcgaggtcgccaagaagctcggcatccgggtcgtgtccttctggccggcggccaccgcgtgcttagccttcatgctcaagatccccaagctcatacacgacgggctcctcgacgacaaggggttgcccgtccgtcaggagacgttccagctcgccccggggatgccgccgctgcactcgtcgcagct

SEQ ID NO: 38499 - DNA, 512 bp, Zea mays
  Clone ID: LIB3060-057-P1-K6-A4
ccccgggtcgaccacgcgtccggacgtcctcgagtccccctcccctcccctcccccccggccccgccgaagaggagcagcgcagccgcgatggaccgcgtccagctcgtgctcctcggcctccccatcctcctcttctgctccgacgtcgttaccctcttcgcgcctctcccgccgccgggccccgggcccgacaggggccggcacgcttttcagcccggcgccgaatcctcctccgccgccgacgcttccgcacatgtggagccacaggtggacggaactggctccggcaccaccgtcgacttcaagttctgcgcctcctgctcgtacaggggaactgcaatgaccatgaaacggatgctggaaacctcctttcctgggatccatgttgtcttggaaaattatcctccgccgttccccaaacgcgctctcagtaaagctgtaccccttcttcagttcggcgcgatggcaacattaatggccggtgatcagatcttccccaggtttggaatg

SEQ ID NO: 38500 - DNA, 568 bp, Zea mays
  Clone ID: LIB3060-057-P1-K6-A7
ctttgtattagcgcgctcatgttgcgtgttcacaatggcaacgggcaatcagaggaaacgtcgcttgtcagtatttgcttggctttagcctcagcccgacacaacgaatggacgtacgtcttgtgataataattttctggccatttgatcggttaacgacgctgcagtctgcagctgtgtgagtataattatcctttttttataaaaaaattccaacttggttatcaactctatatattgtggattcagctaattagcttgtatccatgcatgcctttatatattgcacatgcatctgctagtgcctgtggtgtgtgaggaactcacgctctcctgatgtcagtctgattttatactttgatctgatgaatatacttgatcatggatattttgtggttactaattgtagactagcctcctaatttcgtactaggtagctagcagcaagtagcagctgcaaaaggatactacagtgccagtttcttggcagtatatatatatatatgaaagatgaaccctagcctagcctagcctggtgtactcgggtctcggggtgcggtgtggctgc

SEQ ID NO: 38501 - DNA, 326 bp, Zea mays
  Clone ID: LIB3060-057-P1-K6-A8
tcccgggaccgcgagcgacctccatacaacggtgtcagcggcctccctacgccaccgtcctcatccgccgccgtcgtccactacaccgccacggtcgtcctcggtcgcgaccgcgcccttcgttctcatccagcgccacggtctagggtttgagcactcctccatcgtctccttgcctcttctccatcatctccttgcctggggtctcctctgtgttctccctctggtcacggtcttgtttgctcttttgtttttcattcaaatcgtcgtgcatccagatctggcgtctatttttgggccaaatgcttatttcttgcagaaaccag

SEQ ID NO: 38502 - DNA, 547 bp, Zea mays
  Clone ID: LIB3060-057-P1-K6-B1
tccggatcgcttatcggcgcccttttttttttttttttttttttatggaaactcgaaaaaggattcggcgtcattgcttgcactacactcgctgtgcattagaactgttttatgaatattttacctctcgggggacatttgcattggcacatagaagagcctccactggtttgcaggtgaacgcagtggtggcagagaaatcttcatggcatggaggaggacttggccaggagaaaggggaggagaagaagaagaagaagaagaagctggtttggggacgaccagcaccgaatatcatggcgattgatgaccgcagaaaaagggaaactagacggatttccttggatctcgcacctcgccgatcggtttgctttgcttctggctcgaatgaagcacgattccaatcgtggcatgcaccgcgcacccgacctaatgtgtggcacctcatgtcttgttcccttgaaggagaggggagcgcggacaaccgcgttggatcatcgttagcatttattcttaatccctagatgaactttatgaattgtacaaa

SEQ ID NO: 38503 - DNA, 182 bp, Zea mays
  unsure at all n locations
  Clone ID: LIB3060-057-P1-K6-B10
ccccggtcgacctcacgcgtccgtacttgctgcttgcagtaggctctatttgtgtatgtctgcngntatacaaaagcaaatcacggggggggnncaangcnnnnggggggcggcagacanacancaaanagagccccggcaagcagcaaggacggacgcgngggncgacccgggaannccgg

SEQ ID NO: 38504 - DNA, 626 bp, Zea mays
  Clone ID: LIB3060-057-P1-K6-B11
actgcggtttctttctttctcttccattcttacgtttccatattaaagtgtagttttttttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacaccagaatttttactagaagtggaagagttacacaaagttcgcgaaatgatcacaagggtttatgcactaagaacaggcaagcctttttgggttgtatccgaagacatggaaaggggtgtttttatgt

SEQ ID NO: 38505 - DNA, 622 bp, Zea mays
  Clone ID: LIB3060-057-P1-K6-B12
ccgaacttctcgaacgccgccttcaccatgggctccgccagccacgacggctccgcgaactcccccatgtactcctcgtcgggcgagtgcgacgagaggatgtccagcgtcgtcatgaccttgatggcctgcatctgcgtgggcagcatgtccagcagcgtcgtctccggctgcttgaggaacttctccatctcctcgcccggcccgccctcctccaccggcatgttcttccggatggtggtcggccggttggggaagtagccggcgaagtggtactgcccgaagttgacggccgagtggtggccggaggtgacccacatgatggtggtcagcgtctccaccaggctgtcgcgggtgtccagcacgggccaccacggctcgtccttcttgtcgccgtgccccacgttgcgcacctcgtcccagaacgccctcagctcggggtcggcggccacggcctcgtcggacttgtagtagacgttgacgtactcggacgcccactgcttgatggagtcccagaccaggagcccgtcgtgggcgtaggggtagtccttgatggtgagctccagctccccgtccttcccgcgcacggccagcccgcgcttgacgaggtcgttgggcagcg

SEQ ID NO: 38506 - DNA, 526 bp, Zea mays
  unsure at all n locations
  Clone ID: LIB3060-057-P1-K6-B2
ccggattcccgggtcgacccacgcctgtccgcaggatgggcggatctccttagctgggctgtccctggctaagtgtgattatcttgccgacgccatcatcgattccttccataatgtgaactaggctgaggtacgatagttgagggtcaagctattgatgtttagttccgtggacgctaggctgggatttttgggtccttccagctatacagctcttccgttgtgctccatctggtgtaacttggataaataaatattttgtcgctgaactaaaactcgtgtgcttttttacctgtaaggtcagcgcgtggctacagacttgtaaacacttgaatgaaaaaaaaaacaatgacattaccggataaaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaaaaaaaaanaaaanaaanngggggcggcccttttaaaggaaccaagcttacttccccgggcttgca

SEQ ID NO: 38507 - DNA, 369 bp, Zea mays
  Clone ID: LIB3060-057-P1-K6-B3
gccgccatcctcaaggtgaaggagatcaagaacggccggctggccatgttctccatgttcgccttcttcatccaggcctacgtcaccggcgaaggccccgtggagaacctcgccaagcacctcagcgaccccttcggcaacaacctgctcaccgtcatctccggcgccgccgagaggacgcctagcctgtaaggacggacgccacgccgccgagcaatgccaagtcatgcgctgctgcatgccgtctttgattttaccgggataaaaagctgtatgtgagggtctgaagaatgtgcaatgcccacgcgtgtaaattatcgagagggggaacaaaccttttcattctgattgtgatatgactgctgcttc

SEQ ID NO: 38508 - DNA, 623 bp, Zea mays
  Clone ID: LIB3060-057-P1-K6-B4
cccgggtcgacctcacgccgtccggcgcagcaccgcacggagagcaagcaagaaagcaaccaccgcacctgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcatcactcactactagtaccttgtttttatatatgtttcctctcctgacgctctccgattttaatcttcatgtatgcaacatatgtgatgaatggaaaaatcgatttgtatttgttagtcagtcagtctgtataacaacgccgtcgggtttctgaaaccaagcaatgtatataaatgcaacaggaattacattctgtattt

SEQ ID NO: 38509 - DNA, 653 bp, Zea mays
  Clone ID: LIB3060-057-P1-K6-B5
ccccgggtcgacccagcgtccggccaattggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcggtaagcatgcatgcattgttagctagcgagctcgcttgcctgctcctcaaggtcggccgaaccgaagttggtggtgacatgtgtgtgtgtctgcgtgcagggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgct

SEQ ID NO: 38510 - DNA, 606 bp, Zea mays
  Clone ID: LIB3060-057-P1-K6-B6
ccacttagatttttccagcgacgctgtcttcttcccctgttgcgcgccgtggagctcccacacgcgtttcttcccctgccgaagccctcccatggcgcccggctctgcttgcccgtggccgtcgttcctaggatcagcctccatctccaggtcgtctctctccctgcgcgctttcccagacgcgcgcctagctcctcgcgcgggtctctggtgctcagcagcccagctccctctgctcgcgacgcacgcccagcctctcccaagaactcgagttcctctgctttttccccaaccgcgcgcggtacttctcctctgctcgctcgtcgccatggcgatggccaccgagctcccttgtcgtggcttcctgcttcctcgtcgcgcgcgtagcgttccgtcgttccctgccgtgaccccgtcgtggtgcttcctcgcgcgcagctcaccccaactcccattcgtagtggtcgccagtcgtcgacctagctcggattccatttcgccaacacctgctcctagtcgacgcttgctcggattcgcgtccctgcgcccagccaagttcacccctgcgtgcagccgggggtttttctgcacaggggtcctgctccc

SEQ ID NO: 38511 - DNA, 643 bp, Zea mays
  unsure at all n locations
  Clone ID: LIB3060-057-P1-K6-B7
ccgggtcgacccagcgtccgagcttctcttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaacttncgcagcatcggcaagaacgtcaaccccatcgaccgcaagttcaccggcaaggccaccttcg

SEQ ID NO: 38512 - DNA, 658 bp, Zea mays
  Clone ID: LIB3060-057-P1-K6-B8
ccgggtcgacccagcgtccggcgccgtggttaaataaacgcacgtcgtcattactcattaggatggagcaggtggattcgaaggaggtgaaggagttcgtggacgcgcaggcggccgtgaccagcgccgtgctgtccagctgcgaccaccgcgggcgcctgcgcgggcagctcaccgcgctcttcgaccacccgcgcttgcgcgcgcccttcaagcgccggggcagctacttctacttccacaacccgggcctccgcccgcacagcgcgctctacgtgcagcacgggctgggcggcgagcccgacgtgctgctggaccccagcacgttcagcgaggacggcacggtgtcgctcggcgtggtcggcgtgagcgacgacggcgagcacctggcctacggcgccagcgccagcggcagcgactgggtcaccatcagggtcatgcgcgtgcgcgacaaggagcacctgcccgatacgctgtcctgggtgaaattctcgcgcatcgcgtggactcgtgacggccaagggttcttctactcgcgttttccggctccaagggatgcgctggattctgggatgaagactgacgtcaatctcaaccacgaagtctactaccatttccttggaacagagcagtcacaggacgtgttgtgctggagaga

SEQ ID NO: 38513 - DNA, 559 bp, Zea mays
  Clone ID: LIB3060-057-P1-K6-B9
gtctgtatgtactgaactgtacaagcttatcgagaaagacactgcgagtctacaacaatccacacccaacacaggcggtggacacaacccatccaataatctttcatgagtacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagcctcctccttctgcgcctcgaggttggcgagcgcctctacgagctcggcctccacacggctgcgcccctcgtccagcttggcctccagctccgcggtggtctccttcttcatcttgttaagcgccgccgcgatctcggcgcgcgccgccttcatgatggccgccgcctggtcctccagctgcttcacctcctcggaggcgcccttgacatcgccgagctcaccgcggatcttggcgtcccgctcatccatgaacttgcctagcggcgtgaagta

SEQ ID NO: 38514 - DNA, 648 bp, Zea mays
  unsure at all n locations
  Clone ID: LIB3060-057-P1-K6-C11
ccgggtcgacccagcgtccgggcggttacggtcacggtgggcacagtgacacgccgcacgcctctccgccccgctccgctccagattgcgcgcacccacccatggcgctcgccgcttcccaccacggcttcctgcccttcgcccccgctgccacgcctaccccgtcacgggggcacctgcgcttccgcgccgcgcgccctctgccccgccccgcccggagaatttgttgccaatctatcaactcagctaatgtgttgggagcttcttcaacgacatctgatgaggcagtcccagtcccagttgtccagatagatcaggactcagaccgtgatgcgaccattgtgcagctaagttttggagatcgtttgggggcgctacttgacacgatgaaagcactcaaggaccttggccttgatgtcacaaaaggaagtgtgacaactgactcagctgtcacacaaacaaagttccacatcatgcgatttgggcgcaaggttgaggaccctgacatgttagaaaggattcggctaaccatcatcaacaaccttctccagtaccatcctgaatcaagtgagaagttagccatgggtgaatnttntgggataaaacctcctgagaagaaggtagatgttgatattgcaacacatatag

SEQ ID NO: 38515 - DNA, 653 bp, Zea mays
  unsure at all n locations
  Clone ID: LIB3060-057-P1-K6-C12
cccgggtcgaccacgcgtccgcttaaagctggcgacaaggttaagataattgtgaacctgaaaggacgggaaaacttgtataaaaaagaagctatcgaactccttagaagattccaaaatgatgttggcgagctggcgacagaagaaagtaagaatttcgcggagaggaatatatatctggttcttgttcccaataagatagctatacagaaagaacaggatgaattgaacaaaaagggtgctgtgagagaagagaaagaccaatcagacagtgatgaaccagaagagaacgaccaaccagacagcgatgtacccctgacagaactgctggaggaaagtatggaacccgaggcagaagtctcagcaaacgtttgatttgaactgtagaggccaaggtgccttgctgagattgaaacaagtaccacgcaggtacagttgctgtagaattgcagctctcgtaaatacaaggcaggctggttcttttgtgcaacaattatatctgttaaactccatctccacaagatatccgataggcgccaaggcgtctgacaagtaaacaaggcttgatgatgtatgtcctccaagtctccaacccctcancatcgaaggataatgatacctgggaactagaaatcaccatcccttgcataaat

SEQ ID NO: 38516 - DNA, 652 bp, Zea mays
  Clone ID: LIB3060-057-P1-K6-C2
cgattcgattccatcatccctctcccggcgccctgccgtcctgcgggagggaggtgcaagcggaaccagcccggcaatggcaggcgcggctgcgcggcggccgggggcgaagcccaggggcggcggtggcgcggggaagaggagcgcgtggttggcggcggacggcagcaagcgctggggggaggccttcttcctgctctacacgcccttctggctcacgctctgcctcggtgtcgtcgtcccattcaagctctacgagaggttcacggagctggagtacctgatccttggcttggtgtccaccgtcccggcgttcgtcatccccctattcctcgtagggaaggcagatagtgttagaaatttcaaagatcgatattgggtcaaggctaatatttggattataatttttagctatgttggtaactacttctggacacattacttcttcacagttcttggcgcgtcatatacttttccatcatggaggatgaataatgtacctcatacgacatttctcctgacccatgcttgtttcctgttctatcatatggcatcaaatatgacacttcgtagattgcgccattctacagctcatttaccacagtctatttgctggttatttgaagctgcatggattttagcactgtcatac

SEQ ID NO: 38517 - DNA, 647 bp, Zea mays
  Clone ID: LIB3060-057-P1-K6-C3
atttctctccagggctgcacactcgtctcctaccgagaccgtcggcggccatcatcgcccacgctgtgctcatgctaagtgtcgaggctcacacgtactactactacccgaccgcgaggccgagacggaagctatgcgcctgcagaaacgtcttgcaagaaaccgccccgcgtgacgcggaggcaaatccctgccgccacggcgagaggaagagcaggagaaggggcgacggtgcttattacatcgacaaggacggcggcggcgtagccaggaccttcgaccggaagaaaatatccagaaagaggggtacggtaaatgattatgccagtgtgccagtgtgccaccactccttaatttagttcccactcaatgctgcagatcaatgccagttcttagatcctcttcttttttttttaacaaaaaaaataaaaaaaaatcaagaacacaaaggtcgttccttttccggattcactcactgttccatgcattggaagttcaaggacaacatggcgtaggttctagctctgaatggcatggcatggcttgggcgtgggcgtgcagggggtgctatcaaagggcgtggatggaagtacggctccgggttcgtcgacggagtgttcccagtgctgagttccatggcgcaagat

SEQ ID NO: 38518 - DNA, 640 bp, Zea mays
  unsure at all n locations
  Clone ID: LIB3060-057-P1-K6-C5
agaaccttaggggaatacttatttctccaggacctggtgaaccacaagattcgggaatatcattgcagactgttcttgaattaggcccaaccatcccaatttttggagtttgcatgggtctgcaatgcattggagaggcatttggaggaaagattatccgtgctccttctggagtgatgcatgggaaaagctctccagtttattacgatgaggaattaggaaaggcattgttcaatggcttgccaaacccttttactgccgcgaggtaccacagcttggtcattgagcaagaaaccttcccacatgatgctttggaggctactgcatggactgaagatggacttatcatggctgctcgccacaagaagtacaaacacatccagggtgtccaattccacccggagagcatcatcacccctgaaggcaagaaaatcatcctcaactttgtcagattcattgaggaactggagaagcagcgttcgtaggggaggtagacgcgacaggtggtttcatttcatagatcagacggaagcagagacaaggcgcttaaagctgcgccaggttccggggctggcagttgaagcatagctaggaaacagctntccctctcttaattcggtgtgttcgtggtgacataatc

SEQ ID NO: 38519 - DNA, 643 bp, Zea mays
  Clone ID: LIB3060-057-P1-K6-C7
cccacgctgtccgcaccacgcagcacctctgccatccccgcttccctccctcactcgcagccacccgaaccccaccgccaaccagccggatcaagtcgagtgaagcgatgctggaggaggcgatacccgcgctgctgagcgccgtccacgggtggttcacccccgccgtgctcttcgtcgtcctaaacatcgtcatcggcaccatcgcggtcacctccaaggccgccgcctcggcgaccggcggcgacgaggaggaagtcgccgcttctggcgcgggatgggagccgcaccggcggctggcccgcgtgccgtccatggcgttcgagcgtctcaagtcgttcaacggccgcttcgccacggccgagcccgtgcccgccgagacaggagtggtggatctggggtacaacaagcagccccacacggcggagatggagaaagagggccctgtcgtcgtcgagggcgctgtagatcctgagcccgagcccgagccccaacacgcggcgcacatggagcggagcaggtcggaggcggatgcagaggcgaagctgccgttgctcccgtcgcgtctgcacaagtccgccagcgacaagtcggcgttcgcgcacttcggcgccgaggaggtggaggagaccgtgcgcccggt

SEQ ID NO: 38520 - DNA, 631 bp, Zea mays
  Clone ID: LIB3060-057-P1-K6-C8
ccgggtcgacctcgcgtccgccgccggtctcctcacgccgtcgctgctgcctgctcactccccactcccgactccccgacgcacgagctcccaggagttagccatggcctccaccaccctctcctccgccttcagcctcctctcccgcccctccacctccccgtgccccgccgtctcgctcccgaggtcctccttccgggtgcctgacagccgccggagacgccgcgccgtcaccgtcgcgtccaccgccaccgagtcccccaaggtcttggagctcggggacaccattgccgggctcactctcgaggaggcccgcaaccttgttgaccacctccaggagcggctcggcgtcacagctgcggccttcgcgccggccgccgtcgtcgcagcgcctggggcgggcggcggggccgcggccgaggaggaggcccccgttgagaagacggagttcgacgtagtaattgaagaggtgcccagcagcgcgcgtatcgccactatcaaggtggtgcgcgtgctcaccagcctcgcgctcaaggaggccaaggaccttatcgagggccttcccaagaagcttaaggaggccgtcagcaaggacgaggccgaggatgccaagaagcagctcgaggaggtc

SEQ ID NO: 38521 - DNA, 631 bp, Zea mays
  unsure at all n locations
  Clone ID: LIB3060-057-P1-K6-C9
agccctttcaacggcagtcatggcttccatcaccctcctctccctcgctcccaccgccatcttcctccacatcccggctttcacctcctcctccgtcgttggtcccggaatcctagccggccgctgggccgcgccccgcgccctcccgctccgcgcgctcccgccccgtcgcgtcaccggcgtctgcagcagcgccgcggcggcagccgaggcctcggacgccgcagcgccagtggagaagttccggctcgacaatttggggccccagaaggggtcccgccggcggcccaagcgtaagggacgcggtattgctgcaggccagggcgcgagctgcgggttcggtatgcgcgggcagaaatcgcgctcggggcccggcgtccggcgcgggttcgagggagggcagatgccgctctaccgccgtctccccaagctacggggcattgccggcgggatgcacattggcctgccgaagtatgtgccattcaatttaaaagacatagtgcgcggcggattcaaagatggtgacgaaatatcactggaaagcctgaaatcacggngtctgatcaatccatcaggcagggaaaggaagctgccgctgaagatcttaggagatggggatgtatcaggtaag

SEQ ID NO: 38522 - DNA, 502 bp, Zea mays
  unsure at all n locations
  Clone ID: LIB3060-057-P1-K6-D1
atggaaactcgaaaaaggattncggcgtcattgctttgcactactactcgctgtgcattangaactgttttantgaatattttacctctncgggggacatttgcattggcacatagaagagcctccactggtttgcaggtgaacgcggtggtggcagagaaatcttcatggcatggaggaggacttggccaggagaaaggggaggagaagaagaagaagaagaagaagctggtttggggacgaccagcaccgaatatcatggcgattgatgaccgcagaaaaagggaaactagacggatttccttggatctcgcacctcgccgatcggtttgctttgcttctggctcgaatgaagcacgattccaatcgtggcatgcaccgcgcacccgacctaatgtgtggcacctcatgtcttgttcccttgaaggagaggggagcgcggacaaccgcgttggatcatcgttagcatttattcttaatccctagatgaactttatgaatt

SEQ ID NO: 38523 - DNA, 616 bp, Zea mays
  Clone ID: LIB3060-057-P1-K6-D10
cgagagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttct

SEQ ID NO: 38524 - DNA, 631 bp, Zea mays
  Clone ID: LIB3060-057-P1-K6-D11
agacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaagctgggctggatta

SEQ ID NO: 38525 - DNA, 616 bp, Zea mays
  Clone ID: LIB3060-057-P1-K6-D12
ctcgcttctcaccatcgaggagggcatctttgaggtcaaggccaccgccggcgacacccacctgggaggcgaggacttcgacaaccggctcgtgaaccacttcgtccaggagttcaagaggaagaacaagaaggacatcactggcaaccccagggcgctccggcgactgaggaccgcctgcgagagggctaagaggacgctctcctccaccgcccaaaccaccatcgagatcgactcgctctatgagggcatcgacttctacacgaccatcacccgtgcccggttcgaggagctcaacatggacctcttccgcaagtgcatggagcccgtggagaagtgcctccgcgacgccaagatggacaagagcagcgtgcacgacgtcgttctcgtgggcggctccactcgcatcccccgcgtgcagcagctgctccaggacttcttcaacggcaaggagttgtgcaagagcatcaacccagacgaggctgtcgcgtacggagcggccgtccaggccgccatcctcactggcgagggcaatgagaaggttcaggatctgctcctgctcgacgtctcgccgctctcgctcggcctggagacggccggaggcgtcatgactgtg

SEQ ID NO: 38526 - DNA, 650 bp, Zea mays
  unsure at all n locations
  Clone ID: LIB3060-057-P1-K6-D5
ccgggtcgacccagcgtccgctgccttctttttttcccccgcgaagcagggcgaggcaggcagcgtgtataaactgagcgaacgtgagcggtcttcgccttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattntggtgttcaaggagcagaatccaacaacatattgtatctaagggacattgcgga

SEQ ID NO: 38527 - DNA, 549 bp, Zea mays
  Clone ID: LIB3060-057-P1-K6-D6
tgatgatcttagtgaacaattgaagcggcaaggtgcttcgataccacttgttagaccaggaaaaagtacagctgcttatattaaaacagttcttagtcgcatatctgtcttgggatctgcatttctggctgtgctagctgctggaccatctttagttgaacagacaagtcacttgacagcattccgtggatttgctgggacttcagtgcttatccttgttggatgtgcaacagacacagctcgaaaagttcaagcagaaataatttcccagaaatataagaatattgagttctatgatgtcaaccgttttggccaatagttgatctcactggtcattcttttcaacctgtacttagatttttatttgtgtaattgaatatcggatccgtaaggccgtaactaagtatttccttgttgttcacttggatcttaatttttttctactgtgtatagtactgaaatctgtactcaaggtacacaaatcattcatctgtacgctaacatgtcagagcactcaaatcttaaacctatgaatgcttattgttattc

SEQ ID NO: 38528 - DNA, 633 bp, Zea mays
  unsure at all n locations
  Clone ID: LIB3060-057-P1-K6-D7
gtccccttgcacacacacacccttcctccgctgcctcagctatggcagcgccgagctggatccggctccggcagtcgcgtgcaaccctcctcatcctgctgctcattgccctcaacatctccctttcctccgccgccaacttcgagggcttcgactccgacgaccttccctccgcggccggtggcctcgatgctgacgatgacgaggaaggtctcgacggcgtcgacctcccgccccctccgcccatctccctctccacctctgcgccatcacctcccgtcacgacgacatccgcgccgaaccctaaccccgctacgcgtacgcctcgggaccccaccccggcgctcgacctctgggacgaggacgagttcgagggcatccccgtgccggaagcgatcccctccgacgactccgccgccccggccgaggccgaccagtcagatccctccgccgaggctcctgccgagacgattccggccgcgaagaggagcccagctgagctcctccgcgcgttctccgtcgagatcgcgtgtgtcagcttcctgatctgcttcgtgctcaactactntacggggaagcggcaaaacgagaacatcgcgctggcctgggccaccaagttcgccacgagggact

SEQ ID NO: 38529 - DNA, 625 bp, Zea mays
  Clone ID: LIB3060-057-P1-K6-D8
tctcgttgagagaacttcgatcagcaacaaacagcttcaattacgataacaagatcggagaagggccacttgggagcgtgtattgggggcaagtctgggatggttctcagattgctgtcaagaggttaaataacgcaaagaacggcacagaagccgaatttgcttcagaagtcgagatactgggaagaataagacacaaaaacctcctgagcttccgtggatactgtgcggacggacccgagcgcgttctggtgtacgacttcatggcaaactcaagcctgtatgcacatctccatggaccgcattccgcggagtgtctcctcgactggcggaggcgagcgtctatcgccatgggcaccgctcgggctctcttgtaccttcatcgccacgcaacgcctaagataatccacggaagcgtcaaggccaccaacgtgctgctggattcagacttccgggcgcacgctggcgatttcggtctggcaaggcttattcccgacgacggaacggaccacgaaaagatagccagcagcgagagccagcgaggctaccttgctcccgagtacgccgccatgtccggcaaaccaactgcaggctgcgatgtatacagcttcgggatcatactgct

SEQ ID NO: 38530 - DNA, 568 bp, Zea mays
  Clone ID: LIB3060-057-P1-K6-D9
ccgggtcgaccacgcgtccgggctttctgacgtcctctcctgtcgatccaaggacaccgggggtttcttggaaacaagttcttggattggtccgccaccagcccaccaccaggcaccatgtcggtctcgccctcgtccctgtgcggcggggacccggcgatgaggatcgtggtgtggttccggagggacctcagggtggaggacaacccggcgctcgcggcggcggcgcgtgccggtggggaggtggtgccggcgtacgtctggtcgccagaggaggagggcccttactaccccggccgcgtatcccggtggtggatcagccagagcctgaaccacctggacgcctcgctccgccgccttggggcgggaaaacttgtcacgcggaggtcggccgacgccgccgtcgcgctgctccagctggtccgcgacaccggcgccacgcacgtctacttcaatcatctatacgacccgatctcactggtcagggaccgccggttgaaggagatgctggcggctgagggcatcgttgtgcaatctttcaattcggatctgctgtacgagccatggg

SEQ ID NO: 38531 - DNA, 587 bp, Zea mays
  unsure at all n locations
  Clone ID: LIB3060-057-P1-K6-E11
ccgggtcgacctcgcgtccggccaggtgagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctgaataataatgaagacgcatgcatgtcgtcgccaggaacaaagatcgagaaataatacaagaccagcacgcatgcatgggcatactctatatatatatatgtatagcccgtgcccgtgcccgcctttgtaccaatacaagccaaaccaagtggatgtgtattattattattattgcgctatcacatacatgtacccctgcctgctacctgaagatggatgtgtatcgagttatcaaattaaggcacagcagcagaaactatatgtattgcatttgaaaaaaaaaaaaaaaaaaaaaaaaaaaaaaaaaaaaaaaaaaaaaaaaaaaaaaaaaaaaaaaaaaaaaaaaaaaaaaannnggg

SEQ ID NO: 38532 - DNA, 632 bp, Zea mays
  unsure at all n locations
  Clone ID: LIB3060-057-P1-K6-E12
tcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcggcggcggcccgctcggcgaggtcgncgaccccctctatcccggcggcagc

SEQ ID NO: 38533 - DNA, 460 bp, Zea mays
  Clone ID: LIB3060-057-P1-K6-E2
caaatctagattcaggaaaagtacttaacttgtgaagtaaaattttggcataaggattcactactagtaagctcttctgcaaaatgagtccttgaaatttggtaagccttaccttgattcctaatcagccagcatatccttgagagtcttttctttagtcgggtaagtcttgctgagtaattgcgtactcagggttttattccctattgtttttcaggttatagctttgtgttgctgttgatggttttaagtgccggtgggctcggccttcttataagtctaagtaactcttctatacttcttattgaggatggtcacttgagctagcatatatttcaaacttataaataatttataacatttcaaagtttatttctttgaatcactattgtaatcactccgataaacataaagtaaacttgatgtaacttgtagaatttggtaataagatttccgctgc

SEQ ID NO: 38534 - DNA, 640 bp, Zea mays
  unsure at all n locations
  Clone ID: LIB3060-057-P1-K6-E3
caattacaaanatcattttcccaattgagaacacacaacataatggctgattataggtttcttgttcaagaaactctaatagcattgtgccttctcctctcttttccaccgggcatagcctccatccattcatccacactgaacaggagttgcatcttagaggagagggctgcgcttctatcaatcaaggcaagcctcctggatcctaacaactacttgtcatcatggcaaggtcaagactgttgcagctggaagggaatcaggtgcagccaaaaaactggcaacgtcgtcaagctcgatcttaggcgcataaatccaggaaactttggaggtgagataagctactctttagttaatttacgacggctgagatatctagacttgagttacaacaacttctctggggtacaaataccggagtttcttggttccatgtcaagacttaggcatctcgacctttcatacacctacctccatggaaggatacccccgcaacttgggaacctcaccaaacttgtctaccttgatctcagatgctgggacttttacaaccctacttactactatcccttctcagccaaccttgcatggctgtcacaactatcctcattgaagcacctagacatgagctttgttaatc

SEQ ID NO: 38535 - DNA, 667 bp, Zea mays
  Clone ID: LIB3060-057-P1-K6-E4
cccgggtcgacccagcgtccgctcggctacacctgcaaaatggatatggcaatggcttccttcgtcgccgctacgcaccaccacggcagtcacctggccgccggcttcccctactccgcgcgagcaggcaggagcgttggccgcagcggcgtcaccatctccattagagcccagaagaagagtaatagcgactctgggagtagtagcggaggtggggacgtgcggaccagcagcgggaggcgagtgtggcgtcgtcggaaactgaccaaagaagatgacatgttgcgttacaagttggatcgtatccctttcttagaagagaaggtgagaaaggtaagggagaatgggaagatcatatgcctggatattaatcagctgatgttatctcaagagaatagatttgcgttcaccatggaggtggctgaagaagctaatgcctatcttgagaagaacaggcatgaatatgggttaaagaagcctatactgcatgttctcagtgatcgcatgaatgaatctgggttttctcggcctgagggttacctttatccttatcctatcaagcctggcccttatttcattaaagaggaaggaaactgagtaaatcacatgctacttggatcgtaatgcacaagctgggaggcagcctctttttagaaggaactcaagg

SEQ ID NO: 38536 - DNA, 648 bp, Zea mays
  Clone ID: LIB3060-057-P1-K6-E6
ccgggtcgacttagcgtccgccgaacttagaatcaacaaattcaaaatttcggagatccttttttgatggttattcgggaaggtgagactgctgcagaggtaatggagcgcatccagagaaaacttagagttcctgatgatgagttctccaagtggaagcttgcattcatatccatgaaccggccagagtacctccaggacactgacgttgtatcagcacgttttcagcggagagatgtatatggtgcttgggaacaataccttggcttggagcacactgatacaacatcgaaacggtcttacacatccaatcagaatcggcacacctatgagaagcccgtaaaaatttataattgagaaaccttcatcaaagttcaatccattgtcaaaggcgtcgacaacagcatgcccaaggtgatacgacgcttcaaacagaaaaatctggtatagtatttgcctgtgctgaggcctgcaagcccaccaatgctgcttccaaccttcattgttccaagcaaccaagcatgtgtttggtttttcttcgtcgtgtcgagtatgacggcccctgacagggtaggtgtttgcttagtttgtagagcaaagctagcacataagaaaaaatattttggtaggggtggggggcatgtatac

SEQ ID NO: 38537 - DNA, 406 bp, Zea mays
  Clone ID: LIB3060-057-P1-K6-E7
cgggtcgaccctcgcgtccgggctttttcctcggcgacgtcatgaagggcgccgagcagctggtgggagggaagcagcagggcggcggggaggagagcgccggcggcggtgggctgtttaagatggcccagggcttcctcaagtagatatattgtctggccaacgtacgtgtactcttgtagtatctgttacgtaatgagcttcaaaataatgttcccctcgcctttatttgctgttcaagtccctgtaataaccgagaacgttaattgtagcagtgtgttttttatatgattaaataagtactatgttgtataaggctagtgcagctgtgcaggttactctatattcttactctatatcactatttatagtctactcatcaataaatagattggttgattttttt

SEQ ID NO: 38538 - DNA, 592 bp, Zea mays
  Clone ID: LIB3060-057-P1-K6-E8
ccgggctgctcctgacagagccctcgcttcaaccgccggcgacctttttcctcctccgctcgaggagtgggccaacggagggagaccatatgggcgcggaggcagcgcatgggcatccgcagcagcagcctccctcgtccctccgacccggcagggaggccgcggcgccgcccgcggtggtggggctgcagctctcggcgctgatcgaccacgtcgcgcgcgtcgactggtccctcctcgaccgcgtccctggcgaccgcggcggctcgcagcaggtatccattgatgagctgaatcatattcttgatgaagtgaatgcccacatccttccttcccgcaatgatctcactccggtaactacaatagccggtggaagtgttgccaacacaatccgtgggctctcagctggttttgggatatcaactggaataattggagcttgtggagatgacaaccagggacttctgtttgtcaacaatatgagctttagtggtgtagatctcacaagattaagggcgaaaaaagggcacaccgctcagtgtgtgtgcttggtcgatgcaagcggcaatcgcaccatgcggccatgcctatc

SEQ ID NO: 38539 - DNA, 645 bp, Zea mays
  unsure at all n locations
  Clone ID: LIB3060-057-P1-K6-E9
ccgggtcgacctcgcgtccgccgttatctccagactgtggtgctgaaggttgccatccactgccatggctgcaagaagaaggtccggaaggtgctcaggggcatcgaaggtgcgtgcctagccgtctagaaacacatgcctcttgcgagtcagcaggttcctctgcatacattttgggctgtttttggctgaaccgagcggggtggttccggtgattgttttcaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgccggctccgcagcctgccggcgacggcggcaaggatgctgctgctgctgctgctgnggccgcggcggacaagaagtcggaggaggcggtgaaggagccgcagggcgagagctccgaggaggaggagaagaagaagaagaagccggagcaggagcaggaggacggggccgcagagaagaagcagcccgaagcagagtcgtcaaaggaggtggagaaagtggaggcgaagacggacggcggtgacagcgagggagctg

SEQ ID NO: 38540 - DNA, 616 bp, Zea mays
  unsure at all n locations
  Clone ID: LIB3060-057-P1-K6-F10
gcagaggcagcgacacgatcgcgagcgcacgccacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgccggagaccgcgctgccgtggttcaagacgggcgtcatcccgcccgcgggcacctacaactactgggccgactcctacacgctcttcgtcttcaacatggcgctcatgggcttcgccgagcaccggcgcctncaggactggtacaacccgggctccatgggcaagca

SEQ ID NO: 38541 - DNA, 652 bp, Zea mays
  Clone ID: LIB3060-057-P1-K6-F11
tcccgggtcgacctacgcgtccgatgaattctagcttttaaatttcataagttatggctgatttcttgttacagacttcatcttgtcactgtagtgttatcctgattattaagcttattattcgtccgaacaacatccatgctttggctattatgacttgttgataaaatggccattcagaaaagaaatagtcaatcatttattcatttaggtcaaatataatcaaatgctttttagaactgttggtcatcattcttatatcatcagtgttgtactgctgttcaatatcttgttaaggacactatttttgcttttagtagcttgttgctagctgtaaggatggactcttgatgtcagcactctcatgtctttactgattaggttatgaccagtaatattatttcttgtgcaagacttttgactttcggtaatgtgagagatcatttgacggcatgagtgctgaatcattacaaccacacaattggccagtattctcatccagggcatgagaaaaaggtaaatacactagaggaatctgtttagaatctattttttgtgttgattgttgctacatatgcagtgtattagtttcctgcatcattctgccatctttgggttttgacgtctcaattctagaagaagcagattatta

SEQ ID NO: 38542 - DNA, 658 bp, Zea mays
  Clone ID: LIB3060-057-P1-K6-F12
cccgggtcgacccagcgtccggcaagctcggccagacctccctcttcaataagaacaagttgaagaaagatgtccacgtacctggtgtcctgctgcctccggccaccgtcagcgggggcggagatgcccaaggcggcttccgccgcctcctcctcttcattggccccgccgcccgacaccaagagagtcggccgaagagactttgtgctcaggagcagtgagattgccacgctcgccgccatcttccacttcagtggcagcaaaccaagctaccttggcgttcagaagagtcctccgtcccttgctctctgccctgcaaccaataactgtgtttccacatcagaggaaataagcgactcaaatcactatgctcccccatggaactacaatcccaaggatgggcggagcggtaaacccataaccaaagaggaggccatgaaagaactaattgaagtcgtcacgaagacaaagccggacaacttcactcctcgcatagtagagaaaaaagatgattatatccgagttgaatatgagagtcctatatttgggtttgtagatgatgtggagttctggttccctcctggcaacaagaccatggttcagtatcggtcggcgtctcgatcaggatttatcgatttcaatgccaacaagaagagag

SEQ ID NO: 38543 - DNA, 643 bp, Zea mays
  Clone ID: LIB3060-057-P1-K6-F2
cccacgctgtccgaagaaagatgcatcgtgcatgccattggatctgcggtggactatcgtcaactgggttctgctgaacaaggtttctattttgtctggaaaacattacagtacgcttctgaaacagaagctccagtctttaattggagatgagaaacccagcccacaaactgttgaagtaattatgggaaggaaattacaggttcccctaggagcaaatggttgtgcatattttccttttgaagacctttgtgataaacctttaggtgcagcagattactttggactctttaaaaaatttcacaccctggcacttgatggtattccaaagcttgggtctagtaacagaacagcagcttatcggttcgtcacactgattgatgttatgtacgagaacaaggcaaggctgttatgtacagccgaggctggaccagtaggactgttcgagaatatcgtgactgttgctgaagcacggaaggtttcaccaagatcttcacgctcacagaaaagcgacgacactgacctatgcgtggacaatgagcttggatttgccaaggatcgtacgattagcaagttgacagagatcaacagcagagaatatttggaggacttcgaaatgagattgaggcaacagcagcagctg

SEQ ID NO: 38544 - DNA, 663 bp, Zea mays
  Clone ID: LIB3060-057-P1-K6-F5
ccgggtcgacccagcgtccggccaagatgaaacagaagccacagaaggagattcagaacagaataaggttgttatcacagagatggaggaatttgtgtggggactgcaattgaatcaaggaacacgcaagccagaagacgatgtgtttatggatgaagatgatgatgccatgccttcagataatgttgcaaaagatgacactaatgggttggcagagatggaagaggatgctctgacagaaataccagccaaggtcgaagaggatgaagtcaaaccagatgaggttatacatgaagttgcagtaggaaagggtttagctggtgctttaaagattcttaaggagcgaggaagcctcaacgagggaacagattggggaggcagaacaacagacaagaaaaagagcaagcttataggtgtcgaggatggacctaaagacattcgcattgaaagaatagatgaatttggcagagtgatgacacctaaggaggcattccgtcatctttcgcacaagtttcatggcaaggggcctggtaaaatgaaacaagaaaaacgccagaagaaatatcatgatgagctgaaaaccaagcatatgaaatcttctgacacaccattattggccgcggaaaagatgagagaggctcaatctcgtaatcaaacaccata

SEQ ID NO: 38545 - DNA, 613 bp, Zea mays
  unsure at all n locations
  Clone ID: LIB3060-057-P1-K6-F6
gaaggtggttccctactcaaagntattcctgcgaccaaggatggaagggttgattggtcacaggatttcttctgcaaaccagcatttctgacagtatctggacagctcaatggtgaaacatatgcttcagctctatctgatatttacacatttggtccaacgtttagggctgaaaattcaaacactgcaaggcatctggctgaattttggatgattgaacctgagcttgcctttgcggatctaaatgatgacatggcttgtgcaactgcatatctccagtatgtagtaaagtatattctagagaactgcaaagaggatatggatttcttcaatacatgggttgagaaaggcatcatagatcgattaaatgatgtagtagagaagaactttgttcacttgtcttacactgatgctgtcgagctactacttgggtccaagaagaaatttgagtttccggtaaagtgggngtttggatcttcaaagtgagcacgagcgatatatcacagaagttgcctttgatgggcgccctgtaataatcagagattacccaaaggaaatcaaagctttctatatgagagaaaatgatgatgggaagacagttgctgcaatggat

SEQ ID NO: 38546 - DNA, 584 bp, Zea mays
  Clone ID: LIB3060-057-P1-K6-F7
tttacaaagagaaccaataatgttactcgcacaagtacagttacaatacgatcctaggaacttcaataatttccatcctctctttttttgtggttgctgttctcaccactgttgtcattgttgttttccccactagcaagtatgacagcaaacttggcatgaaaagaagatggagcaacgcatgcattgtagtgatccacaagatacagatccaacaacattgcctgctcaaaggccggcaatctcaaacatagtagcttataagaaaagcactcaaggaaaggaatacatagaatggggacgaagggggcccttgagcttagaagcacttccggtgaacaatcgctggtcctgactcatcgtactcagcctttgagatccacatctgttggaaggtgctcagggaggcaaggatggaccctcctatccagacactgtatttcctctcgggtggagccaccaccttgattttcatgctgctcggggcaagggcggtgatctccttgctcatacggtcagcgatgccagggaacatggttgtgccaccactgagaacaatgttaccatacaagtccttcctgata

SEQ ID NO: 38547 - DNA, 337 bp, Zea mays
  Clone ID: LIB3060-057-P1-K6-F8
cccgggtcgacccagcgtccggccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 38548 - DNA, 650 bp, Zea mays
  Clone ID: LIB3060-057-P1-K6-F9
ccggggctctgatagcttgctccaggactgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcaccctcaccgtgccgggcacctacggcttctactgcgagccgcaccaaggagcaggaatggtcggcaagatcacagtcaactaaagctagctatccattccatgcatctcgatctgtatgtactccgcccgtcgatggatgatgcatccatctctacttgttttcctcacatgtacaacaattaatgc

SEQ ID NO: 38549 - DNA, 543 bp, Zea mays
  unsure at all n locations
  Clone ID: LIB3060-057-P1-K6-G1
caacagcatctaatcaatcaagacagccccgtgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgccaaggtcaccgaccaccacatntacctcggcggcaacgccgggagcagggacagggacctcgcccacatcgag

SEQ ID NO: 38550 - DNA, 611 bp, Zea mays
  Clone ID: LIB3060-057-P1-K6-G10
cccacgtgtccgcgttgattggctcggccggaaagctacaatgtggatcttgctgtttggatgctgtggcttcctcggacctctggctgttcatcagaaggagtcggtgacaaccgctcttctgttcggtgctcgcgcctgtggcatggggagctctacggtcttgtgcttatacgcaccagaggtgtacccaacatcagcgcgctccacaggtgttggcattgccaccgccatcggaaaaattggcggcatcgtttgccccctcatcgctgtcggcatgctgcggagctgccaccaaatgcaagccgtcctggtctttgagcttgtcctaggcctcgcgggagtagcctgcatcctcttccctgtggagaccaagggccgcgagatgaaatgacagacccttcacagcacccaaagcgaccactactttcagcggcgtacgttcgaacataaagtatttttgttgaagacgcgtactcagaaaattgctcaagctatatctttaatgaaatattctgagtatcctttttatcaattagttttttctaccctatgtctttttaattttcactattttgattagattttggtttctaattaaaatcttaata

SEQ ID NO: 38551 - DNA, 557 bp, Zea mays
  Clone ID: LIB3060-057-P1-K6-G11
ccgggtcgaccctacgcgtccggctccctcagatcccggcgtccccaccgcacatccctccctgcttccttcccccatcgccccggccgcggaggcggagctgcccccccacgccacgatggcggagtgccgcagcctcatcgagttcctccgcgcgttcgagcaccaccgcagggcggccgacatctccgcctccgcgggcgcgtgctcccgatccaggcgggccggggcctcctccgccgcaggcggctccttctgcgacagcgccccgatggccgtggtcgacgcggtcatgctcctcgccgtcgtcaccgcgctcggcttcctcctgatcccctacctcaagctgctgctcctcgagatgggcgcgctgctccaccccgccgcgtcctgcctcccggccgccgccttcttcggggccgccgtcgccgtcgccgcggccgtcgtcgcctgggagctgctgggccaccacgcgcgcaagtgcggcaagcccaggtgcaggggcctcaagaaggcccgcgagttccacatacagctagagaccgaggagtgcgtgc

SEQ ID NO: 38552 - DNA, 607 bp, Zea mays
  unsure at all n locations
  Clone ID: LIB3060-057-P1-K6-G12
cccacgcgtccgcccttggttcccctccattattcgacctcacctcaccttgccaccagccatggctgccgtgaccgccgcggccatctctctgtcctcctcctccgcctcctcccctgcggctgctgccaaggccaaggcggcgtccccgtcgtcgtcgccatgcaggcacctgcagggcctgtcggcagcgagcccgcggcggcggtggcgggccggcgcccgcgcggtacgggcgcaggtgtccaccaccgagaccgcggcggcggggccggcgaagacgtccaagaagcaggacgaggggctggtcaccaacaagtacaagcccaaggagccgtacgtcgggaggtgcctgtccaacaccaggatcaccggcgacgacgcgccgggggagacgtggcacatggtcttcagcaccgaaggcgagatcccgtatagagaggggcagtccatcggcatcatcgctgatggcgaagacaagaacggcaagccgcacaagctcaggctatactccatcgccagcagcgccctcggagatntcggcgactccaagacggtatcgctttgcgtgaagaggctagnctacaccaaccatcagggggagatt

SEQ ID NO: 38553 - DNA, 396 bp, Zea mays
  unsure at all n locations
  Clone ID: LIB3060-057-P1-K6-G3
gtccggcaattactgcctgagatggatcatgtggaatccagagaactaggtccatgccgaatcaaatctttgctcagaatccatcgtggccagtcattgcggtcacctggaaaagcctatcgaggaaacagctgctggcatcttggggatcctccatgacaggaagcagaagtgctccatgcccacgccatatcagagagacgatactagcactgtgttctatcccttctctactaccaccttgtaaccgtgtgcatgttttgaataagctttgtgtcaaggaccatagccttcatgtaatttttttttgttggaccaccttctaggtggtgccgtttgtatcataaacataacttgaagtttagcgcagcagaaacacatgtatattgcgttnaa

SEQ ID NO: 38554 - DNA, 560 bp, Zea mays
  Clone ID: LIB3060-057-P1-K6-G4
tcccgggccagacctcatctcactccgcttctcccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgaggtgccggcggtacacggacgccatgtggatcaccacggcgcccatcgaggacatctccttcgtcgccgccacgcgcaccggcttcctacagctgttcgactacatccagggcaagaacgcgtacaaccagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccggttcgggggcttcgtggcggacgccgacgtcggggagcaggcggcgcggctc

SEQ ID NO: 38555 - DNA, 628 bp, Zea mays
  Clone ID: LIB3060-057-P1-K6-G5
cgggtcgaccacgcgtccggtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatgggtccaagacgaagatatcggaagtgatgacatctccagctatcacactatcctctgacaaaaccgggatggatgctgctgttctcatgctc

SEQ ID NO: 38556 - DNA, 434 bp, Zea mays
  Clone ID: LIB3060-057-P1-K6-G6
gaggtattgtcacttatgtaagctgggcttagttggttaagagactttccaggcccttctatgcctctgggccgggaagacctggcttcttagattcactgtcaaattcaatgggcctatttttaccggaaaactaacataattagggaccttttggagggcttaaatgggatccaaagtcccgcatgttctgggcctcgagaggtatggagtaaatatgccagataaaccttgaggaccttcaaatatgaggagaactccaaaaaagcagtaccaatggttgaacatatggtgacctgatgcacctgattcatgcctgaagagtgccttcagtacatgtcagccctgaagggatcctgcattttccgtttttgtgcaataccccagataatggcaattggaacatgtgctctttgctaccatacgtgcatgtc

SEQ ID NO: 38557 - DNA, 660 bp, Zea mays
  unsure at all n locations
  Clone ID: LIB3060-057-P1-K6-G7
ccggttcgacctttgcgnccgctngtttttcatcagcacggaaagcatagctagccaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgggggtctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacctgttgaagaacaagaagctggccgccaaggacaggcgggaggagtcgctgctaccgccgtactacgtggccgggctgccgggctccttctacacccggctgttcccggaccactgcgtccacctcttccactcctnctactgcctcatgtggcgctccaaggtccccgacgagctcgccggtggcgcggtccttaacgagggccacatgtacatctgggaaaccacgccgcaggcgggggtggccctgtacagga

SEQ ID NO: 38558 - DNA, 662 bp, Zea mays
  Clone ID: LIB3060-057-P1-K6-G8
cgggtcgaccacgcgtccgcttttttttcggaacgcacacacagcccggtccccgatctccgatcccctcgtcgatccaagatgcagatcttcgtcaagaccctcgactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgagtcttctgataccatcgacaatgtcaaggccaagatccaggacaaggagggcatcccttcggaccagcagc

SEQ ID NO: 38559 - DNA, 358 bp, Zea mays
  Clone ID: LIB3060-057-P1-K6-H10
gtcgactcacgcgtccggaaggatattgcttggtcttgattggatcatgtctgatttaagtcgactattatttcttggaattttcttttggacctggtgctatggttgatggatgtatattggatatgtgcgttctgccaggtgtaagcaccaaaggtttagacagaccgagagcaagagcgagtgaacctgttctggttttgcagtggttcagtaaggcagaaagttgttaaaccgtagttctgagatgtattaccagtggcgccatgctgtacttttagggtgtataatgcggatacaaataaacaatttagcggttcattaaagtttgaactcaaataacatgttctttgtaagc

SEQ ID NO: 38560 - DNA, 628 bp, Zea mays
  unsure at all n locations
  Clone ID: LIB3060-057-P1-K6-H11
cggacgctgtggggcagcttctgcttgctctggggggaaggagagagagagagcgagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggcgaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctcgtcgcatccgaccccgagggcagggtgccgctcttctgggggatcaccgncgacggctgcgtcgccttctccgacgacatcgacatgctc

SEQ ID NO: 38561 - DNA, 627 bp, Zea mays
  Clone ID: LIB3060-057-P1-K6-H12
cccacgcttccgcccttggttcccctccattattcgacctcacctcaccttgccaccagccatggctgccgtgaccgccgcggccatctctctgtcctcctcctccgcctcctcccctgcggctgctgccaaggccaaggcggcgtccccgtcgtcgtcgccatgcaggcacctccagttcctgtcggcagcgagcccgcggcggcggtggcgggccggcgcccgcgcggtacgggcgcaggtgtccaccaccgagaccgcggcggcggggccggcgaagacgtccaagaagcaggacgaggggctggtcaccaacaagtacaagcccaaggagccgtacgtcgggaggtgcctgtccaacaccaggatcaccggcgacgacgcgccgggggagacgtggcacatggtcttcagcaccgaaggcgagatcccgtatagagaggggcagtccatcggcatcatcgctgatggcgaagacaagaacggcaagccgcacaagctcaggctatactccatcgccagcagcgccctcggagatttcggcgactccaagacggtatcgctttgcgtgaagaggctagtctacaccaacgatcagggggagattggcaaaggagtctgctcaaa

SEQ ID NO: 38562 - DNA, 451 bp, Zea mays
  unsure at all n locations
  Clone ID: LIB3060-057-P1-K6-H2
gttcgccaagtggcgcatcgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacccccggcgcggaggccaaggacagggccaccccggagcaggtggccgcgtacaccctcaagctcctccaccgccggatccccccctccgtgcccgggatcatgttcctctccggcgggcagtccgaggtggaggcgacgcanaacctcaacgccatgaaccaggggcccaacccgtggcac

SEQ ID NO: 38563 - DNA, 542 bp, Zea mays
  Clone ID: LIB3060-057-P1-K6-H4
gcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcatcgtggtcattggccacagctgctgcggtggcatcagggcgctcctctccctcaaggacggcgcgcccgacaacttccacttcgt

SEQ ID NO: 38564 - DNA, 545 bp, Zea mays
  Clone ID: LIB3060-057-P1-K6-H6
gtcgatttagcgtccggagaattcttaattcatgagttgtagaggaaggacttatgtcaccacaaacagaaactaaagcaagtgttggatttaaagctggtgttaaggattataaattgacttactacaccccggagtacgaaaccaagggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacag

SEQ ID NO: 38565 - DNA, 577 bp, Zea mays
  Clone ID: LIB3060-057-P1-K6-H7
ccgggtcgaccacgcgtccgcacgattctgagcgcacgcacgtacgcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgccggagaccgcgctgccgtggttcaagacgggcgtcatcccgcccgcgggcacctacaactactgggccgactcctacacgctcttcgtcttcaacatggcgctcatgggcttcgccgagca

SEQ ID NO: 38566 - DNA, 515 bp, Zea mays
  Clone ID: LIB3060-057-P1-K6-H8
gggtcgacctcacgcgtccggtcaccattggcgctgcaccaagacaaccaagcgtcggcaccaatggcttactaccaggaggtggactactgctcggaggaggtgagggcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcagggagagcttcctcgccagggctaactgagcagcccgggcggccggcatccacgcccgttcgtgcctgcctgcgtgccttatgtatgtctgtgattgtgcagggtcatcgtacttggctagcgtacgtacgtgcacgcactcagctcctgtacgaattacgacaataagctcgtgacctgaataaaacttcttcgtaat

SEQ ID NO: 38567 - DNA, 506 bp, Zea mays
  Clone ID: LIB3060-057-P1-K6-H9
gggtcgatcacgcgtccgctgcgctgcgcggaagagtgggaaggagaaaatcagttaagcttgagccgcgcgcgacagggtcaaggtcgaggcccggggaatcgccggagaatggaggtgggccagggctccgcgacgaccgggtgtccccagcagcggcggcggcggctgggccttcgcttgcttctggtcgccgttctattcgcgggccgggccggcggcgttcggccacctgcaagccgccggcgccggcgcgacggcgctgtacaagcacgccgtcgttcttcgaccgcgacggcgacggcgtcgtctccttctcggagaccgtacggcgcgtttcgggcactcgggtttggattcggcctgtccagcgtcagcgctgcgctcatcaacggcgctcttggtagcaagtgcagacctcaaaatgcaacgtcatcgaagttggatatctacatagaggacatccagaacgggaaacacggaagcgattcaggggcatacgacgc

SEQ ID NO: 38568 - DNA, 476 bp, Zea mays
  Clone ID: LIB3060-058-P1-N6-A10
tcggcgctgtgcaccaccctccgcaggccggtgccgttcgggtgcaccatgtagatggcgaagctgccgccgcccgggttgtgccggtccgaggcgaacgcgatccactcgccgtcgggggaccagttgcacatggtgtcggaccaaggaccctcggtgaggcgccggatgccgtcggcctcgccgtcctccgcgtccatgatgtagaggttcttgtgcccggaccgcccggaccggaacaccacccacttgccgtcgggcgaaggggacgggaacgcgttgttctcgccgcccacggtgagcttcttgatggagacgctggggtcgtcgccgtcgccgtcgccgagcgacacggcgaccacgtccacctcggtgctctcgctcgcgaagtctgggccgacgctggtgtagatgacccctttcctctttcagtcccatgtcgtcgggaacgcgttgcccgagaagacccggcggca

SEQ ID NO: 38569 - DNA, 563 bp, Zea mays
  Clone ID: LIB3060-058-P1-N6-A11
gagaaaacgaccatacattcaaatatgcagatatggatagatacatagctaatgttttacgcacagacgacaggaacagctgtagccaaaccaaatacattgctcgcacactacatcgacatatcacttgaaagaaagcagcatctgaatcacgaagcagggcatccgaaaggcatgcgcttagttgggtatactcttcccccctcatgcagaaagtatgtgatactccatagagacactcaactcaacaacgcagatctcaacagcttgacacgctatgaaaggcgcggcagatagctagctcagaagcattttcggtggacgatagcagggccagactcatcgtactcatccttggatatccacatctgctggaacgtactgagcgacgcaaggatcgagccaccaatccaaacactgtattttctctcatgaggcgccacgaccttgatcttcatgctgctcggcgcgagggcaggaatctccttgctcatcctgtcagcgatgccagggaacatgggcgtccctccactgaggacgatgttcccgtacaggtccttcct

SEQ ID NO: 38570 - DNA, 448 bp, Zea mays
  Clone ID: LIB3060-058-P1-N6-A3
ggggtgctgaacgattaaataaaggattaaaccttgtatctattcatgctaccatatacagtttacattgcccgtgggagatcacaccctaccgatttgtgtggaactcctttttgattcttatattttctctggcttctcagcttgcggcggagagatatcctggtcgtagatgacctgagcaaccagaccaatgaaaatcagacccagagcagcaacctttctccactccacctttggtgttgcaaagatggcattcgcaattgtaatcccgagtatccccatcagccccaggtaaatgttcatacaagtttttgatcctgcactctcctttgcaatctgtttgaccttctgggcttccaccttggctttcacctttatttccatcttgttccgaggtttgaccttgccaaggcttttgaagaacattccttcggttttctccttg

SEQ ID NO: 38571 - DNA, 549 bp, Zea mays
  Clone ID: LIB3060-058-P1-N6-A4
aaatcataattgatacttcatcagaagtatctataaaaggaatggattttaaggtagccaatgcatcaaagggtttccaagcaactcctataaacctaatgcacatttcgctagactttaagtgtgtaaaatttttatttaaaaacacaaggaaaggattgcatgcaccagggcttgcctggaataaatactacgttaatgtttgttagacgacgtccacttggcgaccatcctttgtcttggcattcattcagtccattcacctgtggtccatcgacactgtttctcagagtagtcgactctttgcattacttggggtcactcggctttagtcccccgcatcatgtgatcaattaacgtacctaaatccgacttggatttcgcagaaataacaacgataatatgttcaagaagtttgttgaatatttgacgagcgccacgcgagaatcgcttctttacccactctcgggatttcttgatgacgtacggaacgacgacgagctcgataacgcacacgtgtgataaggcagggtctgcggaaatgtgtgt

SEQ ID NO: 38572 - DNA, 416 bp, Zea mays
  Clone ID: LIB3060-058-P1-N6-A5
caattgatcttgtatcaaagcttatggcatattattatactgctcaaacaaaggccgacaagcaacataaacgcaagtgtgcgccctagacccctctaagggtatcatccgcaacaaccttgagcctagcacgatagagcccgcgacgagccaaactaatatcacaaacaaaggcccccagggtgcaaaaaactatcctgaggaaagaaaaaatggtcacacgcaccaaggaccatgaggggagcgaacagtagccgcccaccggtggggggctagcggactcccaccggatggttgccatagaatgtagcacatgttgttacacttaacgataactatggctggctgcgagcatacctgagtaagaaaagtgagaacggatgtggatcaatacgcgccgggtgacgaggactcac

SEQ ID NO: 38573 - DNA, 561 bp, Zea mays
  Clone ID: LIB3060-058-P1-N6-A6
tttttgaacagaccaaccttagatagactgtgcatatggttgtgtaaagcattgttttgaactacacgcttacagaatagaatttgaaatagaatatgatagctgcttgagacagctttatagataacaagaccagagaccagacgcacccatgacaatatacccagctaatctattactatgttggctcatcgatccaacaccttttttttcgtcgtcgtcgtaatcatcttcacacgcacccacgcacacacaccatcgttttattcatccggatccattgctttagttcagaagttggggcctgctgcgaggatctcgtcagtcaggctgctgtcgtccccgatcttgtagctggcgaacacctcgaagttcttcttgaagagcccgccgagcctcaggagattctccttgtacgcggccttgtccgtccaggtgttgatcgggtcgaggatttccgacggcacgccgttgatctcagtggggatctccaggccaaacacctcggtcttctggtagttggcggtgaggagctcaccagagtggatggcgtcgatgatc

SEQ ID NO: 38574 - DNA, 585 bp, Zea mays
  Clone ID: LIB3060-058-P1-N6-A7
gttggagatgcttctataatttaatttgactgctgggccgtttattagccaaaaggcaagcaatcatgactgggtagacaagcctcatagcatcatggtcatcgataatattactatagaagcaaaacccaatatatatagtgtggtacgcaatcacgaacacaacagtccaaacctacacaatgaacccatgaaaattattcttttgttaactactactagcaccacccaacaaaatactccgaccagcaaagaaaccaggaaccatggattacatgcagaatcatcatcatttcttcttggcagccgccttggtcaccttggctcccgttgggtccttcttctccacgctctttatcacgccgaccgcaaccgtctgcctcatgtcgcgaaccgcgaagcgccccagtggaggatactcggagaaagtctccaccaccatgggcttcgtggggatcatcttgacgaagccggcgtcaccgttcttgaggaacttgggggcgctctccagctccttgcccgaccggcggtcaatcttggtgagcagctccgagaacttcacggcgatgtgggacgtgtggcagt

SEQ ID NO: 38575 - DNA, 562 bp, Zea mays
  Clone ID: LIB3060-058-P1-N6-A8
gaaatgttgtagcagaatttataacacagaggctactatttgtttgtggaaatttaaatgtgcaggaatctggctactgtaggcttacacaacaatgcagtctgtttctgttaaggaacgcaggaaggaactatcagagaccaacgatcgttgggtggtgttgtggctgtgcctcttcagggctgtgccccatcctcgtcggcggccgatgccgtgtgagccgggtacctccacatgatgtcagcccaggtgctctgcccgtccgtcacttccttcaccaccgaggccacctcgtccacatccacgcggatctggtccttgctgtcacgatcgcgcaccgtcacgctcgtggtgtgatcaaccgtgatcgccagggggacaccaatctcatccgtccttgcgtaccgttttcctattgtattacctgtcatgtcgatgatatgtgaaatcccagctgctgtcagggccttggagatcttcttggaacagcctcaatttctcgagcttgaccaatggaaagacggtgcactttattggagcaacgagagggggaaaccctgac

SEQ ID NO: 38576 - DNA, 526 bp, Zea mays
  Clone ID: LIB3060-058-P1-N6-A9
agggaggaattgtacattgatttaccatgtgcaatacagtttccggtctcaataagatcaatactagtttgttgttacaggcagcaggctggccatgcatgaatcatgaccgatgcaacgcttcaggttcctttacaacacgcatgcatctagctttccacagcaaacaactggcggcggcggcggcagcagcaggtatgctgatgcaccacgttctagtggaacttgaggctggtgagcacgttgttgttgacggggtcggcgaggtggtcgagcaggttctggaacgggccgacgccggtgacgagcccctggatgaagtaaccgaggatggcgagcatggcgagcctgccgttcttgatctccttgagcttgagctcattcatctccttctcggtcttgccgaagccgagcgggttgaagaggggcccgccggggtaggacgggtcgccggagccggcgaggaacttctcgaggccgaggaagtactgcttgcccatggagcccgggttgtaccagtcctgga

SEQ ID NO: 38577 - DNA, 502 bp, Zea mays
  Clone ID: LIB3060-058-P1-N6-B1
tttttgaacagaccaaccttagatagactgtgcatatggttgtgtaaagcattgttttgaactacacgcttacagaatagaatttgaaatagaatatgatagctgcttgagacagctttatagataacaagaccagagaccagacgcacccatgacaatatacccagctaatctattactatgttggctcatcgatccaacaccttttttttcgtcgtcgtcgtaatcatcttcacacgcacccacgcacacacaccatcgttttattcatccggatccattgctttagttcagaagttggggcctgctgcgaggatctcgtcagtcaggctgctgtcgtccccgatcttgtagctggcgaacacctcgaagttcttcttgaagagcccgccgagcctcaggagattctccttgtacgcggccttgtccgtccaggtgttgatcgggtcgaggatttccgacggcacgccgttgatctcagtggggatctccaggccaaaca

SEQ ID NO: 38578 - DNA, 581 bp, Zea mays
  Clone ID: LIB3060-058-P1-N6-B10
agcagtaacgcgttcttcattttgtatggaattacaaactacacatctgctaacaaactatagggaatatatacagcaacgaccaatacaattgccaaataactttccgactataatatgtacaccggaaattgggcatagctatgtaatctggaacggtggaacagctataatagtggttcaagaactaggacccccctgaggactggtaatgtaaaccagttcgttgcggtggagcggctgaaatatttcgcctcaccttatgattcttaggcgctaaaacccttgtggatagaactccaggggttggaaggaatgctggtgcaagcctgagcagcgaccttcgacactgcttcaggaaggatgccagcgttgcagatgtttgcgaaggaccgcatgtgcttcatcccatactgcgccaacgacccacattgcgcctcaaaagtacgaaccgtggacttgagacagctccaatcatcgaccagaggctcaccagctgcacggacggctttcagaacccttggaccgtcctcagagccaaagagaaggcttccaatgagctcaacgctgctgtcaacatg

SEQ ID NO: 38579 - DNA, 364 bp, Zea mays
  Clone ID: LIB3060-058-P1-N6-B11
ggacaagaactgtttttacaagacaacccaaaaacattctttttggcccaaaataaataaatttctaaaagttattttaaataaaactatttttaagtttgaccaaattcataaaaagagcatggcactgaattagtgtcactaatgcaccataaaatatttttcataatgtactcatttggggtcatagagacatagacgatggggcctttcctataaaattggtcaaacttaagataatttgactttaagggattctaaaaattgacttattttgagacggagcatattactataagaaagaaaagcttaagcagtataactacttcacggttcagcttaaacgatcatggactcgggattt

SEQ ID NO: 38580 - DNA, 541 bp, Zea mays
  Clone ID: LIB3060-058-P1-N6-B12
atagctgagttgtttttctgttttttaatagttttttttttattgaattattaaaagttttggcgcggggagtgaacccagggaaggccggaccggcaccggaaggcggaccagctcccccggggggggggggtattaaagaagggaaaaaaaatggacataggggaaaacagggggaaaggggcagccggggaaaaatccaaaaaacaaaccaacccgaaacaaaaagcgaaaagccaggggagggaaaaaagggagggaacccaaatgaagggggtaacgcacactggccgggaaaaagtgggggaacccctcacgccaggtaaattaatgaaaccgccaaaattaagggagaggccgttccgcgatggggcgccaagaaagttttttttggcaggggggagacgggcaataactgagggacccccaccggctggcccccatagaatggcaggaaccggaccacgcggggaaggccgatcaagctagaatgccggagggggggggaaaacggaaaaatataacatgaccggttttttgg

SEQ ID NO: 38581 - DNA, 430 bp, Zea mays
  Clone ID: LIB3060-058-P1-N6-B2
agaggaatagtgcttgtaatttcatataccacataaatacaacacctaattaatacaggttatgacttattagtttatccttacaaatgctggatcattggagctaacaagcttagcttgagctgggttgtaacaaatcgagctaagatgctagcttaacttgggacaaaactaaaacaagttgaacgagctgactagccacgagtattttgtctcggggctcataaagaacctggccacatcagccctcgctacacaaaatcctgctggaaagaaaaggcgcgcatgtgcacgcacaccttgcttccggtggtgattttgcgatgccaatgcataggacgccgggcgaactgatcacaactgccaaggccatttatccgatccacccgcagatcagctactagcaaaaagctcacccaactggcattcg

SEQ ID NO: 38582 - DNA, 446 bp, Zea mays
  Clone ID: LIB3060-058-P1-N6-B3
gtactgcaaatgcgcatagtatccactcatttcatatagcaaagcaccccccaagcataatctcatctgagtgaactgaaacattgatacagacatataggtaaaacattggcatagatggcaaacaagtacttgagtgcctctcctattcctcatatcatcatcatatcatctaatgcagggcaagattgtctattttaacggccaatttacaaatgcgagcagcccttgctgtggcaggacccataagcacgcaaatcaccataacgcacctcaaatcatggtaaaagttgacgcaccaccaccttgcaggagatcgccacccccgtggtattgcactagtctgggagctgttttggacttttgccactgaccaccaatcaggcaaggtatttgtacgtattagcgttgtccttgtcgcgctccaagtagtcccttgtaatgag

SEQ ID NO: 38583 - DNA, 580 bp, Zea mays
  Clone ID: LIB3060-058-P1-N6-B6
aaaaatcaatgtcgaaatcagcattcatccgggagaactcagaggtcctgttgtgactcaaaaaaacaggatatggtacctagtactcacaattagttggaaacaaattctgccaaagagaaacaaatcttcggtagggaaacaaattctgccgaagagaaatgtgcaagagccaatgtaatgaaagacataaccgccttgaccagctacattcactcactccaattccttgagatatataaattacggttatcgacgtctgaagttcctcaaccatgatatggatagaagcagagaagaacctgacggggtggtatataaggagcgcagcacaatagcgagatggtcattacatgaggtttgaggagagtttgaggcactcgctctggcacctcttgaggcagacgtcgttccaattgggcacctggtgctggttgacgcagacggtgcgcgcgcaagcgtcggcgcatgcgtcgagttcagagacgccgcagacggtgacgcaggtctccggtatggggtccttggagaaggcccctaccttcttgagcatacgcttggaggtgcacacgcgctcgca

SEQ ID NO: 38584 - DNA, 387 bp, Zea mays
  Clone ID: LIB3060-058-P1-N6-B7
ttttcaaggaaaatctaagttttttacttagatgttatgcatcaattctaaatacaccttggcaaagggttttctaaagaatgtatttctatcattgcgtatttactgtgtttgataataacatactctgacacaagaaaacacaggatgaaattaatctaactgcgttaaatcttcaagatgcctgcaaaatctccctgatatcatacccttgcatctgaagaaaagttagcaacaatattactccagagttccagacagcgtgtattgcaataggagttagaaggttgcgagtttgagcatatgaaaatcctaagaccacaccaagcacgaaaagctgaggaaattctcctggtgtaaagtgagcaaaggcaaacactgcagcag

SEQ ID NO: 38585 - DNA, 504 bp, Zea mays
  Clone ID: LIB3060-058-P1-N6-B8
aacccaagggaattcgatcgattcatcattgaacaacaaggcaattaagataagacgctgctggcgtcgatcctcctctctgcttgccgcactcaggcgtccacgacctcgtcgtccttgtacgcaatcatcaactcctcgcgcaacggcggcgacatggtcccgtccacggcgttgggcctgcccagggccttgagcgccaggtgcgccgccttctggccggagatcatcatggcgccaaacgtggggcccatgctgggggcgccgtgaatctcggcgacctccattccggtgacgatcatgccgggaacgacctcgcgcgtgaggcgcacgatctggtgctcagcggagttcatgtcgagcgcatgaatccacggatcggcgctgatcatgccgatgtccgggagcctctcgactcctgtggcgcctaacggcccgtcgtggccgcaagagctgaccacgaccctgggcttcatgaattagacggctcctgcaggactgcct

SEQ ID NO: 38586 - DNA, 470 bp, Zea mays
  Clone ID: LIB3060-058-P1-N6-B9
aaaaacgggctaaacgggccggtaaacacgttttagtgcaaaaagcgggcttaacgggcttagagttaaacgggccgtgccggactagcccaccgtgcctagtttcctgtccgagcccggcccgggcctgcatagaaccgtgccgtgccggactcggatcgaggctaaacagtgggcttcgtgccgggctcgcgggcctcgtgccgggctcgcgggcctcgtgcttattggtcatctataactacatcaaacgggtgcaacagctgtagaacagtaaactaactcacagtaagaaattactgttcctactacaggacatactacatcaaactatagatataggccaccaaattgtattctttgactagcatacgctaagccccttgcgctcgatccatcagacggtctgtaggctgggctcggccgacttagcgcgggcgtcgagggccgcgagccactcgagcagcgcg

SEQ ID NO: 38587 - DNA, 542 bp, Zea mays
  Clone ID: LIB3060-058-P1-N6-C1
tttacgaacaatgaagcttatgcatattcagaaagttgaagggtatctcaaaacagaactttcaaaatcctaggtaacatgatttacattgctcccaaatgtagtgctctgcttattgcggtaatcagatgatgtacaccatctggttactctatgatgtagtctttatatgcataccaatatgccatggccctgacaccgtaatcatataattcaaaatctgaaacctgtacacccattcgtattcctttttttttccgttaggagtttcaagaaatcgatgctgagatggtacagataacaagatcatcataacagatcgtgcagaatcctaactctggtgaaacatcagccttccggggggaaaaatgaagtccattttcaactgtctgatatcgttctatgcaagtgttctcaaccatctgagtagcccaagaagaccagcatctagagccggagatttttgctctagtccaatatctgcagcgactcggtgagcgcacatgatccctgagaatgctacagctattacaccttgtccg

SEQ ID NO: 38588 - DNA, 422 bp, Zea mays
  Clone ID: LIB3060-058-P1-N6-C10
ccgaaacagcaagggagtgcacaaattggatatataattacatggatcaccaacaaactatccagatccttcttaccaggaactatgcagcaaacatagaccaaagtctctgttgcttggcatctcaaattctgatctatgatcacagaaggaataatctttggtatgtacaacttgtcagttcgatcaactcttatgtataccttcttccatttgatatgagaatgctcggtgaaaaactagagacgttttcctcaactagaacaattcatcattggacagtcatgcaactattgagatcaccaatcctggatccactctggagcagtgagatcatctgggtcttcaatcggcacggaaggagatgcggataagtcctcattaagagtttctatacagtagttgatgcgctcagtgatttc

SEQ ID NO: 38589 - DNA, 484 bp, Zea mays
  Clone ID: LIB3060-058-P1-N6-C2
agagtaaaaaagcgacagcccgaatttgcattaacaagtgcattacatacacgattcctcctgtgctctccaaagttttccatgggatacatacaccttcccaagatccatgacggcggtcggacacctagcagttagacactcgaatcactcgagctgagcgtaccagaccccctggatcttgacatccttgggcgccttggccccgaggtcggtgtcggacggctgcacgctctcgaagacgccgatgacctcgccggtctccgggttgctcttggtgacgctcaacgtgatgttgccggtggaggaggcggcgttcttgatgttctccttctggagctcctcctcgtcacctttgcccccggcggggagcgcgacggcgttgtcgtaaccggtggagccgccgcggcccttggggtcaaggaaggaggagccgcggtagctgggcacgaggaagggcccgccgaagctctcgggcttgccg

SEQ ID NO: 38590 - DNA, 382 bp, Zea mays
  Clone ID: LIB3060-058-P1-N6-C4
aaatacatgagcggtcatattattattcatcatataagatatagtagtacataaacagctcagcgttaggaatgaacagtggtagaaaatgatattggttattaaattcacattgggcgattgatcccggtatatatatatatatgtagatgcagaaaacagatagtactcgacgcattcaaattgctcgggtgcatatcggtaggtacgtagtagtatagtatagtatagtatatatatttatgataatgcaggagtcggcgggccggtagaattgccttagccctagtttttcactttttccatgtgaggaactctcctgagacaaagtcgtagtggccggcgatcagcttgagggtcccatttgcaagcccttccttga

SEQ ID NO: 38591 - DNA, 379 bp, Zea mays
  Clone ID: LIB3060-058-P1-N6-C5
taatgtaatccctgcacccagatataattttatcgtgacgtggtcacatggaagttgcaaccatggtgacgatacagtactcaaaacgtagtaatcagccgtcacaatgatgtggtcggaatctcagcagaaacaagccaccacaatacagaggcatcttcagattacatgacaatcacaaacataagatgcagtacaattcaagtatgatcgacttaacagtgttcaaatatagtttgaaaagcgcaaagtaaacaagacaccatcaccagtccaagcctctgaaaaaagtgtcgatgaggcccatcacactgaaaggtcttcggcagatcagatgagaagcttctcaatggagtccttgagaccctgtatctgcgga

SEQ ID NO: 38592 - DNA, 414 bp, Zea mays
  Clone ID: LIB3060-058-P1-N6-C8
aagctccaatctaacccacattcattcggatccactcaatataacgaccaacacaactggccatactagaccccaatgacgacgcaacacacccagccagacggccttcgcaaattcctcttgtccggccaaaggtctctggcattccaatactacagaaaagtcttcgggctataagtaaactgaaacggggaacacagcgacagagagagagagagaaactagggaaaacgctaacagctagccagctgctctccagcagcgacgagatggagccgcaacgctctagggcgccatgcctgcccagttccacagcctgccttggttggtcaccagttcccttgtacagcgattcggtcgagctctggggacgtcgaccgtcgctcgcggctagctatggagcatcggttgggc

SEQ ID NO: 38593 - DNA, 518 bp, Zea mays
  Clone ID: LIB3060-058-P1-N6-C9
gattgatttattttgttgttagctagctgattcacattggatcctaccaagttccgttcgttcagtatccacgacacgacggtgacgactactaacgctggcgctcctagagaggaacgacaactaggcgctgactgcggggccttgcgaacccatcctgctggaggactaccacctgatcgagagggtggcgcacttcgcgcggcagcgcataccggagcgcgccccgcacgcgcgcggggccttcggcaaaaactggggcgagcgcacccacgactttacatttttttacgtgcgccgtccccctgcgcgcgcccggggtgcggactctcgtgaacgttcgcttcgggacagaaaaccacgagcggtggtttttttatacgaaccaagaccggggcggaaatgggggggatttatagaggcccggggggaatttttaactccagggcaacagcttccctggggggggggtgctatacaaagggaccggccccccgggatccacttgggggagccca

SEQ ID NO: 38594 - DNA, 484 bp, Zea mays
  Clone ID: LIB3060-058-P1-N6-D10
aaacaagaccatccaatgggccgggatattaattaattattacaaaacagcatgcagattgagcgatgtttattattacaatatgtataatatgccaagattttccacttggacttgacaacaagattgaatctaaagagggaggaaattgcatatgcatagggaaaacagacgctggcattttggactttccatccaaaactgacaaaaccccaccatccggaagctgattattgctgcgcactctgcaggtgagtgaaaaaaacccgcctaaccagtgttctgcatgccgggggagatgcccttcatgggaaggatgagcgtgctttacaggccgggcggttactccctcgccgggttcaacttgaccagtccggcgggcttgttttcctcagaaaactccttggacagcggcggctggggcgtcaccttgaagttggggtcccttatccgcttcagcgtgtaggcctggaacaccttcagg

SEQ ID NO: 38595 - DNA, 529 bp, Zea mays
  Clone ID: LIB3060-058-P1-N6-D11
gcaaaaaaacacattaaatagtaaaattgttgcgcgtgacattgtaagggctttcgagtagtaccagtcgcactactagattgcataatagtctgcgtccttgaagaataaaagagtttgtttgatacagaaccccgcaaccgaaacctccagtgctgactagagccatttatgccatactcatgctctgctcactgacagtcgcctgcagcgaagcatcatggggtcgaggacaacttaaataactcatcggttgcatgacaggccaatcgatagagagcctgattgcgacaacatgctcacggttttttgctgtccaggcccagagaccttagatatgttcaatgagagaactgacactcagtacaagaggatacatgtaatcagtatgctgaagctgggctccttctaccactagcagcaaatcctgccaaaatcgaccagaaactgcctttttgaatctaattatacacttgccaccattctggttagcaggatcctcccagaggggacggatgccatccttgaa

SEQ ID NO: 38596 - DNA, 590 bp, Zea mays
  unsure at all n locations
  Clone ID: LIB3060-058-P1-N6-D2
ttatccagacctgaattcattacatctgtatgtaactatctctgttaatacatgccatcaccggtgaacaatccaacgaagaaggctaaaaaaatatccagatacgggtaccgaactaatgtcaccggggggtaagaagctacagcggaaccggaaagaaatgaaagcataggatacaacagcagcgaagcagcagctacagattatcacaaggaagctgctgaaacagattcagcccccacgcgtttctgagttaacaaggcaccagcacatggtgcccaatggcgtctcagctaaactcggttcttggacgaacaccacgacaatcagtgtttttgattatttggtaggtaccagaattgtaggtaggatttattcgcaggccaacttggtgtcgaagctgctcaggcagatggcgaaggcctggaaggctgacagcgggtagcagtagtccatggtgaagatgtccttgccgaccttcccaaactgcagtatgaccttctcttggtccggcggaggaggcggagctggctgcggngctgcctgtgatggggtcagggctccggcggcaggctgtgtcgccgcgacta

SEQ ID NO: 38597 - DNA, 390 bp, Zea mays
  Clone ID: LIB3060-058-P1-N6-D3
aaacaagtccataccaatagggctgggatattaattaattattaccaaacagcttgcaaattgcccgatgtttattatcacaatctggttaatatcccaagattttccacttggacttgacaacaagattgaatataaagaggcaggaaattacatatgcctagggaaaacagaccctgccagttcggcattttcatccaaaactgacaaaaccccaccatccggaagctgattattgcggtgcactctgcaggtgagtgaatagaagccgcctatccagtgttctgcatgccggcggctatgccctttatggtgaggattaccgtgtcttccaggccgggcgggtactcgctcggcgggttcagcttgaccagtccggtgggcttgttc

SEQ ID NO: 38598 - DNA, 400 bp, Zea mays
  unsure at all n locations
  Clone ID: LIB3060-058-P1-N6-D4
cttaaaataactgaaatgacctggncacccatttttttccttttgtgtttgctcaatttttcctctgttctccatgtaagtcacttgtcacccacaggccacaggtgctgctgatgcagcatcgaaaacatacagagggtgagagggagggagacggtgtcagcagcgcccaagtcccggagtcaaacagcacagaatggcgtcagtcgattgaggccttggcttgacgtgcgtaggtgttcagaccttgccgttgttgtggtcgtcgatgttcctgacggggcctttgaaccacttgcgcgcgtcgagcagccaccagagcatgatgaggccggggcagacgccgagcgcgatgggcggctacccggtgcccatcttcacccgcatggtgatgcgggag

SEQ ID NO: 38599 - DNA, 334 bp, Zea mays
  Clone ID: LIB3060-058-P1-N6-D7
aacccaagggaattcgatcgattcatcattgaacaacaaggcaattaagataagacgctgctggcgtcgatcctcctctctgcttgccgcactcaggcgtccacgacctcgtcgtccttgtacgcaatcatcaactcctcgcgcaacggcggcgacatggtcccgtccacggcgttgggcctgcccagggccttgagcgccaggtgcgccgccttctggccggagatcatcatggcgccaaacgtgcggcccatgctgggggacgcctcaatctctgcgacctccatttacgagactatcatgaccggaacgaccttgcgcgtgaggcgcacca

SEQ ID NO: 38600 - DNA, 422 bp, Zea mays
  Clone ID: LIB3060-058-P1-N6-D8
atctccatttttactctatgctattcttttttactttttgtgggggaaatggaggccgtcttcgtcgccgatgacgaagctagccctgattccaaaaaaaacggtacccggcgcctgatacgggccagtataggtctcccgttcccagctcccaaagacccggggaaagcggtgaccgcccgtacaaaaagccggggaggggggtccctcgaataaccggcccctacggagcctgtccttggcctgcgctatgggcccaaccgtgcccctccggagaccgcctcccccaaggggagcgaatagccactcgaccgaggaagcaccctgctgggcccaccagagaccccacccgtgggtgcaaccctcaacggccagaggcagtggccttctctttcccaggaacacccggttgagcctttttt

SEQ ID NO: 38601 - DNA, 521 bp, Zea mays
  Clone ID: LIB3060-058-P1-N6-D9
tgaaatcgctagacttctgtaacatgtagttatttatgaaggacgagtgaaatgtttccgatgtgtcggctaaactatcgaatcaccatccggttcgccatatggatggatggcttttgtcgccatcattcatctactgaaataagataggtctaaggagagagatatgtcaatcagccagctgaaaagggttcaagcagggattacaattctcctggtccagagagcaatgacatgataccaaacagcaggaagagaactccgcttgacagttcgaccatcttctcggatatctgggaagctaggctctttccaccaagaacagcagcagtagtgcagagtgcttgcgctatgattccgcccaggacaacaccaaatgggttttcatcagcagccaagccaatagtagcaatctggctcttgtcaccccactcaccaaagaatgtaatagaaaatgcctttatgaaaattggtgagaagaattgcatgagaaatggtctttgctgtttcttcgtatcatc

SEQ ID NO: 38602 - DNA, 573 bp, Zea mays
  Clone ID: LIB3060-058-P1-N6-E1
aaaaatcaagaggtaaaacaactattattttgaaacggaaggagtagaaccctgaccagtttataaagatgatgcatatatttccatcacatagctctgcagaaaaaattacagagcatgcatgcaaatatgccaaatgagaaacatcaccgtctaacattgtgctggtttatttaggctaaaaataatattaacaaagaagtctgccttcttctctacaagctgaaacttggcccaaaacgaacaagcctgaactccttccacaccacaatccgcagacagcacaagcattgccccgaccgggtatccacatgtgagcttcggcaatgggccttaagctaaacatagtagatcatgccgacttctatcatactaatgtgtggaatgtgcagcgtgactgatgggcctctgcagttcttccggaggaaagagtaaccaacatcaatagcaaacttcttcaggaaatttgagttcctcctggctttgatataagaatgccccatgatgtatgcgatcccagcatgtttcgcttcaactagtgccgtgagttcttctttcacttgctgacccatg

SEQ ID NO: 38603 - DNA, 485 bp, Zea mays
  Clone ID: LIB3060-058-P1-N6-E10
aaaaggagcttgaatttcagctcagactatatattctcaatgcatgagaaatatattacagctttgaagaatctatatctactaattattgaatagacagatactcctatgtattagaagaatatacattggctgaacactatatataccaattgctgaaagatgttgcacaacatttggatcacaaactcaacacatggtgtgagggtacgagcattactgtgcccctcgtagattagttggctccatttaaatcaagttctaaatttggtactggtgtttatatttctcatgcattgagaaccgtctgcagagctaaaattgaagctccttttatatttatgtaatcataaatggaatcggaggttctcctagacactagacagagatagatagagaaccatgcatgtctcacgtcactcatccctgctgccaagaacaaggtcgttgttgtcgtcgtcgtccggcagtggcagtggcacgga

SEQ ID NO: 38604 - DNA, 451 bp, Zea mays
  Clone ID: LIB3060-058-P1-N6-E11
atgttgttgtgaggagtgctagaggaggctagtgtgttcaaacaccatagggaggggagggcaggcgaaggagcgaggaaaaaaccccataaaggagacccggaaaagataaagaagagggggaaggaacaagggcgcttggaggcggagaaaaaccttcgggcgtgggagctcgagcggggtctggaggccggaggaaaccaggggggcgccaaaaaaagcgggggggggcgatcctagcccctttggggctaatccaaacccccaattggaacacaaaattgtgggaaaaaacccctctgttgctgggacaacccacccgtgtcaaagaaatttttgaccacgaaaaaaaaaaagagttggggagctgcaacagggcctctaaaattgttaaacacccccccagggtgaaatgaccgggtcccctcaagcctgtattttttcccccaaa

SEQ ID NO: 38605 - DNA, 535 bp, Zea mays
  Clone ID: LIB3060-058-P1-N6-E12
atataatcgataattgatgatgtattgaagaacagagttttgaaccatggagcagtttggaagttttacatgactggggaaaaaaaaggacatgggattgtagcttttatgagcactgctactagtaatgttcacatagcatggctctggaataatactgttgatcaccacatccaccagcagtaggcaatccggttgccaatgaggaggcagcctcagacaagcacctgagctgcagctagcctagcaatcggaaccctgaaaggggagcaagaaacgtaatccagcccagcctttgggaagaaggccacaaaggaaggctttccaccgtgttttccacaaatgcccaccttcaagttaggcctagctttgcggcccctctttgtagcaagcttaaccagcttgcccactcccctttggtccaggacctagaaggggtcatgttggataatgccctgagcaagatagacgggaatgaacttttccacattatccctgctgtacccaaaggtcatctgcgtcaggtcgttcgttc

SEQ ID NO: 38606 - DNA, 561 bp, Zea mays
  Clone ID: LIB3060-058-P1-N6-E2
agggaggaattgtacattgatttaccatgtgcaatacagtttccggtctcaataagatcaatactagtttgttgttacaggcagcaggctggccatgcatgaatcatgaccgatgcaacgcttcaggttcctttacaacacgcatgcatctagctttgcacagcaaacaactggcggcggcggcggcagcagcaggtatgctgatgcaccacgttctagtggaacttgaggctggtgagcacgttgttgttgacggggtcggcgaggtggtcgagcaggttctggaacgggccgacgccggtgacgagcccctggatgaagtaaccgaggatggcgagcatggcgagcctgccgttcttgatctccttgagcttgagctcattcatctccttctcggtcttgccgaagccgagcgggttgaagaggggcccgccggggtaggacgggtcgccggagccggcgaggaacttctcgaggccgaggaagtactgcttgcccatggagcccgggttgtaccagtcctggaggcggcggtgctcggcgaagcccatgagcgccatg

SEQ ID NO: 38607 - DNA, 402 bp, Zea mays
  Clone ID: LIB3060-058-P1-N6-E3
gggaaactcaccctcatttttttataaacaattaatgttccttgttccctaccaaggaaggtggcgggcaccaacatgatcatcctaacatgacggggggggaacattttcaagacgattttttttaaatcgggaagaacaatcaatttgaacccaaattaggtaaaagggggtccttttccctttttggtggggggcttactttgaaccgtaaaaaaacccgtgcattttaacatcccctttaatttggcagaggtctaactcaaagccattttgatcatggatgccgagttgtgtgaaacaaaaccgcctttatttactaaaaggctattttttttacctcaatctactaaaaggcaaactgttaatttaagtgcaaaaaataagggcaaaatgaaaagc

SEQ ID NO: 38608 - DNA, 488 bp, Zea mays
  Clone ID: LIB3060-058-P1-N6-E4
ctataataaatatatttatctatttgattattattatttttcttctatcaattttgggctttaccataacactaggttagtgtttgttagatagacgatcacttgacgaccatctttatcctggcacttgattggtccatctctcattaggttgattcgccatcattgattcttagagtagttcatcctttcatcctcttgggtcgacatggttcttctcctccgcaacacgtgatcagctagcgtacctatccgcgcggaccgccggtgacgctttgacgagaccgacagtctgggcacatcggcatacggagacgtagacctggtcatgatgaggaggagtagataagcagggacgagcttaggcgaccgtcgaggaaagtcagttgaacacgtatggccgcgagtcctgctgagacgagagtggctcgaggagatgacgacacaggccaagcgcggcgaacagcagcgcgcacctaaggcgtgat

SEQ ID NO: 38609 - DNA, 452 bp, Zea mays
  Clone ID: LIB3060-058-P1-N6-E5
agattttctttttatgtgttctttctttatgtttactctttttcctgttttttattgttttcgaaacaggaccacccaagggggcgggattttatgtcattgttacaaaacacggtgcaacttaggccctgtttattactacaaaaggacataatctgccaagattttccacttggacttgacaacagtagtgactatagaaggggccggaaatcccttctgccttgggaaaacagccgctgccagttcggcttttccatccaaaactgacaaaaccccaccctccggaagctgattattgcggggccctctgcaggtgagtgaaaaaaaaccccctacccagtgttttgcatgccggcgggaatccccttcatggggaggataagcgtgtcttccaagccgggcgggtacccgctcggcgggttcaattttaccaacccgggggggttttt

SEQ ID NO: 38610 - DNA, 492 bp, Zea mays
  Clone ID: LIB3060-058-P1-N6-E6
tctagagcggccgcccctacgcgttcggctccttcattatattggaatcttcccttactctggtcttaaattctacttctacgagaagatgaagagccacgttcctgaagagcacagaaaaggtatcatagcaaagctcggttgcggatcagaggcaggtttgctaggtgagacaataacataccccctagatggggggaggcgacaaatgcaggttcaagccctttcgtcatccagcctcgcgggtaggggaacatttgaaagcctggccatgatagcgaaacagcaaggctggcgacaactcctctcaggatgatctatcaactatttaaaggcggcgcgctcagtagccataggatctactgtttacgactcgatgaaggtctgtctaaaaggggcgtcgagggaggaaactgctgctgctgtctaggcagaggagcgaagcatttcagctcctatcccctccagttaggcaggagtgtaggatagcat

SEQ ID NO: 38611 - DNA, 462 bp, Zea mays
  Clone ID: LIB3060-058-P1-N6-E7
atatttttttctttttttttttttggttttatttttgctttctttttttcctttcttttttttcttaatgggaaactcaccctcattatttaataaacaaaaaatgttccttgtccccaacaaaaaaaaatggcgggcaccaaaatgatcaacccaacaagacggggggggaacatttccaagacgactctcatgaaatcgggaaaaacaatcaatttgaacccaaattaggtaaaagggggcccccctccctttttgggggggggcttactttgaaccgaaaaaaaacaccggcaatttaacatcccctttaatttggcagagggctaacccaaaacaattttgaacatggatcccgaattgtgtcaaataaaaccgcctttatttaccaaaaagctattttttttaccccaatttactaaaagacaaacctggaattgacgtgcaaaaaaaaagggccaa

SEQ ID NO: 38612 - DNA, 452 bp, Zea mays
  Clone ID: LIB3060-058-P1-N6-E8
gttataattaatacactccgagcaactctattattatatgtattattacaaggcacaatggcacatacatacagtgatacagctgcaatatacatgaacaccctttgtctcgctcctgctttatctatgcaactgctggcatgcatgcaaaagacgcctcgggagataagacccctgttattctgctagtacgtatgcatgcatgtgcacgatcgatgggcgcgatggtcatatcatccgttggttcagtagtagggctggatcttccagcgctggttgtcgccctcgcaccacttccagagcacgacgttggtgccgtcacggacgccgccgtgccacttgtcgccgtggagggcgtcgaagttgaggtagattgtgttgaccatgcggacgcagcggaaaccgttgccgacgtcgcgggtttccgtccacagcaccgactcgtccaaaaa

SEQ ID NO: 38613 - DNA, 433 bp, Zea mays
  Clone ID: LIB3060-058-P1-N6-F1
gtaacctacggcgcagacatgaaaattcacaggcaaacttggcacatgacaggcatgttcaaggaccaagggacacatgcttaaataacatagtgtggagactttgtttaaaagtccaacccaccacaaccttttttaccaacctactgagcacaccaccaacttacacaacttatccagcgttcgtacatgatattagtaagaacataaaatctttcctaggccacaacttaataaatagctaacccagttttcctgaccaacacgacaaaagcctttcttggggaaccatttgatatttacaagaaagcaaaatggttggccaggaagacataaacatatttaacaagtccgatgaagttttctgatccaacagaagggttctccttagttgcctgcgtgaatagcaaaccaccagcagcaaccttaataa

SEQ ID NO: 38614 - DNA, 457 bp, Zea mays
  Clone ID: LIB3060-058-P1-N6-F11
gtttgcaaactaaaatgacagtttcaatagtacatatgcatataaccattgggaaatctacaagggcacgggacgctgatattatattgtttgcaaagcaaatggacatggagatggccgaagagagcatggaaccaaagaatcaagagtacaaataatctagtgctaaaacaaaatccatgctcatgtcctgcggagaaagtataatgcagctatgacccatctcaatgccagagcgaataatacaatcagaagatcagaatgtgccacttatttacatacatcgctccaaatacagtggcatgtgagtaccttctaattgattcccacacaataaactgaagcttattgcatgtgtgccgtcaggttgaggaccatgtagggaaggatgcctacatggttgaagtatgtgacctcaaactgtgtgtccaagctaagagtgcatgtgaatgatctt

SEQ ID NO: 38615 - DNA, 610 bp, Zea mays
  Clone ID: LIB3060-058-P1-N6-F12
taaccctctcctgacctctcccgccatgcatgagggatgacagcgaatcgattctaattaaagttggatttccttcctatgctgcgttccacaacgttcaagagaatgaatatataagcaatgtgcattccaaaagaatcctgagctaaaaacgggtcaggactcgctcccaggctggtggccatcggaatcaggctgcttcctgtagccgccgtcgccgtcgttctggtcgttctgttcgttcatatcaggaagcgaatcactactggcagcccccagcttttcctttagggaagcgttctgtgaaagtagctgttcgtactcctttctgatccgctcgagctcggccctaagcgaggagttctccgacctcagagcctcagcacgttgcccaagctcctcgcactcagcctgtttgcgcagccgggatctgcgagcggactctctgttggattgcttccgcttctgcttcttgagctccctttcatcccattggtctcctcgagctgaaccagctggcgctttgccgtgcgctgcggggacagccgcataacccggagctgcccagtagtccactccgatattcaggttagctgccgtggagctagga

SEQ ID NO: 38616 - DNA, 496 bp, Zea mays
  Clone ID: LIB3060-058-P1-N6-F2
tttttcttcttttttttcttaaaaggagcttgaatttcagctcagactatatattctcaatgcatgagaaatatattacagctttgaagaatctatatctactaattattgaatagacagatactcctatgtattagaagaatatacattggctgaacactatatataccaattgctgaaagatgttgcacaacatttggatcacaaactcaacacatggtgtgagggtacgagcattactgtgcccctcgtagattagttggctccatttaaatcaagttctaaatgtggtactggtgtttatatttctcatgcattgagaaccgtctgcagagctaaaattgaagctccttttatatttatgtaatcataaatggaatcggaggttctcctagacactagacagagatagatagagaaccctgcatgtctcacgtcactcatccctgctgccaagacaaggtcgttgttgtcgtcgtcgtccggcagtggcagt

SEQ ID NO: 38617 - DNA, 497 bp, Zea mays
  Clone ID: LIB3060-058-P1-N6-F3
gatttagacagaagcaacaaggttctcactgatgacgatggttactgctacatggtaataacaatcattaaatagaaaacagagaccataagagcagagcggaataatcccttgagagtcacgacatgattacattgcaggggaacgaaaccaaaccaaatctcacgcacgcgcgcaacgcagcatctgctgaaacaaaaaaaaggcgacccgaaccaaccaccggcacccaagtcgatcgatgaatgatggcattctcctcgctcacggccccccgcccgtaggtcgcccgccattgctccacagccaagccccgctcatcacgcgttgctcctgaaggagccgagggccttgatggcgccagcccggaggatgtacttggtggtagaaggccgcgatggcagcgcccacgagagggcccacccagaagatccagtgggtcgtcccagggcttgtccttggtgtagatgacggcggcgcccaggctcctggccggg

SEQ ID NO: 38618 - DNA, 469 bp, Zea mays
  Clone ID: LIB3060-058-P1-N6-F5
ggccggcgcccagcgtctcgatgatgttctgcacgctccccttgacgccgtcgaacgccgcaggaggcgaggtacgcgtggagctcgccgtagatgtccccgccacccggcgcgggtgcaccaggcccagccccaggacggaccgcgagtccatgacgatgtccggctggttgcccgtcacgcccggggacctgcacggggtaccgccagcgccggctcgtagcgctccatcgccggccccgccgtcggcgtcacgccgccccagtacccggccatggcgtgccacacgtacacctgcttcacgccgtgcgcgtccttggtctcggccaccagtcgcttcagcccgcccgccgcctgctcgccgtcgccgtctccgtcaggcttggtctggaacttggtgttctccctgatcccggtcagccggctggcgaattgcgcgccctcctggacggcgacgttggggtcgggc

SEQ ID NO: 38619 - DNA, 347 bp, Zea mays
  Clone ID: LIB3060-058-P1-N6-F6
agaggaagagcacttgtaatttcatatgccacataaatacaacacctaattaatacaggctatgacttattagtttatccttacaaatgctggatcattggagctaacaagcttagcttgagctgggttgtaacaaatcgagctaagatgctagcttaacttgggacaaaactaaaacaagttgaacgagctgactagccacgagtattttgtctcgggggtgataaagaacctggccacatcagacctcgctacacaaaatcctagtggaaagaaaaggcgcgcatgtgcacgcacaccttgcttccggttgtgattttgcgatgccaatgcgttggacgccgggc

SEQ ID NO: 38620 - DNA, 409 bp, Zea mays
  Clone ID: LIB3060-058-P1-N6-F7
ggacagggaacgcatgcttctatatatcttgaggtggggttttcaatggggctactgccttgggtaccacccaaccagggagtgatatctaactgcctcctagataataatcattcgggactgataaaaaaagaatgtcaggatgcccccctcctcctccctttatacactgaaaaagcgaggcccatcgaagtacctcctaatcagatgactgactgattatgtgtgcatgattgaggagttactaactatgggagcatataggctataaggctcctgcttgctcctactgcaggatgggatccatggatgggtggttcatttgctggtgtcgagtgacccagcgtacccttacggttttttgctcgcccagttccacatatctatgcacatttcctagatcccgaac

SEQ ID NO: 38621 - DNA, 432 bp, Zea mays
  Clone ID: LIB3060-058-P1-N6-F8
aagaaagtagtatagatttcctaccgttcaccaccgtacaaaatttgtgacaagcgtcataactttaattacagcaggattaccgtacaaaatttcctactatgacacctttgaccacctgcaggtccctccaatggccttcctcctccatccaagtacactaacacaagtgagccttggttaggtttctttgtagattttgtttctcttcaaatgaaaggaagcctacgtcgcatgacttgacaagtccgcgtgttagcagccttcatgtaagccactgtccaaattttgcagcgcattaatattggccaaggaaaggctcaagctagtgtaacctttttgccttttgactctcttgcctttgtcgaaatagacttcctggatgacacgaattcaccaaactccctatcataccgcatcttctcgtctgct

SEQ ID NO: 38622 - DNA, 500 bp, Zea mays
  Clone ID: LIB3060-058-P1-N6-F9
gttgcagcggaaatcttactaccaaattttacaggttacaaaaattttacattagtttatcggagtgattacaaaagtataagtttgaaatatatgctagctcaagggatcatcctcaataagaagtatagaagggttacttagacttataagaaggccgagcccaccggcacttaacaccatcaacaatagcacaaagttagaacctgaaaaacaacagggaataaaaccctgagtatggaattactcagcaagacttacccgactaaagaaaaagactctcaagggtatgctggcttaagggagtcaaggtatggcttatcaagaatcaaagactctgttttgcagaaaagcttactacgagtggatccttaaaatccaattttattgtcaggttaagtaaaattacctgcagctagagttctttctaccctagttcaatcactggtcctacactagccaatttctcaacaaaaccctttatctttagtggaatgcta

SEQ ID NO: 38623 - DNA, 612 bp, Zea mays
  Clone ID: LIB3060-058-P1-N6-G11
gaagtaagagacgtccatataacgagagaaataactctactctgacgccaaacagaaatggacatttgtaatttcatttttttagaaaacaaatataatacgcattatcaattgagctggacagcactactgtcgcatgctttacatcaagtcagactaatatgggttctggtagctagcctaatgtacaatgaagccacagatgggttagtcaaaaaaatagcaataatcttcacgcatggcacggcacggcagtgtgtaggatggagaagctggcgagtaggacaacaactgccatctgaaatgtaatcaccagcttggaagaagaggagtacgtcggcgatgggctgaaggacgctccgttgaagccgaggctgtacaccggcgtgccgttggggtaaaacaagccgtagttcctctccgacgttgccccgggcttcatgtcctcgttgaagagcgcgaacacgaagacgtcgacgggcacgtgcggcttgagcggcgtgccctggcccatggcgatcctcttcatgaggttcccgttgtacgcggcggcgttggccacggtggcgcccacctcgtcctcgtcccctctggacggccacccggtctcgg

SEQ ID NO: 38624 - DNA, 606 bp, Zea mays
  Clone ID: LIB3060-058-P1-N6-G12
ggcaaaaacaagtgtttggaaatagaaggatgccagcatgccacagtggcattcagaatcaatagcttacaacatcacttctcccaacataacaaaaagccatgaaattatactattatggcatcacatcagttttttctttttattaatcagctagtatattcccacggactccgaacataaactagcagaacatagaagacagcaaccacacaagtttgatgccaaacagttcgcacaacggggtagggcgcgcagatggagctttgcttgacaaagcaccactcgagagcatttttggtccctcgccaaattgaaaatccctagccctagtacaggtcgccttccttgtgggtgtggatgacgcagtcggactttgggtaggagacgcatgtcagcacataaccttcctcctgctgcccgtcatcaaggaaggacccatccgactggtcaaccgaaccagactcgattttgccggcacaggtggagcaagccccagcacggcacgagtatggcaactccacaccggcagtctcggctgcgtcaaggatgtaggcgtcgtctggagcatcaaactcgtgctcttcaccttcaggcccgacaagc

SEQ ID NO: 38625 - DNA, 418 bp, Zea mays
  Clone ID: LIB3060-058-P1-N6-G3
aatattgacatttcgaatttattactttcaaaattaataaatacaatttttacgtatcatttatgtagcgtcaaatgagaagaaaacaaagaaaaatgaaaaagaaatggaaaatgtgaatctgttaacactgtagctttaggggacggaatttagaggacgctgctggagccggagaatatatagaggacagaatcttttagagtgttctgtaaaggacagagaatattcctttaggggacgaaatttaggggacgctgctggagaaagcctaaaacatacctgtctgtatttagggtccgaaagagtacacgtcgaacacctttaggaatgtttagggatgccataacatcagctgtgatgttcttatctctgggaacgtcaaccaacagcgctggtccgttgaggacagcgaggt

SEQ ID NO: 38626 - DNA, 564 bp, Zea mays
  unsure at all n locations
  Clone ID: LIB3060-058-P1-N6-G5
atggcaattttgatatataggccgaccctgagagttcttctttggcacactttgtgtagttttttttttgtacagccttgttctgctagtcttggctcaccttgtttttaatttaacaggcagctagcccttctaccttgtttctttcaaaaaaaaaaaaaacatcgacaaaaactttgcatgcccagctatatatcgcgcttggccagatcccgtattgtagtacgtacaaattaagagtaatacatggatcagggataataaaaatggcaagtttagaagatgtagtggcagagctgccatgatcgcccctcgctgttcgttagctccaatgcattttggtggcgccctcctcgatcctatgccggcctcgcgcctagctagcaatagcaagagttgctttctacttgaagaaggagccagtcttcatggcgtcctcgttggcttcaccaagagcagcctcgttgaggtacttgtcagcaagctgcacacgcttgacgttctcctgctccgccaccagcatgtgtccgtactccaagagcttntagatcgttatcttgggct

SEQ ID NO: 38627 - DNA, 583 bp, Zea mays
  Clone ID: LIB3060-058-P1-N6-G7
ggccacaacatgacgaaaattaaagtaggtaaattttgactagcttaggtgtgatcgacaattaatacaaaattgtcaagcagttttatactactgcgcgcgctgcatcatcgttggtttctatggagaggcagcagaacaccgtggctgccaccatggagaacagctgcgcaccaaccgagggaagaccagatccgaaaactacgcccatgaaccagcacacgccctggctccactgcctccacatcgccgggccgtggagagaaaacctgaccgccatgtcctgtccgtagtagagggagtactcgtccgccgggtacatgtacgagaacgcgtacacgggggctgggtagatgaaagcaggcaggatgttgacgacgaacacgagcacggcagcctccttcccccttgctctcaagagccgccacgcccggcggagcgcccagacgccgtggcagcctctgtccaccgccgacacgccgacgctgaccgggatcaccgtggcgaggtagatgtagacgagaagcgccaccgagaacatcgagtagccacacacagactttacgatcgagtcgtcagcgta

SEQ ID NO: 38628 - DNA, 555 bp, Zea mays
  unsure at all n locations
  Clone ID: LIB3060-058-P1-N6-G8
gctgttagtgttagggagcacaaactccccatctccgccactactgaagcccttgtacccctaaccgacgccgctgctgctagggagcttgcacccgcgcgcctacaacgagagctagcagcagtagcggtcgttatcttgtcgctcctgctccgtttgtttacccaagtcccagcctagatgccgcagatggatgtgcccactaatcagatccccgcaggctggttcactgagccggcttccgagcggcccatgggcttgcccaggaccggctcttccagtcgcctcaacgcgcatgcgccggagttcgtgccgcggggcccgccaccaccgacgccggcggttgtgctgccgcctccgccgcaggtgatccgcatgttcgccacgccttccccgccgncgcgtgggggcttcttctccgtgccgccgccccggccgnttgagtactatgcgcctatggtgaacgcagcggatttgctgccaaggagcaacatgcgcgggagccggaagcggatatgctcccgcccgccgcggtgaagacggagctggtgtatc

SEQ ID NO: 38629 - DNA, 547 bp, Zea mays
  Clone ID: LIB3060-058-P1-N6-G9
caaccaaaacaagtaaaagctttacttcagtcaggatgcaaatgcaatggagttacaagctaggcaagttcacaggttttactataaacagaaataagttagacatttagtataagaaacatgtacattacaagaaactagcttcgctcggcgcaaacatcttcatcatacactgatacaatcgggctggctcttctgcagtctatcaattggggccccaacgtatattgtcccagaggaaaggcttcatacaaccaacttgtggcaggctcttcatgatcaatcccacacatacgcagacggcagcaatggagaccaaggaaagcatcgcagtcctattagacagaaacctatttgtccggggatggaatgcaagctgctgggcctgctggacacactgtctgcagctcaatgtttggttgatgcttagttgttttttctcaacaccaaatgtgatttgatcggcaggcttcattcggctaccatgctttccgacagtatcaattgtgctggggatggtaaccgagacatgagctctggtcaccct

SEQ ID NO: 38630 - DNA, 558 bp, Zea mays
  Clone ID: LIB3060-058-P1-N6-H1
ccttccgcaatgcaaataatatcagtaatgaatatacgacaacaatgtatctagtttcacgcagaccacctccatgcgaaacatcgacccactcgatatcgtgcaaaatcccagttccagctttccctcgtaccaatatgtgaaaaagaaaacaaaggtaaaagtgggcaagccaaaaacaaccacacccaagcagccccactgtatagaaaaaggactattaccaaactggttatcggccctgacaaaaagtgtcaggtgatatcaaccaggaccacgccctcgacatcaagaccgccctaagccactcccacatgtcttggcctgcttggggctatagaatctactggagcgcacacgtaaaaaacagctgatggaccacaactgagctccaagcaatcagattacaaggcacacggacagagtcattgctgatcatcatactatctgggaggtttcttgcggctaaggatctcttgctctttgagccggtgctggaaccgtgccaagcgtgcttggaggctgaccaagcctgcacccttgcgtgacagcagaaag

SEQ ID NO: 38631 - DNA, 582 bp, Zea mays
  Clone ID: LIB3060-058-P1-N6-H10
aaaataatttctatgtaactttattgatcacgtaaactgcatgcacacgtctcaaattccgcgttttctctctgtctctctctctaataaaaagaggacattgaacatgcttagttattacattcgaggggtaatagtgccttctttcctgatatatcatatcatatcatggtcgatagataatttcttattctgatacgacggcaattcattacaagcggccggccggcaggggcaaaccctggtgtggtggtgtctacaggacgaactgcttgcggtaaatgtcaaacgtctccgaagaggacaggttaggctcctgcacgccgctgaagttggcgacggtgcggatgggtgcgccgatggccccctgcagatcgcagcccccgccgcggttcttcatgatggccctcatggagctgagcaggtggccgtaggtgaccccgcgcggctggcactccagcgtccggacgaagctgtgcgtcatggccccgacgaccgacgcgtgggcgtcgggcatcatggcgaagttgcctttgccctcgctgtatccgctgatgagcacggcgtggcctccgctggtgc

SEQ ID NO: 38632 - DNA, 584 bp, Zea mays
  Clone ID: LIB3060-058-P1-N6-H11
aatgaaacaccgacgttttctctattgccaattttcaatacaagaaaattcagatccaaggagaaaatttacaacaaaaaaccaatcagctagtacttcagtaacatcagacggcaggtaggccacggcgtcacgctgcctttaggcatcgcgtcatctagcggatttccccattcgctattgtctgtaccttgcagactccagccgaagtcatgaaggggacatcttggtagcaggccacaagggcgccattgctacgcaggtcagccgctagcttctcccacaccttgctcttgccactgagagaagcctcggtctcaccggagtgcccggcaaaggtcaccctctcccccacggaagcatccgttggtggctcgaccagatcaaccctagtatggtcctcattagaagcagccaaaaccatggcatccgattttataccacgcattaccaccggtttcagatcgcagagaacacagactttccggctctgtatttcttcaagaggaatgtatttgacaaggccactaaccaccgttcttggagcctactctcgaacatcgatttcctctacatacagcgaa

SEQ ID NO: 38633 - DNA, 331 bp, Zea mays
  Clone ID: LIB3060-058-P1-N6-H12
atgctgtggatgctcccaatgtgttcgtgttcccgtatttgtaccccattacgcctttctctatctttttctgtagcactgtctttcttttccagagggatcaggaagaggagtttttcttcatcaaaagcacgcacaacaaggtgcaagttttaaaaaagcccgcgcgaaaaaacccccataagtgcggtagggccccatcctattgaagccgccacgcaacgagcagcgcactggcgctcggcaccagattaagctaaaaaaacaagatcaactaccagtcccaccgcgtggtccccaacggccaggagcagtaccttcaccccaagga

SEQ ID NO: 38634 - DNA, 491 bp, Zea mays
  Clone ID: LIB3060-058-P1-N6-H2
acaatattatcggtcgcttctttactctttcagaacaggcaacacatacatagcagactaaggccgcagttgcagttgcagttgcagcagcaaatatcacatagtgcaccgatcactgttctactagtatgggcagtagaagcaaaatggtggcgcggtcgcttcttttcatgttgacatcacattctggagtagccctcgtattgctccatgaatgagtcgttgaacttcttgaagctcgacatgatggtagggaagtcttcctcggctggaaggatagttgtccgaaggtggaacaccccttccttctgcccaaaaccagatcccggaacagtggaaatccccgttgcctccaggagcttgaggcagtagaaaacgtctgctgctttgccggctctctttgccgcctcgatggctcttgctggcagctgtatttgggggaaagagtacatagctccttctgtgaaattgcacaccacatttcggcagct

SEQ ID NO: 38635 - DNA, 440 bp, Zea mays
  Clone ID: LIB3060-058-P1-N6-H3
gtgcttattattcttatgttgcttattgtgtgttatatatgtctctgttgaaacgattggcacgttccatgtactctaaccctcctattcacggtgccaagatagttgccaacggagggggagatccaaccatgtatggagaatggaaacaggagatggaccccccggccccacggatcaagagggaaaaacacacccccttctacagtcagccaaaaaaagtctttttccccaaggcccccccatgggaccccaagggaaaacgtttttttctggaaggccccaaaaaacccagcccagggtgacaggaaaaaaaaaaaaaggggtggcccctaaaccaatggcccccagcccttgttaaattgggggaggaatcctaagtggggttatcaagaaaacaccatttagccgggggccccccagttaaagaggcccccccc

SEQ ID NO: 38636 - DNA, 469 bp, Zea mays
  Clone ID: LIB3060-058-P1-N6-H4
gccttagcgtcggtcagtgcattgccgtgtggcgggtagcgaccgggagcgcgcacgatggcgtgcggcggccgtggcgactgtggcctccccatccctcacctccaggcgagttgccaccctccgacagcccggttttctgcggctcccagggccaaccagagcggctcacgcgcgccctgcgggtcgccgatgcggcggatgaaacaaacctgctgcctgggccgggggccaacggggatgccagagttgccggggaggctggaggagcatcggcactagcagctgggcggaagccagctcaacataagagggctcgccttacatggcgacgtgagcaggggctagaccggcggccgagcgagctccgaggccttcggccgagagaggggtttcaagatgctggaccggggcattaacacggacatggcgctaggggccagaacctactctatcagcaagctgggga

SEQ ID NO: 38637 - DNA, 543 bp, Zea mays
  Clone ID: LIB3060-058-P1-N6-H5
atattgatcctttcaagcaatacttaaagcgccaggatacttatagtagtaccaccattctgaaacatagtagcgccaggacgaaatataggatcgtccaaaaacatactcttaacaaaagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttgacgctcatctggatgttctgctggatctgcttctcctccatcgccaagttgccaacggcaacacccatgcaaagaaccttcttgagctggaacttgacggttgccttagtctcgttcaccttggactcgagggattcctggtgagtaaccagggtcgggaacttgcctgccttgttgagaccaggaccaaggagacggggaatctgcttgatgatggcctctgatgccaagaaagcatggtacttcttggcaagcctcttaacaagcttctt

SEQ ID NO: 38638 - DNA, 365 bp, Zea mays
  Clone ID: LIB3060-058-P1-N6-H6
gggacaagaactgtttttacaagacaacccaaaaacattctttttggcccaaaataaataaattcctaaaagttatcttaaataaaactatttttaagtttgaccaaattcataaaaagagcatggcactgaattagggtgactaatgcaccataaaatatttttcataatgtactcattcggggtcatagagacatagacgatggggcctttcctataaaattggtcaaacttaagataatttgcctttaagggattctagaaattgactcattttgagacggagcatattactttgagaaagaaaagcttgagcagtataactacttcacggttcagcttcaacgatcatggactcgggattt

SEQ ID NO: 38639 - DNA, 516 bp, Zea mays
  Clone ID: LIB3060-058-P1-N6-H7
tattactttttatatttttttgtgttttttgtttttttgctttatacattattaaagtttgtggtgtaaaaaatgtgttgccctttttaacaggggcggagcaaaaacaatttatcttccggcactaggttactatcaccaaaaaatgccgatggtttgccaacaccaagaggaaaacatgccataagatgtagcgggccgactagtaaaaaaaaggagccgaaacaaaaggggctgaggacaaaatgaaagacatgggtttcatacccataatataacatgacccacaatccagggggagcgggggagaggttataaccaaaacatggcttactgaaaacaagatgaatgcccaaacagggagcttacggggatctggtgacactaaaaaacccccccacagggggcacctggggatgagacgaggcacacccttattctcgggaggggccccataagccaaagggaaagctttctgaggccctaaacccggggtaaaatttccacccttttttt

SEQ ID NO: 38640 - DNA, 601 bp, Zea mays
  Clone ID: LIB3060-058-P1-N6-H8
aatcgataattgatgatgtattgaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttctccacaaatgcccaccttcaagttaggcctagctttgcggcccctctctgtagcaagcttgaccagctcgcccactcccctctggtccaggacctcgaaggggtcatgttggagaatgccctgagcaagatagacgggaatgaactttcccacatcatccctgctgtacccaaaggtcatctgcgtcaggtcgttcgttccgaaggagaagaattcagcctgctccgctatctcatcagccaccagagctgccctggggatctcaatcatt

SEQ ID NO: 38641 - DNA, 607 bp, Zea mays
  unsure at all n locations
  Clone ID: LIB3060-058-P1-N6-H9
agtaaatcaaagatgtgctcattagtaaataaactgtcagaaacataacgtcacaactcatcgctgtttcttatagacaggcccatacacagcagggtttgtaccacaggccacaatgacacattcttcttcgttacattacgtctccccagaagagaagagcatacaccagaagttccagtatatataatcgaccaccgaccatcagcatcagcataagtacgacaacgcgcacatcccctgtttattcaattatattggtgtaaacatcacacgctccatgttgcgttgcatccttggccaccggtgcctgctttcttactcgtcgatcttacatgctcggcttcaggttcagcctagaagccagcttctggccaagagcggcgtcgcactgggaccagtaggagatccaaatggtacggtgttcatgggtcacgcgagggtctgtcagtgcgtcaacccatcgctggatgaaccggtcttgccttgcagggtcgaaggaacgatatctctcgccagcctgcttgaagttgntctccttctgaatgatgcacttctcacgacagcctgttagaacacggggaggaatggggaccttctccgcgtg

SEQ ID NO: 38642 - DNA, 478 bp, Zea mays
  Clone ID: LIB3060-003-Q1-K1-H5-SP6A
ttttgcggtagagattcgtgttagttcgccaacatctctctttagatgttttctggtgtacaaagtacatacagaacgacagcaagaaacaaatcagatccagacatgagaaaaaaaggctgaaactctcgacgatctgactggcctctgaatgaatccggagagcgttaacgaaaaggaaccatcattcaattctattgccaatttgccattcgtatcgcgtagtacatggcactactgctacaagctcacgacaagtcaaagcagaattcgcctcgtccgtggatccgatcgctcagagacagagacgcaggtccgtgcagaacccgaggtcgtggccaccatccaagtcgagcggcgccgggaggttgagatcgagcgacgggcgcgcgccgaccggaccgtggacgcgtcgtcgccgtcgtccacgacggaggccgacgacgcgcagtcgctgtggcagtcggcgtcggtgggc

SEQ ID NO: 38643 - DNA, 548 bp, Zea mays
  Clone ID: LIB3060-003-Q1-K1-H5-T7A
accggtccgaattccgctcgaccacgcgctcgtattgcgagccgccctcagatttttgtaggaagtttgaggtagcaggccgctgccccttcattaaggaggctcggtatgaagcatgactatcttgtagaagatacttccgaagtcgcctggcacaagggagcagacaaacgcggctaattggctcgccggacgaacttgtctgtgctgattgatctaaaggaccattaggagcagagggcttatcgcacgggggacaaatcggcgcccgcaaatcactcttatcgccccaactgctatgcacaagggatcatcgcggttggcgaccagttggtttgatctatgattcgaaggagcatattgaggctagcgagccactcttgtatgattatcgatctggacctcaccaggcctcaccttgttctcgcagaccccgagaaccaaagaaggaccgggcattcggctttcaccgtcgagcacacaaagtggctcgacagctgaagagtagtttcggattacccactctgcagtgaactgaatacttaata

SEQ ID NO: 38644 - DNA, 509 bp, Zea mays
  unsure at all n locations
  Clone ID: LIB3060-016-Q1-K1-A9-SP6A
acgtanaactgaatccatttgtccactcagatctgtatctgtggcaaattatgaacggttgttattgtccctaacagcctccggggggttcagcgtccagctgctcctacgtcaaaaggatatacaaggccgaggtagtatagtaaatacataggcagagtaactgtagcacatcgattgttaaggctgccacatcgaagaggctacatcagagacattcctgcagttacattgaactgcaacatttttcttaaaatgctaattgtttgcacgatcatctgagtgcaaaagtttgtgctcagaaatcgcgtatcattttcttgctatcgttggacggattataccaaacatttgtgctcagacatcgcctgctatttctagtcgccggtgaccctccacgggcgacctccgtccgagctgctgcacgcttggttgccaacaaagctgtctccgtagtcgctggccagcctcatttgcctctcttcctgcggcgaaagaatcctgatgca

SEQ ID NO: 38645 - DNA, 548 bp, Zea mays
  Clone ID: LIB3060-017-Q1-K1-C3-SP6A
ggataatccgagcaagtaaccattatgcagtgtccacatcgcgagctagcaatgtattagtaccgtaatctagctgatctgataaagccaatcaactttgcaacaacacactacagacgttataaggaaaactttaaacataagcattgcgcggcgcaacttgagataacattgtccagagcatgccgttacgccattccactgctttggtaaaagatatggatatgaaggcactgccactagcttcgggaaggctgtgaaaggtaggcacgagcctcacttccagagcttgcgcagggacatgttcttctccgtgtctttcttcatcaccttggccactgccatctcgaagtcctcctgggtaacgtgcacccttctctcacgaagagcaaacattccagcctctgtgcagacggccttgagctcagctcctgaggccccattcatcttttccgcgatctttttcagatcaatgccacgcatcaagttcatttttcttgaatggatcttcaagatatcgaaacgtgaatcctcgttaggatttggaa

SEQ ID NO: 38646 - DNA, 569 bp, Zea mays
  unsure at all n locations
  Clone ID: LIB3060-017-Q1-K1-C3-T7A
ctcgccgnctccactacagggcntttgcttcctcccaactctcgaaaccctacccacccgatgagagatcgatcggtcgagcgcgaattccccagccgcgagcggggggatcggccgccgcccggggtgctggggcccccgcgccgcgggccggcgtacaagacgaagttgtgcgcgctgtggcagcgcggcggctgttcccgcgacacatgcagcttcgcgcacggacacgccgagctccgccggttccccggatcgcgcacctcgttcccaccccgcgccgggagaagagattatagagctggtgactttagagataggtttgataggaggcgctcacctcataggaggcattcccctgatggagattccaggggccatcgctcccttcgtgaccgacggccaaattcccaagaaagggaatctagctattcacggtctcccagtaggaagagtgaaatgaggcatgagaagaagcctgatgatggagaaactaactcatctaggagtctcagtgtctctgacaataatgatgatagaaaaaaggagacactgttaagtggtgatga

SEQ ID NO: 38647 - DNA, 442 bp, Zea mays
  Clone ID: LIB3060-022-Q1-K1-E5-SP6A
ctgcgtaagggacgataatccacttttattcacgaattgttcggccctgccatgaattttttcctacgatcgagataatccacacttattcacaaattattgggtcctgccagcctcagcagcgcttaatgaatttttttcctacgatcgcccgatcttttccaccaggcgggtttcgatctccattcttttcctcatcaggagggggtatttttggaggagctcccggtcctgctccttgtggccggccgggactgccagctttgagccaagggaggttttttccaggttgccctggtacaggcacgagatggggacgaagctaccttgcgcgttgacagccacccgtgggcagctttaagcgctgcgcccaggatgccgaatcaggtttttggactgtgaagacagggcagccgaagatctgcgcgactgacttgaggat

SEQ ID NO: 38648 - DNA, 515 bp, Zea mays
  Clone ID: LIB3060-022-Q1-K1-E5-T7A
ctgcttcagaatatattattccatacgctaagttcctgaagagcctcaatcatccggtctgtattggagcaaggatcaactttcagtgccataatgaagatgttagtgaaaggcgatctggagtggttgttcgcattaatgaaatagatcccatgaaatggcctggctcgaagtggagaagcctgctggtaagatgggaggacggtgctgaatgtaatggccaagatagagtatctccatgggagatcgagatagctggtggttctgtctctgtttctcattctctttctgcatctagttctaaaagaaccaagttgtgtcctcagggaaatttggacgttccagcaatgtggaatggttgtactgactccatggaaactggaaagttacccagggtcttgcaaggtcaagaattgatgagttttaggacttgtcatgttccgtgtgctcctcaaactgctgaggctgcaaaacttcaatcttctgatgctagtaggttccttagtaatgcacat

SEQ ID NO: 38649 - DNA, 601 bp, Zea mays
  Clone ID: LIB3060-050-Q1-K1-B6-SP6A
atataaacttacatttatttcaaaagcaagcttgagttattttattacagaccagagctaaaagtgagtgcagagtagtaatattatacaaaccatgggaggcacaaactcctcccgataagctataagcaaaagaacctaagtggaggaccgagtcctcccgcacttcagtcttgtttttcctcatttggtaccaccttggagcaaaagcaacaaaagtttgtcgcttcctcacctgagtaacactaggttagtgttattaggtgacgtccgcttgacgagtatccttcgaccgagcacttgcttgatttaaccgtcttcaggttgattcatcagcttcagcttgcagattagcccacgcttggggtcggcttggttcttcttccgcgtcacacgattatttatcgtacctcatgagatgcatgatgcacatgtatgagcacatgtataacgagtataatatagataatctacgctaaaaagcatgaaacacttaaaaccaagcattaagcaccatggatatcacagcaggacatcgactatatccattaatcaaattgacatattacactagaaaatctatttttattcttaggctttt

SEQ ID NO: 38650 - DNA, 446 bp, Zea mays
  Clone ID: LIB3060-050-Q1-K1-B6-T7A
gatttccgtgctcggcttctccctcccgctatctctatctctgcgcgcgagctcgcccctgctcgccctgctctcccatggccgcgcccaactccgtgcgctcgccggatcccctgctcggcttcgactgccgttccccgtgctcgcgttatctccctcctctctgccgcagctcgctgagtccctctgtttcctcccatggcacggggttccctgcaggctgctcgcggcacccatctcctctgctcgaccgcgagctcgctccctggtcatgccgctccctcgcctaatcgtggtcgcgcgcgcgtgtgcccttctcttggtggtgctcgaccccggcctcaggcagccacgtccgttgtcgtcgggcatgctagccgtcgtggctccccttgtgcgctgtccttgctgctcgctctgcgcgcacggtcctctgtcccctgcgc

SEQ ID NO: 38651 - DNA, 517 bp, Zea mays
  Clone ID: LIB3060-034-Q1-K1-G3-F2A
aaggcacacattatgacatatcatcatatataatataaatccgtctggtttattattccgtcacggtaatttatatatagagtccagacgggaatctgtgatagtctgcaaaggcaatggcaatgcagaggaggttcacagcgcaaagggcttgcggtagacgtcgaacatctccgagcaagacaggttaggttcctgcacgccgctgaagttgacgaccttgcgggcgggtgcgcaggcgccctgcagctgctggttgcagccgccggcgttggtcatgatggctttcatggaggtgagcaggcggccgtaggtgaccccctggggctcgcattccaccgccttgaagaagctgtgggtcatggcccccaccgccgcgcaagcctccggcgtcatgctgaacttgcttttgccgtcgctgtagccgctgataagcaccgcctggccgccgctcgtgcccttgcagacgcccgacggtggacggtgatcctccactgccagttcccggtcctgacat

SEQ ID NO: 38652 - DNA, 531 bp, Zea mays
  Clone ID: LIB3060-034-Q1-K1-G3-R2A
gcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgccgcggtggg

SEQ ID NO: 38653 - DNA, 488 bp, Zea mays
  Clone ID: LIB3060-022-Q1-K1-E5-F3B
tcgagctcagtacccggagattcgacttggatagtctgaacgcctgggcagatgcacctctcttcagccgcagtctcctggtaccctaaggtctaaactcgagggtgttcaaatccgaacaaggaacttcgctttccaattgcaaatgctctccttgcgctaaatcaacgatgggagtcctttagtggaacatctagttctgatgctgctttattgtgcatatacagtgggtctctacctgcaccttgctgagtcggttgtgcatgaaatcaaagatgccctcgaaatctattgcttgaggataactagaaaggatgcttgaactcttgagtgaagatatattattattacttcacaagtgctagtgaggagcatcacagttcgaaaccgtgcacgctgggagtgtgtgtgcccctctgaaatgccacagccatctgtgtgttgagcagagggatctacggataggattgcgcacttatcttggtcat

SEQ ID NO: 38654 - DNA, 587 bp, Zea mays
  unsure at all n locations
  Clone ID: LIB3060-022-Q1-K1-E5-F3C
gattcggactcggtacccggcgatcctgtaagactcgaactgtatgcatcggtcgccctttttttttttttgtagcgataatttatacatatgcncatttaaaaaaaaactgagggtgtagacaataaccaacataatcacatgctacgatcactttctccaagcaagtttttcacagtatattttttaactacggtgctacataactcatattaacttgtgttgcgctctctgaccaatttacctgcgcaatacaatccctagatccttctgctcaacaaacagatggctgtggcatttcagaggggcacacacactcccatcgtgcacggtgacgaacagtgttgctcctcgttagcacttgtgaagtaatcataatttatcttcactacaaagttcaagccttctttttagttatcctgaagcaatagattccaagggcatccttgattttatgcacaaccgacacagcgaggtgcaggtagagacccactgtatatgctcaataaatcagattcagaacaagtttattaactaaaggactctccatcgttgatctttgcagtgagagcatttgctaatggtaa

SEQ ID NO: 38655 - DNA, 372 bp, Zea mays
  unsure at all n locations
  Clone ID: LIB3060-022-Q1-K1-E5-TGA
attcggctcgagctaagaccgcgcgggcagtagccaattaataattaatttgatatacctacgacgtaccacggaccagatatatgtatataaaccagccgacttgccagcgtaaatttcgtgagatgcatgggatatcgttggaaggatactgtaaggtttgcacttgtactgtgctctagcctagaattaccagactagagcagcagataacataggccatgcatgttttgattttgccctcggaatgtgcaacatgtaaattctgagggtattgtttatttacttatgtatgctactactagcggttaactattattggggttaaaaaaaaaaaaaaaaaaannnnnnnnnnnnnnnnnnnnnnnnnaa

SEQ ID NO: 38656 - DNA, 595 bp, Zea mays
  Clone ID: LIB3060-017-Q1-K1-C3-F3BA
ggaagagtgaaatgaggcatgagaagaagcctgatgatggagaaactaactcatctaggagtctcagtgtctcgtacaataatgatgatagaaaaaaggagacactgttaagtggtgatgataaagaggatcacgaaatacagctcaaacaaataagacaggacatggaacttttgcgtgatgataaatctctcttggagataattttggatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaaaggtcacaagctcgttttgagagactcggtgatttacttgcttcagatattctgaaacgtggtgctaatgaagaagtttctagtatcaatgttgatgaagatccaaatgttccttatgaaaggagcccaaatgctgctatagctaagaagagatcaataccatactcaacaagtgaagaagcgaaagccgtgaagaaaagaagagagcgggactctgacacaactag

SEQ ID NO: 38657 - DNA, 407 bp, Zea mays
  Clone ID: LIB3060-017-Q1-K1-C3-F3CA
gaagagtgaaatgaggcatgagaagaagcctgatgatggagaaactaactcatctaggagtctcagtgtctctgacaataatgatgatagaaaaaaggagacactgttaagtggtgatgataaagaggatcacgaaatacagctcaaacaaataagacaggacatggaacttttgcgtgatgataaatctctcttggagataattttggatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaaaggtcacaagctcgttttgagagactcggtgatttacttg

SEQ ID NO: 38658 - DNA, 761 bp, Zea mays
  Clone ID: LIB3060-022-Q1-K1-E5-TAA
ctatttacagactacaagcagacgacagcgatcttcagagctcctaccagagcaacgaggctttccatttccaccacacaaaccggcgcgtgctgatgtgctcggcctcggcttcagcaaccggagacgaggccccgtgacgaccaccagctgccccctgtcaccgacgacgacgactgaccgcggcgcattcgatccactgcgtcatctttattggcacactgcatccaaaccggtgcggcctctcggcacgcgcgagtaaacttggaagggcttagggctcggcggctcaccggcgtccgcgcctgaacattcacacagcaggtccttcttcagtaggacggtccccggaactgcggccagcctcaccttactcagcctcttcttgtccgactcatctatctctctgaacccaaatgtcgatgtccatgtctccgccaggtgcgggattgctgataggagcagcatctccaccttcagggatttcagcatctcctcaatgtaatccatgaggcgcctgcacatcccctgctgacgattctctttagaagttgctaccagaggcatctctgctaaaattgcaccatgcaaccttatggaggcaacagataccatgctatcatcactttccaagactactgtatagaaccccttgtaattgaaatgtaaatcagacctccagttatacaatatggagggaataatgtctatccctgtcctgggatctagaataggcagggaaacactcttccatgatactc

SEQ ID NO: 38659 - DNA, 284 bp, Zea mays
  Clone ID: LIB3060-022-Q1-K1-E5-TCA
tcaaatgtgggacatattaaagatgggtctaatgtatcaaaagttgaagatggtcatgtcgatagaagtgttggtgtgaagaagcccagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatgaaag

SEQ ID NO: 38660 - DNA, 723 bp, Zea mays
  Clone ID: LIB3060-029-H4-R5A
cttacaggcctaagaaggatggggattctgatgtatatggtgatgcagatgaacagctggagaaggttatgaagactgagaggttcaagcccgacaagggatttactggtgcttcagagaggactggcaagcgagacaggcctgtggagttcgacaagcaggaagaaaatgatccatttggtctggatcagttcttgactgaggtgaaaaagggtaagaaagctgtggagaagattggaggtggaggaaccatgaaggcgagtggtgggtcctcaatgagggatgattatgacggtggatctgggaggtcccgcatcaactttgaaagggggcgctgaggtatttgctctgcttctgcaggtttggaatgctttctcaaatatcttctagcagaatgtcataagaagctgaactctgataagaaagagcatggctcctgtgctgttatatagctcatgtgcctactttcagtggttgtgcttaaggtgtactatatggatcctatgatgtctatgtactatgcgtgtatctgttcattataggagctatgaacttcgtttatccatgttccatcaattgttacgaacttatgatacatgttattgggctctatgatttcatcagttaccattttgggatatggatggactcaacgtggctatttgttgccatggttgctgcacatgtgctcattctgtttatgaatttcttggtggtgcctat

SEQ ID NO: 38661 - DNA, 556 bp, Zea mays
  Clone ID: LIB3060-047-G10-R4b
ggcgaggaggaagagcagcatgagcgccacgtacttgagcgccatcatgtactcgccgtgcgcgccgaacacggtgtcgctgagcggcttcttgatggtgtaggtgctgctcagcaccgccgccacgcccgtgcagaagaggatcgccgtcgtggccatcagcgtcgaccccatgatgacgttccgcaccgactgcaccaccgtcaccgcgttcttggcgttgtccttcatcatgccgatggcccagaggcggcgcgtggcggcgttgatgccgacggccgtgcgcagcgggcggaggcggacctcgcgccacagccaggcgtggtacgccatggggaggagcaggctgagcgggatgagcgccaggtccaagaagctgtccctccactccatgatcgaccgaacgagagcgagcgagagcaaccacaacggaacaacgctagctagctagctagagtcctgtatgcgggcggaaacaggatggttgttgtgtagctctctgactcgtgacgaggtggggggggggggcaacgacgttgctttccgatcaggcgtc

SEQ ID NO: 38662 - DNA, 98 bp, Zea mays
  Clone ID: LIB3060-016-Q1-K1-A9-F2A
ataggtgggagcgacaagccaattttaaccaagaccggagcaagggccacggaggcaggtttaccagcagcaaagtgccacctgcgggacggccggcc

SEQ ID NO: 38663 - DNA, 101 bp, Zea mays
  Clone ID: LIB3060-016-Q1-K1-A9-R2B
gccgaaaccggaagcgcgcgaacccggaccgcaaacgggagaccccgccggaagaaccgcgggagaaacgcagccctgacgcgccgaccgacacaaacccg

SEQ ID NO: 38664 - DNA, 399 bp, Zea mays
  Clone ID: LIB3060-016-Q1-K1-A9-SP6B
caacggcaggtggggaccaccacctagacccaagagtcggacataaacccgaggaggcacagaagaaaccgacgaactgggcgaggagccacgggtactagacccccaccacgaggcagacgccgccgatcaggccgacgacccccaacgccacggagcagaagaaggagaaccaggacgggccacacgtgtggaggcccgacgcgcgcaccaggagctacagcacccacgtctcctcgcagttcatcgacagcgccaacccgaaccgccccgggaacaggacgaacgacgcggacgccaccatgagcaagccggaggcggaggcaatgcaagcgcagggcacgcactgcgacgaccaccgctgccggaccaccctaacggacggcagcgctgccaacg

SEQ ID NO: 38665 - DNA, 319 bp, Zea mays
  Clone ID: LIB3060-016-Q1-K1-A9-TGA
acgcaccaccggaaggccagcgggccaatttaaaaaaggggggggccccccccaaaaaagccgaaaaggaggacaggtaaaaagatcaactggagcggggcaccggctgaaggccccaggaaaggtcgcgaaggaagtcaccggacgagggaaacacacacgcggaacaagacaggagggacaaccagaggcagcgagccgaagacaagaacagcccacagaaggaccgcccgacaccggcgacaagacgaccacaccgccggcccgaacaaagaaccacaggacaccaggacaggcgcaacccaggaagcacggcaga

SEQ ID NO: 38666 - DNA, 333 bp, Zea mays
  unsure at all n locations
  Clone ID: LIB3060-017-Q1-K1-C3-R6A
agcgccnccnancaaaccnancncnaaagncaccagcnctattatcncnncncccggcgcggggggggaacgaggtgcgcganccggggaaccggcggagctcggcggggccgngcgcgaagctgcaggtcgcgggaacagccgccgcgctgccacagcgcgcacaacttcgtcttgtacgccggcccgcggcgcgggggccccagcaccccgggcggcggccgatccccccgctcgcggctggggaattcgcgctcgaccgatcgatctctcatcgggtgggtagggtttcgagagttgggaggagcatagccctgtagtggaagcggcgag

SEQ ID NO: 38667 - DNA, 701 bp, Zea mays
  Clone ID: LIB3060-022-Q1-K1-E5-F3D
gctagaaggttccttagtaatgcacatggctgcgcattgggtggttcaacaagcagactcgcagtgcatagccctggttttacctaccaatgtgtaggcttgaatgaatttattggattctcagaggtcttgcaaggtcaagaaatttctcgggcggttcctagttccaaggaatgatgtcggaagcttgttcactgaaagacagatatgggctgcatagttatatgcgtgccccagttgctgttaatggattatcagctacaactcaagaatgttctctcgcactatctactccgccaggagcacaagtgccctctctctaccctggtaatgttgttaaccgaactgtggttccacaacttggactggcaaggaagtttggtggtggaggtacaaatggccagcagtctggcccatttgataggccgagggaactttggaccaggccacagcatgaaacacctgaccaaatgaacttggatcagtttgagactagaagaccttcagtgcctgtagatgctgctaagcttgggtctggtggaggggaggttcgcaaaactagctgcagactttttggtttctccttgactgaaaagatcttgccagcagatgatgatgacgtcaaggaagtgagctatgagactgagtgccagaacccacggatgctggacctgttcgggtacaactgctcaacaccgagt

SEQ ID NO: 38668 - DNA, 675 bp, Zea mays
  unsure at all n locations
  Clone ID: LIB3060-022-Q1-K1-E5-F3E
tgcacatggctgcgcattgggtggttcaacaagcagactcgcagngcatagccatggttttacctaccaatgtgtaggcttggatgaatttattggattctcagagggcttgcaaggtcaagaaatttctcgggcggttcctagttccaaggaatgatgtcggaagcttgttcactgaaagacagatatgggctgcatagttatatgcgtgccccagttgctgttaatggattatcagctacaactcaagaatgttctctcgcactatctactccgccaggagcacaagtgccctctctctaccctggtaatgttgttaaccgaactgtggttccacaacttggactggcaaggaagtttggtggtggaggtacaaatggccagcagtctggcccatttgataggccgagggaactttggaccaggccacagcatgaaacacctgaccaaatgaacttggatcagtttgagactagaagaccttcagtgcctgtagatgctgctaagcttgggtctggtggaggggaggttcgcaaaactagctgcagactntttggtttctccttgactgaaaagatcttgccagcagatgatgatgacgtcaaggaagtgagctatgagactgagtgccagaacccacggatgctggacctgttcgggtacaactgctcaaca

SEQ ID NO: 38669 - DNA, 467 bp, Zea mays
  Clone ID: LIB3062-010-Q1-K1-A1-F2A
tctggttggatgattctataatttgcttactggccaaaaaaaaaaacttgtgaaccatattagttgtgttgcattcgaaagcagcatactaggagttgaaaattaaactcccgcataactgatttggttggggtcgctcagtttgtttcggggccactactgagggggcacgagatgtatggctgctacatgtttaataactaagcacaaggagctaacgacctgagcttgaacggcacgtaggtcttgagcgagattaccgccccctgcacggaggccgatcaggaggcgggggggactaggaaacacacgaagctgaggctttgcggggctatccacttggtgtttgaaccttcgcacctgccgatgccgaatgtacatctggaccgggaagaagacggtgagcgtccaaaaggcgatgctgaccgtgatgcccatgatgctgttgaaaaaggtgctgaggatgg

SEQ ID NO: 38670 - DNA, 188 bp, Zea mays
  Clone ID: LIB3062-026-A1-F6A
agcccagctcatgtatggttgtcgcccgtatagaaactctgtatccgtgtactgaactgtctatagacaaaaccgtcgctggcagtggtagggggttgcattcatcgtgcgtgggacgattcgttatttattactgtacctgttattctttccgttcgttgggtaaccacacctctctctctttgctc

SEQ ID NO: 38671 - DNA, 322 bp, Zea mays
  Clone ID: LIB3062-045-Q1-K1-H6
caaggactccaagacgcttctcttctgcgataagccgttcaccgtctctgtcatcgggaagccctactagatcccgtggggagaggctgtttctcattatactctttagtccacctgtgtcttcactgacaaggacaaatctgccagcacatctgaatggtattgccaaaaaggacgctatctctgccccaagcatatatgcacccatgtttgttcttagtgtcaatgaggacaagctcacctcccatgttaacattgattacaatgctagctgcaccacaaactgacttgctaccctcgctaaggtcaatcatgacaacta

SEQ ID NO: 38672 - DNA, 440 bp, Zea mays
  unsure at all n locations
  Clone ID: LIB3062-035-Q1-K1-H2
cacgaagactgttatttggaacggccccatgggagtgtttgagttctagaagtttgcagctggcactgacgcgattcgcaaggagctagctgagcgtacagaccacgaaaggtgtcactaccatcatcggcggcggcgactctgttgctgctgtcgagaaggctgggctggccgacaagatgagccacatttcgaccggctgctgtgcgagcttggaactcttggaaggcaagactctacctggtgtccttgccctcgatgactcctagatccgctgctgctgctgctactcaagttctgccagctttgcgtgtcatcttgtttcggaccttggtgtaacactgcaaggctaaagtttactcctncgcacatggacttctggcgataggcttgccaccgtgtattgctagatgagtcgtggaataagcttttacttcctc

SEQ ID NO: 38673 - DNA, 383 bp, Zea mays
  Clone ID: LIB3062-017-Q1-K1-D10
atcccgtcgcatcccatcccactaccacccatctcgtcgtccgccgattcgatccggggcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaag

SEQ ID NO: 38674 - DNA, 301 bp, Zea mays
  unsure at all n locations
  Clone ID: LIB3062-018-Q1-K1-F2
atcgtgtgcacatgcacaaataggtgataaaggcagatgatgttgttggaccagaagtgganaagttggtgtctgcattgccaaacggtaatgttgtgctccttgaaaatgttagattctacaaggaggaagagaagaatgacccagagtttgcaaagaagcttgcctctttagcagatctttatgtgaacgatgcctttggaactgctcacagagcacatgcgtcaactgagggagttaccaagttcttgaagccctcagtcgcagggttccttttgcaaaaggagcttgattaccttgt

SEQ ID NO: 38675 - DNA, 432 bp, Zea mays
  Clone ID: LIB3062-049-Q1-K1-H7
ggttcttccttggttgaagatgacaagcttgagcttgcgacctctctccttagaagagcggaggagaagggtgtctcccttatgttgccattcgatctggtcgtcgctgataagtttgctcctgatgctagcagtcagctctccaggttgttcctgcatctgcaattcctgatgcatggatgggtctggacataggtccagattcgatttcggcgttcagttctgccctggaaactactcagacagtcatctggaatggacccatgggagtttttgaatttgacaagtttgcagttggaaccaaggcaattgcaaagaagttagccgagcttagtggcaagggcgtcactacaatagttggtgggggagactccattgcagctgttgaaaagggtggtgtcgccgactctctgagccacatttcaactgggg

SEQ ID NO: 38676 - DNA, 235 bp, Zea mays
  Clone ID: LIB3062-015-Q1-K1-H5
agacgctgtcgtacctgccgccgctgtttacggacgacctgctgaagcaggtggactggctgctgcgcaacggctggataccctgcctcgagttcagcaaggtcggcttcgtgtaccgcgagaactgcacctacccgtgctactacgacggccgctactggaccatgtggaagctgcccatgttctgctgcaacgacgccacccacgtgtacaaggaactgcaggaggccatcaa

SEQ ID NO: 38677 - DNA, 416 bp, Zea mays
  Clone ID: LIB3062-016-Q1-K1-D11
cgcccaccgtgatgatggccttgtcggccaccgccgtcgatccgttccaggggctcaggtccaccgccaggctccccgttgcccggcgttcctccagaagcctaggcaacgtcagcaacggctgaaggatccggtacatgcatgtgtggacggcctacagcaacaagaaggtcaagacgctggcgtacctgccgacgctgtcgaccgacgacctgctgaagctggtggactacctactgcgcaacgggtggataccctgcctcgagttcaacaaggtcggcttcgtgtaccgcgagaactccaccttcccgtgctactacgacagccgctactggaccatgtggaatctgcccatgtcactctgcaacgaccccacccaggtgtacaaggagctgcatgaggccattaaatcctac

SEQ ID NO: 38678 - DNA, 458 bp, Zea mays
  Clone ID: LIB3062-036-Q1-K1-F11
gccaggcaggcatggcgcccaccgtgatgatggcctcgtcggccaccgccgtcgctccgttccaggggctcaaggccagggccagcctcccggtcgcccggcgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccatgtgtacaaagagctgcaggaagccatcaaatcctacccggacgccttccaccgcgtcatcggc

SEQ ID NO: 38679 - DNA, 158 bp, Zea mays
  Clone ID: LIB3062-029-Q1-K1-F9
tcaagcaagcaagcagcgagttcatacttactacgcagccaggcagccatggggccgagcgcgatgatggcctggtctgcgaccgccttcgctcccatacagtgtctcacgttcaccgtcagcctctccgtagccaggcgctcctccataagcctatg

SEQ ID NO: 38680 - DNA, 371 bp, Zea mays
  Clone ID: LIB3062-057-Q1-K1-G7
ctaggcagccaggcagccatggcgcccaccgtgatgatggccttgtcggccaccgccgtcgctccgttccatgggctggagttcaccgacagtcttcccgacgaccggcgctgctccagaagcctatgtaacgttagcaacggcggaaggatccggtgcatgcaagggtggtcggactacggaaacacgaagttctagactctgtagtacctggcggcgattgcgacagacgacctgcttgagcaatgtgactaccatgatgtgcaacggctggataccctggctctagttcataccggacagatatgagtaccgtgagaacttcatctaaccgtgctaattcgaactgcgttactggaccatgcgaaagc

SEQ ID NO: 38681 - DNA, 453 bp, Zea mays
  Clone ID: LIB3062-023-Q1-K1-F12
atgctttccacatggatggttttggcggctctttggttgaatatatggttagagaaactgaaaagctccatgcacaggttgggagatacaagagcccagatgagcaccctttctttcctgaggatctgcctgagccccggttgccacctatgcagtacccaagggttttgcatcccattgccgattctatcaatatcaacaaagagatttggaaaatgtattttgatgaacttcttccaagattggtaaaaaaaggaagtgatggtaatgctggatccagtgctctttgtgacacgacctgcttgcaagcgctctccaaaaggatccactatgggaagtttgtggcagaggctaagtttcaggagtccccggaagcttacatgccagccataatagctcaagaccgtgatcaactcatgcaccttctcacatatgaaacggtggagcgtgcta

SEQ ID NO: 38682 - DNA, 426 bp, Zea mays
  Clone ID: LIB3062-011-Q1-K1-E11
cggacgcgtgggcggacgcgtgggtggccttcaagctggccaccaaggccgcggcggcgtcgcccgctgctgctcaccgcgggggtctcgcccgggggccggagggtacgagccgcgttgccttcggaccagcgcctagaaacaaggggctccgcgcggccaacaactccgcgacgcccgtggctaaggaagagagggttgatcgaagtgaaatattgacattggatagcattagacaagttttgattagactagaagacagcatcatattcggccttttggagagagcacagttttgttacaacgctgatacatatgatagcaatgctttccacatggatggttttggcggctctttggttgaatatatggttagagaaactgaaaagctccatgcacaggttgggagatacaagagcccagatg

SEQ ID NO: 38683 - DNA, 433 bp, Zea mays
  Clone ID: LIB3062-040-Q1-K1-H3
acggccaggtgaaacgattggcacgtaccatgtattcgataccccgctattcacggtgccaagatggttggcgaacgttgttggtgatgcaaccatgtttggtgaatggaaacaagagatggagctaatggctggactgatcaagaatgtaagacaaaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactatgctgaagtactatagttgagggtcaagctattgatgttt

SEQ ID NO: 38684 - DNA, 392 bp, Zea mays
  Clone ID: LIB3062-047-Q1-K1-H1
gtgccactcccatccaccacaaggcttggcttggtgggaagaagacaaacgccggcacgcgcgacgcggacacgatggcgatctgcagcgcgcacactaccacctccctgcgctccccatgcacaaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaacaacggttttcggggcgccgcggagcccgccaaaggcgggaacccggacttcaacacgctcatcagtgacaccacgaca

SEQ ID NO: 38685 - DNA, 419 bp, Zea mays
  unsure at all n locations
  Clone ID: LIB3062-015-Q1-K1-A11
cgcccccgaagcgtctcggttcgcatagcaaagctgctcttgcaacaagccaaacaaggcantggctgctagccgagacaggggatagattgagagagaggcgcgcagatggcgacgccgtcgtcgtcgctttgctccagcttcgcctccctgcggaccgcctccatcggccacccccgtggcatcgcctcctccacgctcaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggtttgtgatgctctgcg

SEQ ID NO: 38686 - DNA, 298 bp, Zea mays
  unsure at all n locations
  Clone ID: LIB3062-048-Q1-K1-D12
cgatctgcagaagctaccggtaaggttcgtcatggacagggccgggctggtcggcgcggacgggccgacccactgcggggcgttcgacgtcgcgtacatggcctgcctgcccaacatggtcgtcatggccccgtccgacgaggccgagctctgccacatggtcgccaccgccgcggcaatcgacgaccgcccgtcctgcttccgctacccgagaggcaacggcgttggcgtcccgttgccgnccaactacaaaggcactcccctcgaggtcgggcaaagcaggatcctgctggagggc

SEQ ID NO: 38687 - DNA, 249 bp, Zea mays
  Clone ID: LIB3062-016-Q1-K1-E1
gaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtgtccaatgctatctgcacaac

SEQ ID NO: 38688 - DNA, 109 bp, Zea mays
  Clone ID: LIB3062-057-Q1-K1-A8
ataaatgtggatggcgcgtgcctctgggtcgccaggttcatgctgagtctggacatgttttgcacttttgtttcccttcctgctaccatctgtgacagatccgctcgct

SEQ ID NO: 38689 - DNA, 385 bp, Zea mays
  Clone ID: LIB3062-023-Q1-K1-F7
ccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttggtggtgtcaatgaaggcaaggtccacttggatggtaaccatggtttcaattgttagttgaacaaaaaatggcttggttcccttggtaaaggcattcatgaccaccttggcattggtgaagggttgaagaccac

SEQ ID NO: 38690 - DNA, 402 bp, Zea mays
  Clone ID: LIB3062-001-Q1-K2-B9
cgagtctcgtccacccgtcgtcctcctagctcctctactcgccagtcgccatgggcaagagtaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggcgtgaggctggcgctgagtatgtcgtggagtccaccggcgtcttcactgacaaggacaaggctgctgcacatctcaagggtggtg

SEQ ID NO: 38691 - DNA, 408 bp, Zea mays
  Clone ID: LIB3062-035-Q1-K1-B9
gcgccgctgcctccgcctctcgagtctcgtccacccgtggtcctcctagctgctctactcgccaggggggatgggcaagattgagatcggaatcaacggcttcggaaggatcggcaggctcgtggccagcgtcgccctccagagcgaggatgtcgagctcgtcaccgtcaacgaccccttcatcaccaccgactacatgacctacatgttcaagtacgacaccgtccacgggcactggaagcacagcgacatcacactcaaggactccaagacccttctcttcggtgacaagccggtcaccgtctttggcatcaagaaccctgaggaaatcccgtcgcgtgaggctggcgctgactatgtcacggagtccaccggcgtctatactgacaaggacaaagctgctgcaca

SEQ ID NO: 38692 - DNA, 409 bp, Zea mays
  Clone ID: LIB3062-009-Q1-K1-B6
gcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgc

SEQ ID NO: 38693 - DNA, 422 bp, Zea mays
  Clone ID: LIB3062-012-Q1-K1-C5
gctgcctccgcctctcgagtctcgtccacccgtcgtcctcctagctcctctactggccggtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaag

SEQ ID NO: 38694 - DNA, 415 bp, Zea mays
  Clone ID: LIB3062-056-Q1-K1-C9
atcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccc

SEQ ID NO: 38695 - DNA, 383 bp, Zea mays
  Clone ID: LIB3062-004-Q1-K1-D3
gaatctttgtgtgctcaagttcttcgtgcaaaatatttcccgatgaagaacattccgggggcaagacctaaaggaggaatatcatgttcctatacttggcgagtatcctaaatggattgcaacttttaagaaatgggctgatctggagagttggtaattgcaattctatcaatatttggaaggatccatggaccccacgtggagaaaccaggaagataattactccatccaaggggtcaatccgtcatccaaagagtttatgaactgataaatccatttaagggcttgttcgggtagctctcaatccatatggattgagtgagatttggtggggttaaaatcccagcatggacaaaaggcacacacgtggtccagctttctac

SEQ ID NO: 38696 - DNA, 417 bp, Zea mays
  Clone ID: LIB3062-047-Q1-K1-F4
actatgtctgcgtgtcttacttaattgattgccttaagcccttacaaacttgttatttttcgaagtattactatgtgatcctaaagttattagtgggttgtcctcagcaatttaggtgccgtttggttcaaattttggtaacgtaatgggtaactcataacattaaatcatgtttgtttaagtttaactgtaatcgataccacactacaaatggatagtcttattcaaatttgttactgccggtattcgagtgtgaatcgttaccattaccatttacgttacatttcgtgaaccaaacggcaccttacttttttatagactatgtctccattgttttcattcactttcactgacacataagttccttatcacttatcagctggcagtacttctgtcttctcgccatctatgtcagtc

SEQ ID NO: 38697 - DNA, 256 bp, Zea mays
  Clone ID: LIB3062-015-Q1-K1-C1
ccttgttgcgtgtttgctcgcccacaagatgggtgttactcactgtaccattgcccaggcggttgagaaaactaagtagcctaactccgacctctactggaagaagtttgaggatcactaccacttctcgtgccagttcaccactgacttgattgcaatgaaccatgccgacttcatcatcaccagtaccttccaagagatcgccggaaacaaggacaccgtccgccaatacgagtcacacatggcgttcacaatg

SEQ ID NO: 38698 - DNA, 208 bp, Zea mays
  Clone ID: LIB3062-024-Q1-K1-C3
atcgttcgcaagtggatctcgcgatttgaagtctggccgtacctggagacttacactgatgacgtggcgcatgagattgctggagagcttcaagccaatcctgacctgatcatcggaaactacagtgacggaaaccttgttgcgtgtttgctcgcccacaagatgggtgttactcactgtaccattgcccatgcgcttgaaaaactaa

SEQ ID NO: 38699 - DNA, 442 bp, Zea mays
  Clone ID: LIB3062-001-Q1-K2-G11
gcagtttctggtcatcacatttgccaagaactccttatgacatctcccttgatgatgagacacaaaaccgcaatgatcaggtgaacaccctgtgcaaatcatgttatgtaatagttgtaccttttgttagtattgccgaacaaatttgacattgatgcaggggtttgagaaaatggtctctgggatttatcttggggaaattgcaaggctggtgctgcatcgaatggctctagaatcagatttttttggtgacgctgctgataatctatgtacccccttcacattgagcacaccactcctcgctgcaattcgcaaggacgattcaccagatctgagcgaagtcaggaagatactgcaagaacatctgaaggtcagctttcctgaccttcatgaagtcaaacatgtgttttcctccaacctgtgaaggttctggtgattttgc

SEQ ID NO: 38700 - DNA, 253 bp, Zea mays
  Clone ID: LIB3062-019-Q1-K1-H11
ctccatcttccacaacgaggagaagctccgcgaggctctcaagttctccaacgcctgcggcgccatgtgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttaccgtcc

SEQ ID NO: 38701 - DNA, 293 bp, Zea mays
  Clone ID: LIB3062-048-Q1-K1-B7
gccaaacacatctttgtggaagagcttggtgctgatgaaagctcactgttgaattgtgtcccgaaagaggactttggaggtggtcatccggatcctaaccttacctatgcaaaagagttggttgaacgcatgggtcttggaaagtcatcctcaaatgttgagcctcctgaatttggtgctgcagctgatggagatgctgaccgcaacatgattcttggtaaaagattctttgtgacaccgtcggactctgttgccattatcgtaaccaatggctgtcaatcaattccttactt

SEQ ID NO: 38702 - DNA, 408 bp, Zea mays
  Clone ID: LIB3062-044-Q1-K1-F2
tgttacgcgttcaaggcatctcccagcgaaggctacatctgatctgctgcttgtgcaggctgatctttacaccgtggttgatggctttgtcatccgcaacccatgcagagcgaatccagctaacccttcaattgagcttggacctgagttcaagaaggttgccaatttacttggtcggttcaagtccatccccagcatagttgagcttgacagcttgaaggtttctggtgatgtctggtttggctctggaattacactcaagggcaaggtgacaattatcgccaagcctgtagtgaagttggagattccagatggagacgtacttgagaacaaggatgtcaatggtcctgaggatctataagcaatggttatcatcaccaggttttccaaggacatgttacagggact

SEQ ID NO: 38703 - DNA, 373 bp, Zea mays
  Clone ID: LIB3062-021-Q1-K1-F10
aattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgtcaagtctggagtgaagttggaggttccagatggagctgtatttgaaaacaaggatgtcaatggccctgaggatccttaagctatg

SEQ ID NO: 38704 - DNA, 342 bp, Zea mays
  unsure at all n locations
  Clone ID: LIB3062-049-Q1-K1-A8
accgagtcgcacaagaggctgacctcccttcacccggagattgaggagctcctgtacagccgaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatncgctggatctccgnccagatgaac

SEQ ID NO: 38705 - DNA, 60 bp, Zea mays
  Clone ID: LIB3062-008-Q1-K1-E6
aatggaattaaaggtccccggttaagaattcttcccgtgaatgcttccttcgaattaatg

SEQ ID NO: 38706 - DNA, 448 bp, Zea mays
  Clone ID: LIB3062-032-Q1-K1-F11
acgctgacttctggacctcgcacgagtgccgtctcttaccctacgagcaggctcttgcccgtggggattccaccaggggccttttctatgattgttcggcccacatgttgtgggttggtgagcgcactcgacaactcgatggagctcatgttgaattcctccgtggtgttgccaaccctatgggcataaaggtgagcgacaaaatgaaccccagtgagttggtgaagctgattgatattctgaacccttcaaacaaacctggaaggatcaccataattacaaggatgggggcagagaacatgagggtgaagttgcctcatctcatccgtgctgttcgcaatgctggactgattgtcacatggattactgatcctatgcatggaaacaccatcaaggccccttgtggcctgaagactcgtccatttgactccattctggctgaagtgcg

SEQ ID NO: 38707 - DNA, 371 bp, Zea mays
  unsure at all n locations
  Clone ID: LIB3062-008-Q1-K1-A5
ctgaacccttcaaacaaacctggaaggatcaccataattacaaggatgggggcagagaacatgagagtgaagttgcctcatcttatccgtgctgttcgcaatgctggattaattgtcacatggattactgatcctatgcatggaaacaccatcaaggccccttgtggcctgaagactcgtncatttgactcaattctggctgaagtgcgcgcattcttcgatgtgcatgatcaagaaagaagtcaccccagaggcatccaccttgaaatgactgngcagaacgtgaccgagtgcattggtggatcacggactgtgaccttcgatgacctgacgaccgctaccacacccactgtgacccaaggctgaacgcc

SEQ ID NO: 38708 - DNA, 439 bp, Zea mays
  Clone ID: LIB3062-014-Q1-K1-D6
gcatgactgagtttgtaggtaccgtgaattggcacatcgggttgatgatgcccttggattcatgggtgcaactgggctgacaatggaccagcctttgacgacgatgatcgagtttctggacctaacatgagtgcttcctcctaccttacaagcaagccttaacccggcaggattccaccaccggcctttctataaatggttcggccacatactcttggttcggagagcgacacccgaacttgaatggcccatatgtagagtctctgagggagatcgcaaaccctcttggtatcaaggtgagccacaatatggagcccggagagctggaaaatctgatcgacatactgaacccgacgaacaagcccgagaggatcaccgtcatcacagggatgggcgcagagcacatcagggtcaagttacctcaccttatccgcgcggt

SEQ ID NO: 38709 - DNA, 198 bp, Zea mays
  Clone ID: LIB3062-024-Q1-K1-D2
ggagaaggagagggatgcacaccacttgcgggggctgcttcctcctgcagttgtgcctcaagaactccaaattaagaagatcatgcacaacctgcggcagtaccaggtccctttgcagcgctatatggccatgatggaccttcaggagaagaacgagaggcttttctacaagcttttaattgataacgtggaagaact

SEQ ID NO: 38710 - DNA, 409 bp, Zea mays
  unsure at all n locations
  Clone ID: LIB3062-026-Q1-K1-C8
ggagaaggagagggatgcacaccacttgcgggggctgcttcctcctgcagttgtgcctcaagaactccaaattaagaagatcatgcacaacctgcggcagtaccaggtccctttgcagcgctatatggccatgatggaccttcaggagaggaacgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaggggaaggtcctagaagttctaaggaactggccacataggaacattcaagttatctgtgttactgatggtgagcgaatcttgggactnggagatttgggttcttagggaatg

SEQ ID NO: 38711 - DNA, 351 bp, Zea mays
  Clone ID: LIB3062-038-Q1-K1-D1
acggtggaggctggaactggtattgcagaactcattgctcttgagatttcaaaacagacgtcgggtccgattgaagagtgccgcaagaagatttggttggtggactcaaagggtttgattgttgactctcgtaaaaactccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctttcattctgaatgtact

SEQ ID NO: 38712 - DNA, 421 bp, Zea mays
  Clone ID: LIB3062-014-Q1-K1-A12
aaacttagttctgctagcagatgaagtgtatcaacagaacatttatcaagatgaacgggcatttataagcgcaagaaaggttatgttcgacatgggtccaccaataagcagtgagcttcaggttgtttctttccacactgtgtcgaaagggtactggggagagtgcggacaacgtggtggatacttcgaaatgacaaatcttcctcccaagacagtagatgagatctacaaggttgcatcgatagcactgagtccaaacgttcctgggcaaatttttatgggagtaatggttaaccctcctaaacctggagatatctcgtacctgaagttcgctgctgaaagcaagtccatccatgaatctttgaggaggagagcacgcatgatgacagatggtttcaacagttgccgaaacgtcgtgtgc

SEQ ID NO: 38713 - DNA, 411 bp, Zea mays
  Clone ID: LIB3062-033-Q1-K1-G2
aacaaagcaacagcagagctattgcttggagctgataaccctgttattaatcaaggactggttgctgcacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtaccggtattatgaccccaagactgttgggttggattttgagggaatgatagctgacattgaagctgctcctgaaggttcttttgttctgctacatggttgtgctcacaacccaactggaatagacccaactcctgaacagtgggagaaaattgcagatgtcattcaagagaaaaagcatatgccattctttgat

SEQ ID NO: 38714 - DNA, 411 bp, Zea mays
  Clone ID: LIB3062-057-Q1-K1-B7
acgctttccccgtcggcgcctcctcagatttaatttggacgccgtcggcgccgctgacccaggtggtcttgatggcgcccgctgtagaagccgtgaaggagacaggctcgttccatatggttcctgccttgaacgaaaggatactgtcatccatgtccaggaggtctgatgctgcacacccttggcatgatctggagatagcgtcctggtgcttcaaccatattcaactgcgtcattgagataccaaggggcagcaaggttaaatatgaacttgacaagaaaactggactgatcaaggtggaccgtgtgctgtattcgacagttgtttaccctgacaactatggattcattcctcgcactctttgcgaagacagtgatccttttgatgtactgggtattattcaagaacct

SEQ ID NO: 38715 - DNA, 423 bp, Zea mays
  Clone ID: LIB3062-001-Q1-K2-H5
atcaggcgcttcttgtagtcctcgaagaagcgcctgatttcagccaagcggtgaggtgggagctccttgatatgattgtaatgcctgtactcgggatcatcagcgcacactgcaatgatcttgtcatctgcctctccctgatcaatcatcggcataaggccgatagccttcgcacgtaggaaacagcctgggataacaggctcctgcattataaccagtacatccaaaggatcactgtcttcacaaagagtgcgaggaatgagaacaaggaggttgctgtgaacgactttctaccagcgagcgccgcttatgaagccatacagcactctatggatctgtatgctacatacatcgttgagggcctgaggaggtaggattctgatggctaggaaagtggggaggatgttgacgaaaaactgggag

SEQ ID NO: 38716 - DNA, 421 bp, Zea mays
  Clone ID: LIB3062-009-Q1-K1-B3
ctttttgttggaagatgtctacaggaacccaagcccggttcagtttgaagggccaagtgcccattcaaagcctatgtgagttgtccttgaaggttcagaactttttggccggattaaaaaagttcaggattccttggaaaaggtgaaaaggattgtgaaccctgggtgctcgcaggatgttcttaaagcggcgctgagtgccatgtcttctgtgacggaaacactgaacatcatgacttcatcttctaccggccagactccactgagtcattaggtaccatttcatggtatggatcataatccccacttttttcagtggtggcgattaacgagtttaggaacagcaaccctggtatcatacgggttattctttttgtagccttttggagagttctatcggttttggattcggtagtttatg

SEQ ID NO: 38717 - DNA, 178 bp, Zea mays
  Clone ID: LIB3062-030-Q1-K1-F12
taaacaatgacaccgtcggccattacgagtcacacatggcgttcacaatgcctggcctgtaccgagtcgtccgcggaattgatgtgctctaccccaagttcaacatcctgtcttctggcgcggacctttccatctacttcccgtacactgagtcgcacacaaagctgaactgacttaa

SEQ ID NO: 38718 - DNA, 478 bp, Zea mays
  Clone ID: LIB3062-021-Q1-K1-C5
tgcagatgaaccatgccgacttcatcatcaccagtaccttccaagagatcgccggaaacaaggacaccgtcggccggtgcgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggaacaggccgagttcaagaagat

SEQ ID NO: 38719 - DNA, 457 bp, Zea mays
  unsure at all n locations
  Clone ID: LIB3062-033-Q1-K1-D2
acgctttccccgtcggcgcctactcagatttaattcggacgccgccgccgccgctgacccagggggtcttgatggcgcccgctgtagaagccgttaaggagacaggctcgttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcgtcagttgtttaccctcacaactatggattcattcctagcactctctgtgaagacagtgatcctttggatgtactggttataatgcatgagcctgttatcccatgctgnttcctacgtgcgaaggctatcggccttatgcc

SEQ ID NO: 38720 - DNA, 380 bp, Zea mays
  Clone ID: LIB3062-009-Q1-K1-D1
cgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatc

SEQ ID NO: 38721 - DNA, 425 bp, Zea mays
  Clone ID: LIB3062-041-Q1-K1-D4
cctgaacgggcacatccgctggatctccgtccagatgaaccggtccgcaacggcgagggtagcgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggag

SEQ ID NO: 38722 - DNA, 431 bp, Zea mays
  Clone ID: LIB3062-022-Q1-K1-C9
cgaccgtgtgaagaacttgactgggctggtggagctgtacggccggaacaagcggctgcgggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggcctgctcgt

SEQ ID NO: 38723 - DNA, 419 bp, Zea mays
  unsure at all n locations
  Clone ID: LIB3062-002-Q1-K2-F9
gacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggntacttcgctcaagctaatgtcttgggttaccctgacaccggaggccaggttgtctacatcttggatcaagt

SEQ ID NO: 38724 - DNA, 447 bp, Zea mays
  Clone ID: LIB3062-023-Q1-K1-D10
gacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgtgtccgcaacggggagctgtaccgctacatttgtgataccaagggcgcattcgtgcaacctgcgttctacgaagcgttc

SEQ ID NO: 38725 - DNA, 439 bp, Zea mays
  Clone ID: LIB3062-048-Q1-K1-G5
cccgtatacggaaaccgacaagagactcactgccttccatcctgaaatcgaggagctcatggacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcatgctgagttcaagaagatgtacagcctcatcgacgagtacaagttgaagggccatatccggtggatctcggcgcagatgaaccgggtccgcaaacgggagctgtaccgctacatttgtgataccaagggcgcattccggcagcctgcgttctacgaagcgttcggcctgact

SEQ ID NO: 38726 - DNA, 383 bp, Zea mays
  Clone ID: LIB3062-001-Q1-K2-G2
acctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccaaggcgggcttcaacgtatcgaggagaagtacacctggaagctttac

SEQ ID NO: 38727 - DNA, 387 bp, Zea mays
  Clone ID: LIB3062-002-Q1-K2-G12
atgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctctcctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctg

SEQ ID NO: 38728 - DNA, 382 bp, Zea mays
  unsure at all n locations
  Clone ID: LIB3062-015-Q1-K1-B9
ggccgccatcgcgcgccttctcccggggcgcaccgacaacgccgttaagaaccactagaactcgtggctcaagcggaagctcgccaccgccacggcgacctccagcggcagcgatgctgagcgggcgtgcaagcgcgcaagccctggcccggggagcccgacggcgtcggaccgcagcgacctcagccacggctgcggcgccgcgcaggtgttccgtcccgtcccgcgcgccggaggcttcgacgccatcagcgccgcagacgtgcgccctccgcccccgccagcagtcgcagacgaggacccgctcacctcgctctccctctcgctgccggtgctggaccagtcgccgtcgggcttncaccacgacagcgcccggagccac

SEQ ID NO: 38729 - DNA, 470 bp, Zea mays
  Clone ID: LIB3062-021-Q1-K1-F6
gcagcagctggagagttcactgaaacatatcagaacaaggaagagccagcttatggtcgagtgaagttcagcgctccaacggaaggagaagtcactgcaggaggagaacaaggttctgcagaaggagctcgcggagaagcagaaagaccagcggcagcaagtgcaacgggaccgaactcaacagcagaccagttcgtcttccacgtccttcatgttaagggaagctgccccaacaacaaatgtcagcatcttccctgtggcagcaggcggcagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcag

SEQ ID NO: 38730 - DNA, 418 bp, Zea mays
  Clone ID: LIB3062-045-Q1-K1-B11
gccacttaaagatatatccttggctactggtgtagcagaaggcaccatcagaaattcgtagagggatctgtatccttatgcctcaaggctcatcccgaatacctacgccaaggaagaagacctgaagaatctctgcacaccttaggaggcttacttttttccccctttctgttactacataattcggaattagatttgtcaaagaggagtgagtgaagttgttcctcgttgtgactgtaccgggcaaggtgtcgtccccgccgtgcttaactttatgatggaatttcttttcagagcacctaccacctgaagatttgtgggatacgtatactcacttcggaaagaatgtagatagcaagcagttggacaagcacaagattttaatttaaaacatgattttgttctccatcttctgaag

SEQ ID NO: 38731 - DNA, 429 bp, Zea mays
  Clone ID: LIB3062-014-Q1-K1-A5
tcggatggtcccaagcttgttagagaattgttcagggtggctgatgatctttctccgtcagttgtctttattgatgagattgatgctgttgggacaaagaggtacgatgctcattctggtggcgagcgtgagattcagagaaccatgttggagttgttaaatcagctggatggttttgattcaagaggagatgttaaagttattctagcaacaaatcgtattgagagtcttgatccagccttgcttcgcccaggtcgaattgacagaaagattgaattccctttacctgatgtcaagactaggcggcgcatcttccagatacacacatcgaaaatgacactggctgatgatgtaaacctagaagagtttattatgtcaaaagatgagttttcaggtgctgacatcaaggccatttgtactgaagctggc

SEQ ID NO: 38732 - DNA, 404 bp, Zea mays
  Clone ID: LIB3062-034-Q1-K1-H3
caaacgttttgatagtgaagttagcggtgatagagaagttcagcggacaatgttggaattggtgaatcaactggatggattcagcatcgatgagagaataaaggtcatagctgctactaaccgtgctgacatccttgaccctgctctgattcgatctggacggttggaccgaaagattgagttccctcacccatccgaagaagcatgagctagaatcttgcaaatccattcaaggaaaatgaatgtaaatcctgatgtcaactttgaagaattggctcgctcaactgatgacttcaacggaacacagctaaaggcaatttgtgtagaagctggtatgcttgccctacggcgggttgctacagatgtaactcacgaggttttcaatgaatggatcgtacaggttc

SEQ ID NO: 38733 - DNA, 422 bp, Zea mays
  Clone ID: LIB3062-039-Q1-K1-F1
ggaacatgcaccatccattatatttatggatgaaattgactctatcggatctgctagaatggagtctggaactggcaacggtgacagtgaagttcagcgtactatgcttgaacttctaaaccagcttgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggtgcacgtta

SEQ ID NO: 38734 - DNA, 404 bp, Zea mays
  Clone ID: LIB3062-002-Q1-K2-B3
ggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagcccttagaaagaccaaacgaatgtttctgggtgaaaatttaaaaga

SEQ ID NO: 38735 - DNA, 425 bp, Zea mays
  Clone ID: LIB3062-011-Q1-K1-F6
cggacgcgtggggttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcaggacgatgatgatgacgttcctgagcttgtccctggagagacatttgaggaggccgcggaagagaaaaaggagtcctcatgattttgctacatgcctgctgttgttaaaccatgccattagaagggacctgttgagaactctgacctaccttatttgtgcctgtgggactggttatgtcatgatcg

SEQ ID NO: 38736 - DNA, 364 bp, Zea mays
  Clone ID: LIB3062-026-Q1-K1-F3
ctcgagtcgagactcgagaggcacctgatctttccttcccgtcttcctcccacacgtccccgtcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaagcattcttgagcgttaccagcgttacctcattgaaagaagggcagtacttaacc

SEQ ID NO: 38737 - DNA, 435 bp, Zea mays
  Clone ID: LIB3062-043-Q1-K1-C6
ggagaagcaaaagaatgctatcaaatcgagtcatcttaaattggcaacattagagcagcagagagctgatgagaatgtgctgaagcttgtggaagaacaaaaagtatgtaccttggctcctgtgatatgatgctttaggtttcaaacaatgtgtcctatggtagtcttactgtatggaaactacagagggagaaacatgctgcgttaaagaagattctgatgttggaacaacaattggatgcaaaacaaaagcttgaattagaaatacagcagttgaagggcaaactaaaagtgatggagcatatgccaggtgatgaagattcagcgtcaaagaataaaattaatgagctgagtgaggcattgcaagaaaagatagatgaactggatggaatggagtcacttaaccaaactctggttatcaaagaaagcaaaagc

SEQ ID NO: 38738 - DNA, 456 bp, Zea mays
  Clone ID: LIB3062-044-Q1-K1-A11
tatcgggtccacacctcgacgcaactggaagcttcgcttcaatctgccctactcctccgccgcctccagcaccggagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcc

SEQ ID NO: 38739 - DNA, 424 bp, Zea mays
  unsure at all n locations
  Clone ID: LIB3062-039-Q1-K1-A5
gcacagcctcgcctccgtaagcagagtgtgtcgttgcggaggcaggaagagagacgacggcggccatggggacgtccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaagaaacgttgggaatgagaatgctactaaagtctcaagcgcctntgctggcaccagagagaaatgtgttggatgcagcaagacagtctatcccac

SEQ ID NO: 38740 - DNA, 379 bp, Zea mays
  Clone ID: LIB3062-030-Q1-K1-A5
tctcagttggatagactgtcttgcgtgagagggtcactgttaataacactatgtgccagaagagctgtttgaagtgctgccatggagggtgcaccatcagcccttctaactacagcttcccctcgtgcgcaatgtagttagaagggctggtggtgcaagcaccaccacatccagctgatcaaggagaaggggaacttcagccagcttgagaatgaccacgagaagacatcacaggctgggtcactggaggacgatgaacaagagtattgatcactgagcacaaccacagatgaataatgaatcctcttgcatttgcctagagcactatgtatttctgtggcgtggttcgatttcagttttaccaatggaggtcatgtgt

SEQ ID NO: 38741 - DNA, 438 bp, Zea mays
  Clone ID: LIB3062-003-Q1-K1-F4
agagagagaggggaagagagagagagagagagagagatagatgtggtaactcaggaactgttcttatgcatgcagcagccataagcattgctactagggtttcatgcggggcgaagcagttggtctctgccgcctgaacgccgccggaatctgcgaggcctccccgagctgcgtccgtcgtcagataaggcagccgccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccggcgtgccggctccaggaactgagatggcgcagctagtgtgcggaagatgccacacccttctcatgtacatacgc

SEQ ID NO: 38742 - DNA, 450 bp, Zea mays
  Clone ID: LIB3062-024-Q1-K1-H10
atggatcagccatttatggctgctatcaatagccagcctttcgtggaggatattgagccagggaagaaagccagtggggacatgcctgcgacaacaggaagcggatgcttcgaatgcaacatctgccttgattttgcatcagaaccagtggttactttctgtggtcatctctactgctggccttgtatctacgagtggctgcgccctggggtggagtcagctgccagcgacaacagcagttcggcaaggcggcaatgtcctgtatgcaaggcaacactctcaacggacacccttgtgccactatacggccgtggaggcaactcaaagaagtcacttgatggcatggccatcccgcgccgtcccatggtacaccgggagactgttgaggagcaacagaatgcacagagcaatgtcaatgaccagcactaccaccagagcatggaagacaac

SEQ ID NO: 38743 - DNA, 445 bp, Zea mays
  Clone ID: LIB3062-019-Q1-K1-G1
gcgcagagaaactctttgttctgttagacatgtacgagataatgtgcgagcttcaaacagagattgataccatggtcgttggagaatcaggttcgcaaatgcgcgactctgcactgagtttaacaaaatgcttagcacaaacagcacaaaagactttcagtgattttgaagaagctgttgaaaaggatgcaacaaagaatattcatactgatggaacagttcatcctttaacaagctatgtgatcaactatgttaagtttttgtttgactaccagtcaactctaaagcagcttttccaggagttcaaggaagatgggacaggttctgagctggcagctgtaacaatgaaaatcatgcaagccttacaaaataatttagaagcaaaagcaaaacaatacaaggatcctgcattgatgcacatatttttgatgaataacattcacta

SEQ ID NO: 38744 - DNA, 370 bp, Zea mays
  Clone ID: LIB3062-043-Q1-K1-E7
aattaaggcaaagaatctccaagtttgcttcgctcttgcattgaaccatggagtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgccagacgagctcctcgaggaagagtactacgacgagcagctgccggagaagaagcgccgcctcaccccagagcaggtgcttctgctggagaggagcttcgaggaggagaacaagctggagccggatcgcatgacggagctggcgcgcaagct

SEQ ID NO: 38745 - DNA, 367 bp, Zea mays
  Clone ID: LIB3062-028-Q1-K1-G3
accaccaccttcctgctcctccccttcatcttcaccacaaccccttcctcccctcctgtcagtgcccctccctgcaagacttccgaggtatggcgccaatgctgcggaagcgcccgacgatgtactgcggcgcggacgacgtcggcgtcggaggcgaggaggcgagctgcggcgcgacgaacgaggacgaggtgtcggacgacggctccctgcaggccgtcgggcccggggagaagaagcggcggctgaacgtggagcaggtgcggacgctggagaagaacttcgagctcgggaacaagctggaggcggagcgcaagctgcagctggcgcgcgcgctgggcctgcagccgctgcaggtggccatctg

SEQ ID NO: 38746 - DNA, 394 bp, Zea mays
  Clone ID: LIB3062-021-Q1-K1-G12
gaccccgataagctgaagcctggcgatttagttggagttaacatagacagctacttgatactagatacattgccttcagagtatgactcacgggttaaggcattggaagtagatgagaaacctactgaggattacaatgacattggcggacttgagaaacagattcaagagcttgtggaagcaatagtgttaccaatgacacacaatgaccgatttcaaaaattgtgcattcgttcccccaaaggggttcttttgtatggaccccctgggaccgggaaaacgctcatggctcgtgcatgcgctgcacagactaatgcaacatttctgaaaatggctggtccacaacttgttcagatgttcattggtgatggagctaaggctgtagaaatgcttt

SEQ ID NO: 38747 - DNA, 415 bp, Zea mays
  Clone ID: LIB3062-029-Q1-K1-C8
gcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaagaactggcaagacactcatggctcgtgcatgtgctgcacagacgaatgcaacgtttcttaaattaactggtccacaacttgtgcagatgtttattggtgatggagcaaagcttgtccgggatgcattccagcttgccaaagagaaagctccttggattatattt

SEQ ID NO: 38748 - DNA, 433 bp, Zea mays
  Clone ID: LIB3062-038-Q1-K1-H8
caagacaaactatattccttcctgttgttgggctagtggaccctgacaagctaaagcctggggatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggaacaaagcttgtccgggatgcatt

SEQ ID NO: 38749 - DNA, 300 bp, Zea mays
  Clone ID: LIB3062-018-Q1-K1-D6
gcagacaaaccgaactcgcacctcgcacctcgcatcgtcttgtcgacacacctccagctccgaagccctgctccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccatgagaaaattaagctcaac

SEQ ID NO: 38750 - DNA, 414 bp, Zea mays
  unsure at all n locations
  Clone ID: LIB3062-025-Q1-K1-D8
agccagtcagccacatcactagcgatctgtgcagaggcaatggcgtccaaggttgggctgggggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaagcgganggcgagggcggcgccgtcgtcagctgggccatggagttcgacaag

SEQ ID NO: 38751 - DNA, 428 bp, Zea mays
  unsure at all n locations
  Clone ID: LIB3062-018-Q1-K1-B10
cttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaagtggagcgccggcccttcacggcggaggaggacgcggccatcgtccgcgcccacgcgcgcctcggcaaccgctgggccgncatcgcgcgcctnctncccggccgcaccgacaacgccgtcaagaaccactgg

SEQ ID NO: 38752 - DNA, 383 bp, Zea mays
  Clone ID: LIB3062-046-Q1-K1-D4
gtgcactgtttgcagcatccgatccccaagtcccggaatactgcgagacgctcaagtcggaggactggccagggggtgcctgcattaactatgactgtagtccgatgaatgcgtctgaagaagcgcacaatcttgagacctcgcagctggtctgggagaagacactggagatggtcggccttccgccggatgccctggagaagctcatcgccggagaatcagttcagtgccgttacggacaacaggatacaactttttagttagcagtttagaggtggtttgttcggttgttatgtcattttgatcctaaatttgcagggaggaaaacacagggaaaggagaaaaagaatttgttgacagctacccaatcttggctcttttct

SEQ ID NO: 38753 - DNA, 409 bp, Zea mays
  Clone ID: LIB3062-053-Q1-K1-D9
gtccgcgagcgctgcagcacctcggatcccgccccaatggcaacagcgtgtccgccgctctcgctgccgtccacctccctcttccgcggcaggtccgcccgcgccgggcccagacgcaggcagctcacggccgtccgctgcagcgccgtcggagaggcggtagtggaggaggcctcgcccgggacggcggaagagccgctgctggtgagcgcaatcagagggaggaaggtcgagaggccacccgtctggctcatgaggcaggccgggaggtacatgaagagctaccaattgctctgcgagcggtatccttcgttccgtgaaagatcagaaaatgtcgacctagttgttgagatctctttgcaaccatggaaggttttcaagcctgatggagtcatcttgttctcggaca

SEQ ID NO: 38754 - DNA, 418 bp, Zea mays
  Clone ID: LIB3062-056-Q1-K1-D10
agcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatg

SEQ ID NO: 38755 - DNA, 423 bp, Zea mays
  Clone ID: LIB3062-009-Q1-K1-F6
atccaaaggaagcaattagaaaagaatgcttaattgatggggagctccagggcgttgggcagttgcatccacgtagtcaaggagttgagacattaggaacaatatacagttcctcactctttccaaatcgtgctcctgacggtagggtgttacttctaaactacataggaggtgctacaaacacaggaattgtttccaagactgaaagtgagctggtcgaagcagttgaccgtgacctccgaaaaatgcttataaattctacagcagtggaccctttagtccttggtgttcgagtttggccacaagccatacctcagttcctggtaggacatcttgatcttctggaagccgcaaaagctgccctggaccgaggtggctacgatgggctgttcctaggagggaactatgttgcaggagttgccc

SEQ ID NO: 38756 - DNA, 358 bp, Zea mays
  Clone ID: LIB3062-022-Q1-K1-A9
cctgcataaacccgaaggattggatctgattagccgttattcttgtgtcccttccgcttgcagcacgatggcagtatgatcataaaccggaagaaggaaccgaggaatggaaacttctggaagcctgcataaacccgaaggattggatctgattagccgttattcttgagatcttttgttagagttttcccttctgtagggctaagaccacgtgcagtttcattatatattttgcatctgtagaatcgtgaataaatatgatgtagtaatgctgtagctgtctgtatctatctgctgttttttccccatgtgaatgagagaaccattggcttctgtattacgaaggattcaggtttct

SEQ ID NO: 38757 - DNA, 430 bp, Zea mays
  Clone ID: LIB3062-011-Q1-K1-B9
gggggaggccgccaagaacggggccgccgccgcggatggccacaagcctgggccggtggcattcttcgccgcggggattagttcggtgcttcaccccaagaacccatttgctccaacattgcattttaactaccgttactttgagacggatgcaccaaaagatgcacctggtgcaccaagacaatggtggttcggcggtggtactgacttgactccttcatatatcattgaagaggatgtgaagcatttccattctgttcaaaagcaagcatgtgataaatttgatccaagttttcacccaagattcaaaaaatggtgtgatgattatttctatattaagcaccgtaatgagcggcgtgggctaggtggaatattttttgatgaccttaatgattacgatcaagaaatgcttctcaactttgctacagaa

SEQ ID NO: 38758 - DNA, 396 bp, Zea mays
  Clone ID: LIB3062-050-Q1-K1-B3
gacttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgc

SEQ ID NO: 38759 - DNA, 364 bp, Zea mays
  Clone ID: LIB3062-053-Q1-K1-C4
cgcaagggcacggcggtcatcaccggcgcgtcgtccggcctcggcctcgccacggcgaaggccctggcggagacaggcaagtggcacgtcatcatggcctgccgcgacttcctcaaggcgtcgcgcgcggccaaggcggccggcatggacaaggacagcttcaccgtcgtgcacctggacctcgcctccctggacagcgtccgccagttcgtcaagaacgtgcgccagctggagatgcccatcgacgtggtggtctgcaacgccgtcgtgtaccagcccaccgccaaggagccgtcctacaccgccgacggcttcgagatgagcgtcggcgtcaaccaacctggccactttctcctcgcgcgcg

SEQ ID NO: 38760 - DNA, 442 bp, Zea mays
  unsure at all n locations
  Clone ID: LIB3062-018-Q1-K1-E9
acaccggcacaccaacacgctggccgggaacatcccgcccaaggccgggctgggcgacctccgcggcgtggcggcggngctgcgcggccagaacggctctgccatgatcgacggctccgagagcttcgacggcgccaaggcgtacaaggacagcaagatctgcaacatgctaacaatgcaggagctgcaccggcggtaccacgaggagacgggcatcacgttcgcgtcgctctacccggggtgcatcgccaccacggggctgttccgcgagcacatcccgctgttccggctgctcttcccgccgttccagaagttcgtcaccaaaggcttcgtgtcggaagcggagtccggcaagaagctggcgcatgtggtcagcgaccccagcctcaccaagtcggnggtgtactggagctggaacaaggactccgcgtcgttcgagaac

SEQ ID NO: 38761 - DNA, 277 bp, Zea mays
  Clone ID: LIB3062-010-Q1-K1-G7
ctggccgggaacatcccgcccaaggccgggctgggcgacctccgcggcctcgcggcggggctgcgcggccagaacggctctgccatgatcgacggctccgagagcttcgacggcgccaaggcgtacaaggacagcaagatctgcaacatgctaacaatgcaggagctgcaccggcggtaccacgaggagacgggcatcacgttcgcgtcgctctacccggggtgcatcgccaccacggggctgttccgcgagcacatcccgctgttccggctgctct

SEQ ID NO: 38762 - DNA, 254 bp, Zea mays
  Clone ID: LIB3062-026-Q1-K1-H5
acctgaaagaggtggtggaagccaacaaggaagaccgtctcaggaaagcgatggaggcacagacaatcatcgccgaagagctgaaacggtttgaggcgtggcgggactcgctggagaccgttccaaccatcaagaagctgaggtcttacgccgacaggatccgggcctcggagctcgagaagtgcctgcagaagatcggggacgacgctctcaccaagaagacgaggagagccatcgaggagctaagcaccggc

SEQ ID NO: 38763 - DNA, 429 bp, Zea mays
  Clone ID: LIB3062-034-Q1-K1-A4
ggtggcacctccattcatctatattgatcaggttaagaattcactaactggtcggattgaggtttctgctcagaatgtgtggattggaaaaggaggagcctacaccggagagatcagtgcagaacaactggtggacatcggctgtcaatgggttattcttggacactctgagcgtagacatattattggtgaaaatgatgagtttattggaaagaaggctgcatatgcattgagccaaaatgttaaggttattgcctgcataggagagctgctggaagagagggaagcaggcaaaacttttgatgtatgttttaagcagatgaaggcttttgcagatagtatttcaaactgggcagatgttgtaattgcatacgaacctgtttgggctattggaaccggaaaagttgctacttcttgaacaacccaaga

SEQ ID NO: 38764 - DNA, 398 bp, Zea mays
  unsure at all n locations
  Clone ID: LIB3062-044-Q1-K1-F8
cggacgcgtgggcggacgcgtgggcggacgcgtgggccgatcgctcctctccactgtccagattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcanagttaaatatgagcttgacaagaaaactggactgattaanggtgatcgagtcctatactcat

SEQ ID NO: 38765 - DNA, 414 bp, Zea mays
  Clone ID: LIB3062-015-Q1-K1-G12
gtaaacctcattatatcattgcaaagggaggaatcacttcatctgatattgctacaaaggcgctggaagctaaacgtgccaaagtcatgggacaagcattagctggtgtacccttgtggcagcttggtcctgagagtagatttcctggggtcccttacattgtttttcctggtaatgttggtgataacagtgctcttgctaaagtggtgaaaagttgggcttccccatctagaagttctacaaaagaaattcttcttgatgcggagaatggcggttatgctgttggtgctttcaatgtgtataaccttgagggaattgaagctgttgttgcagcagcagaggctgaaaagagtcctgctattcttcagattcatccgagtgctctaaagcaaggtggagtcccactggtagcat

SEQ ID NO: 38766 - DNA, 442 bp, Zea mays
  Clone ID: LIB3062-031-Q1-K1-E8
atggggaatgcgttgtttaaactcaacgaatggaaggaggtacttgagtgcaaggttgaggtggagacagaaatgttatccccatttgacttggcggctagttggagagctcatcaggagtattttcagccttcaagggtgcgagggactcacgatgtcactatcaaccctgggttagaaggcagggccaagaatggcttcgcttctggtttgaagcttgatttagacaagtatgtagttccaacaccaaacatgggctcaggtgttgtttatgcagctagtttgactgaaaatccacgctcattattgcaaactgcgagttcctcatacaatgataccacaaaggacattttgcacaactcaactaaaggcgattcatccttgaatcactatgttaacactatgaagagcacaattggagggcatgcatcgtcactggaag

SEQ ID NO: 38767 - DNA, 339 bp, Zea mays
  Clone ID: LIB3062-034-Q1-K1-A8
ctagagttttgcagcaacctagcactaaggctcctgctaaaaagggaaaacagcaagcattgacaagtgctgaagaaccagatgagcctcctctgtgaagaggagcctacaccggactgatcagtgcaaaacaactggtggacatcatctgtcaatggatgattcttggacactctgagcgtagacatattattggtgaaaatgatgagtttattggaaagaaggctgcatatgcatagagccaaaatgttaagggcattgcctgcataggagagctgcttgaagagagtgaagcatgcaaaactcttaatgtatgttgaatgcagatgaaggcttttg

SEQ ID NO: 38768 - DNA, 373 bp, Zea mays
  Clone ID: LIB3062-056-Q1-K1-F9
gcgcgcctcggcttcagcgccatggcgccctccaggaagttcttcgttgggggagactgggagaagaacgggcggaagcacagtctgggggagctcatcggcactctgaacgcggtcaaggtgccggccgacaccgatgtggaacgtgctcagcatactgcctatatcgacttagtccggcagaagctagatcccaagaacgctgaggctgcgcagaactgctacaaagtgactaatgacgcttgaactgatgagatcagccctggcatgatcaaacactgcggagccacacgggcggtactggggcactcagagagaacgcatgtctttggggagtcagatgagctgattgggcacaaagtgcgccatgctc

SEQ ID NO: 38769 - DNA, 231 bp, Zea mays
  Clone ID: LIB3062-001-Q1-K2-F7
caatttagaagcgcccctcctcctctccccatccgtgacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgtcgttgaggtcgttgtcaagcctacttatgtgttcctcccggtggtcaagagccagct

SEQ ID NO: 38770 - DNA, 466 bp, Zea mays
  unsure at all n locations
  Clone ID: LIB3062-045-Q1-K1-F6
ctcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgngtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttg

SEQ ID NO: 38771 - DNA, 443 bp, Zea mays
  Clone ID: LIB3062-041-Q1-K1-F9
ccggcttacactttcagcccttgcgcatgcggtgagagccaagaaggtgctgatactagctggaatgtgaatgatgccgataaaaacaacagcgaaagggaagatagtgatttagctctggagaaggagagtgctacattcacctgacagaagcagcacctggaagaattatctgacgcaaaggaaacatttattggaggtcctgaggcagaggccaaatccaacagcacacaggattctgacaatccaattgctaaggtgcggagcagtgtagcatctgacaagatgagagatgggtgcaatgctaatgccattccgtgtcctgctacttcaaatcatacaactgaacccagctacgtagcttcccaggaagccagtccagcaagtacaaaagacacagctatgcctgaacaagttgaaagaccaagttctgaggaattact

SEQ ID NO: 38772 - DNA, 53 bp, Zea mays
  unsure at all n locations
  Clone ID: LIB3062-041-Q1-K1-G1
tctgttgcctctggcttgatctgtggtgatgggatctgctaattcntcacact

SEQ ID NO: 38773 - DNA, 452 bp, Zea mays
  Clone ID: LIB3062-041-Q1-K1-G10
cgagtggatctcttaattgttgagagggttgcccaaacgcggtatataaggcatacccagtaaagcttacaagtgaagcagatatggagatggcgactaaagttgctgtttccatttttatagaatttcaagattacaatggatctatgaaaagatcgtgtatttacaactacaacggaatagtatacaaagtcaacaccaatgattaaatagaatttatggctacacaaaccgttgaagatagttctagacctaagccaaaacggactggcgcaggtagtttattgaaacccttgaattcggaatatgggaaagttgctccgggttgggggactactccttttatgggggtcgcaatggctttattcgcgatattcctatctataattttagaaatttataattcttctgttttactggacggaattttaacgaattaggtttctactaac

SEQ ID NO: 38774 - DNA, 437 bp, Zea mays
  Clone ID: LIB3062-041-Q1-K1-G11
ctgtcacacacacacacacagacaagtggtttccaaagccaagtgtgtgtactagcagccaggtagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaagga

SEQ ID NO: 38775 - DNA, 400 bp, Zea mays
  Clone ID: LIB3062-041-Q1-K1-G12
cgacgcggcagcgaggaggaagcaaaggaaaggggatatgtcgaggccgcccaacaggagcgacgcgcacctctccgccgaggacgaggcggcgctggaggccgaggtgcgggagtactacgacgactcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgaccggaacgggtttcatcaagatggacaaagctaaaggcgccccc

SEQ ID NO: 38776 - DNA, 448 bp, Zea mays
  Clone ID: LIB3062-041-Q1-K1-G3
ctgctgtgggtacagcatccattacacccctcatatcagcattgccattctatttcacttatttggttgctactgggcgactcaattcattctcgcatgctcttcaactgtggttgcgggatcagttgcttcatactactgggcgcgtggtgaaatatcacatgatataccatttctcactgtagtctcttcactgaagcgactgatgcgctacagccttggatctgttgctctgggttcacttgttgtatctgttgttgaatgggtgcggtttatactagaatgccttcgtcgcaagttgaagctagttgattctgcccgagagagctgctttggaaaagcgacgtcctcctcttctgaatgctgcctgggttgcatagactggaccctcaagtcagtaaatcgaaatgcctacattatgattgccatcaccgggaaaggtttcttc

SEQ ID NO: 38777 - DNA, 404 bp, Zea mays
  Clone ID: LIB3062-041-Q1-K1-G4
acggtccgttcgctcctcctcctcccagccgcagctggtcgcggctgctgcggtccttacaagtgggctgctgctgctggcggcggctgccgaaacggcgtcggcggctgtgatctgcgacaaggcgacgtcctcggtggcaccttgcctcgggtacgctatgggcatctcggcgtctcactccgcggagtgctgcaccacagtgcgctcgctcaacatccgcgcgtagtcggcggctgaccggcaggccacctgcaactgactcaagagcatgactggccgtctcggcagcctcgtcaacatggccaacgccagcaacatccccggcaagtgctgcttctccgtcgacttgcccatcagccccaccgtctactgcaccaagatcaactgatcgatggaaccat

SEQ ID NO: 38778 - DNA, 428 bp, Zea mays
  Clone ID: LIB3062-041-Q1-K1-G5
acggcgacctccacgacgaccctttcgccgcatctgctgactccaacggtgggcccatggttccgccgcccaccgagatgggccgcgaggagggattcctgctccgcgagtggcgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcggataagcaatactggaaggcgatatctgaacttatcccacatgagattgctaacatcgagaagagaggggcaaggaaagacaaggagaagaagcctgggatcgtggtgattcaggga

SEQ ID NO: 38779 - DNA, 431 bp, Zea mays
  Clone ID: LIB3062-041-Q1-K1-G6
ggactgagcatcgcacacgatcttcacgagcaggaagtatccaggatgctcacagggtggatgttttaagagtcagcatgtgggcatctcgcattaggatcaccattcacaaagcaggagcaccttaaggagtaaggaccaccattttatctggacctttccctctgaccgctttcttctcctgataattaaaaacgccataaggaatccccagctggttttctgagtctgggacaaggatgggctctatttcaacccccatccttgctgatatttccatgacaatttcatggttccaacatgatctttaggtgtttctagcatgtttccttgccgcatggtttgtagctgcatagcggcatggcatgcatgaagtagcgttctgtctctagggatccctaaaggcttgtaagaggagacgggttttatgc

SEQ ID NO: 38780 - DNA, 430 bp, Zea mays
  Clone ID: LIB3062-041-Q1-K1-G7
ggatgggcttcgagggcccggccccgccggcggtgccccacgcggagccgctccgcgcggggcagctctacttcgtgctcccggccgccgcgcgccgccgcggcctgcggcgcgaggaggtcgccgcgctcgccgtccgggcctcggccgcgctctcctcccgggcctccgcatccgcatccgcctccgccgcgccgggacggcggagacgcggcgccgtcgcgcccctcgtcttcgcgccgccgccagaggacgaggagcgcgagcagcacaagacgacggccttggcggcgccaccggtgcggcggcccgcgcgccccggcaggcgcctcgtgcgcttcgcgtcggacctcaccgcgatccccgagtgagtaggcgggtcgggctcagacggacgggaacgaattcgctgccattgaattggctctgg

SEQ ID NO: 38781 - DNA, 249 bp, Zea mays
  Clone ID: LIB3062-041-Q1-K1-G9
cagaaggagagcaccctccaccttgtgctccgtctccgtggtggtcagtaagtcatgggtcgtttaagctggcatgtgcctgcgtcgtgtggggccctctccatatggaggttgtcaaagtatctgctgttcgtgtcatgagtcgtgtcagcgttagtttaataatggaccggctgtgttgtgtgtgcatactacccataactattacaaatcatgaatcagtttgttgtttgaaaaaaattaatacat

SEQ ID NO: 38782 - DNA, 461 bp, Zea mays
  Clone ID: LIB3062-041-Q1-K1-H1
ccggattcccggtcgaccactcgttcgcccacgcgtccgatgaggtcccaggggatcgtactactggacgaaagcgtcaaggaaagggggggtcaacgtctagatgatcctatccgatgacgggaacgtgtcctagatccttgtgcaggacgatgacgtccaggttgagcagatgatgaaggacctcaagttcagcgagaaggggatggtctatgtgaagggcatctttgagacatgactgggagtttgatactctatctgtgagtgaacaatcgagtggagacgagtctttgctgcaacggaaactgcgtaagcgtaacccaggtgaggaaatgcaaattggacgggcaaatctctaccttggcttaaaggaaaaaagaagtgatcttcatactggatttgattattgtaagtgttgcccgtatgaggatagttaatgtatgaactcaaactaatgactt

SEQ ID NO: 38783 - DNA, 374 bp, Zea mays
  Clone ID: LIB3062-041-Q1-K1-H10
gttgaaatgaattttatgggcacactagtcatatctacagcatggttcatttctgagggtgggcaggtgggaagttcatgggggaccgtatttgcctgagatctgcagcagccacaggagccgataccaatctctgatctaggtcttaatgaaacagctgaccctgtgtgtgaaagtgacgtttgcgagattcttttcgacacttacactaagtcttacgatatcatctcatctgcatctgcaagaatattgccagtgatgatgtgttcagaggatgggatccttgcaggcgtcgaacatgataagagaccccttgaattgcttgctgaatcttgtgccatcaactccttcgacatagatcctcataacccctc

SEQ ID NO: 38784 - DNA, 442 bp, Zea mays
  Clone ID: LIB3062-041-Q1-K1-H11
atcaatatagtcacttcgtcttcctaatcacctaggggaaggcgaatatataatacatgttggtcatttgcaatggaaggagattaaatacatgacaccaagaagtcaggatcttggcataggaaacaaatacatagtctgtccagacctcaaaatttgagttggaatcttggaattgacatttccttataactcaattccagtattttgctgagaaaatcaattgtaacatggaatccaattccagccttttcaaattgtatctaggcgtagacatttctagaatttgtctagggcgacacaaaaggaaatgtattgcatttttattgcctaaaacaaactttggcattaggtcctgtttggatccttgaattgaattgtattctaacaatcataatttagacatagatcaattaagttaatatagttttacatggaaaaa

SEQ ID NO: 38785 - DNA, 365 bp, Zea mays
  Clone ID: LIB3062-041-Q1-K1-H12
gttggcttctcctccccctccggttcgggttcgggttcgtgaggttctccggggttgggttgcgtggttgagcggatcgagatggcggcgtctgatgttgagtaccgctgcttcgtcggcggcctcgcctgggccacggacgaccactccctccacaacgccttcagcacctactgcgaggtcctcgagtccaagatcatcctcgatcgggagactcagaggtcccgcggcttcggcttcgtcaccttctccacggaggaggcgatgcggaacgccatcgagggcatgaacggcaaggagctggacggacgcaacatcaccgtcaacgaggcccagtcccgctgctgccgtggaggcggcggctg

SEQ ID NO: 38786 - DNA, 417 bp, Zea mays
  Clone ID: LIB3062-041-Q1-K1-H2
caatgcatcattttgtccactaagacagtgcatgccctcctgcatgttagctattgcagggtccgttgtgtccaaaccaaggaaaggagaggcaggttcctcacatctctcctgccatatctgctactccagaagctttcctccacctcctctctgcttcaagagttcaaggtagctggcgctgcacgctcctagcagcgagcttgcagccatggagcccaggaagtcgaattatctcgtcgccctcgtcttggcgtcgttcttgctctccgccgtcgcaggagggcataggaagaagctcgatgacgcatcagaatcaatggagacattggaatccatgcaggaagacgacgaaatggcggttgtggtccacaagagaattctcagccaggtgaagatgaacgactacgcgagata

SEQ ID NO: 38787 - DNA, 370 bp, Zea mays
  unsure at all n locations
  Clone ID: LIB3062-041-Q1-K1-F8
ggggccgagggagggagcctgctccgctctgcagcacgaacatgatgaatccatcggtgtactgcttgtttccagcgcttcttgtagccactctcgcagctgcttcttcgtcctctccttcgtattccgtcggcaagcacccatggtggctgctggttctaggtcgcaaaggcagagaactcggccagtcgtcaaggtaccattaccagcatcagagcaagcagcccgagctgcanggagtggctatggaggtaaagatacccgatgaggatgcgacggccaggcggacggtcgatcatagcggtgacgccgaggcagggctgatctacagcgcggactacagcagcgtggccatgcatgctgcctctcc

SEQ ID NO: 38788 - DNA, 324 bp, Zea mays
  Clone ID: LIB3062-041-Q1-K1-E5
tcggtacaaaaccactacaaatcaccaactcatcaacaatcgtagaccatcattcattgcggggctaacaaattagtgcggctgggctctgattgaaacctttgcagccatgcctaggcttctcagccaactctgtctgcgacacgctcgtcgtggcctactctaatctgtcctgcctcttgtgcaacaacctccacaccgaccacgtctactactactcctggatcttgctcaccatcaacgtcgtcaacctcgcgctctacatggcgctcaccatccggtgcacttccaaccttgttgtcgctagcgagctctacccgatgc

SEQ ID NO: 38789 - DNA, 424 bp, Zea mays
  Clone ID: LIB3062-041-Q1-K1-E6
ctcacatccctcgagaagactcctgctcctcgccgatcgatacgatggccgtcttgtcggacctccacaccggcgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaaga

SEQ ID NO: 38790 - DNA, 428 bp, Zea mays
  Clone ID: LIB3062-041-Q1-K1-E7
ggcgggctccgacgtcttctgcggcatcgcgcagctggagttcttctacggtgagggccgcgccgcgatgcgcagcatctgctcggccttctccttcctggcgctgtcgctggggttctacgtcaactcgctggtggtgactctggtggcggtcgtgactaagcggcccgggtggctggcgacggacctcaacaccgtccacctggactactacttgtggctctggaccatcatcagcgtcgccaacctgctgctctacatggtgctcgccggccggtacacgcccaatcaggtcgccgctgacgtggtggatccgatgcgtcccagcaacagtggcggcagcgacgaatgattaatttggcacatcgatcgactgcaacttgatccgcttactatacagtaaaaaaacgagatatggtcgagtagga

SEQ ID NO: 38791 - DNA, 439 bp, Zea mays
  Clone ID: LIB3062-041-Q1-K1-E8
gactcgtccgattcttattgatgatctgattaaatcagagatatattcagattatgtgcatgctcatctgtcccctagtggtgaccggaagatacccactgatatggaagattatttgaagggttgcaaatttcttccaaagcttaacaatgatatcccaagtgcaagaaatactacctataaagaaagattcagcagcttggaaaacttggtactgatcatgtctgaggactatgcagtattaatacctctggaaacagcgtggtttggttattaccctgatggagcctttagcccagtgctgccccctcaagagacgaagctgtatacagaatattggattggcttgaagaccctggacgaggctgggcgtgttaaattcgtgtctgtgccatgaggtcacctgcgtatcaccagaagcgacatgaagaagtacatc

SEQ ID NO: 38792 - DNA, 337 bp, Zea mays
  Clone ID: LIB3062-041-Q1-K1-E9
aaaagcaaagcctgcaatggcatctgcagccaccgccgtggcgctcgtggttgttgccgccgtggcctcgctgacgcagctggccgcgtcggagtgctcggcggcggaccgcgacgcgctgctttcgatccgcgcggcgctgtcggaggaggagcggcagctgggcgtgttctcgacgtgggcggcgggcacggactgctgcgccgggtggtacggcgtggcctgcgacccgaccacggggcgcgtctcggacctgtccctacgcggagaggccgacgacgcggcgatggcgcccgcagtgcggcccgcgtcgggggtcatgtccgggtacgtctcc

SEQ ID NO: 38793 - DNA, 435 bp, Zea mays
  Clone ID: LIB3062-041-Q1-K1-F1
cgacgaagcggagccagcgccaacgaaccaactaaccaacggacggaagtggcgtggcgaggcggggccgccgcgaagccgagcaaatccaagcctccctcctctacccgttcctctcctgccttctcgggatctgcccgcccgccttgtgtgatcttgccgcctcgccccccgcggttggagctccggctgcacgacaccatgagcccccgcgcgtagaggctgggagagaggtagcggggaacaaagttaggcaccaacaaagttaagtggggaggccagagctggccagctgggtcgctgttctaccagagggatggacgggagcgccggctccttcgtcgccgtccgccggctctccggctccgaccgcgccgtcgccttccaccactcctcttcggcggaggtcgtgacggggtcgacggcgtggatcgg

SEQ ID NO: 38794 - DNA, 399 bp, Zea mays
  Clone ID: LIB3062-041-Q1-K1-F10
gaagcatgatctgatcaccgtaacgcaaacgctgacacccgatgaggtcctctttcgagcaggtccatcagagatgactgcatactctcattactgtggatcactactattcgaacattaaccagagtactcgcatcagaccagtctcttacgtgacttatttatccgctaggggtaccaactagatcatgtatgtgactgcaccattatgaaatatcctcaacttagagatgaattctgacttcactctagctacaatatgaatcggtttgcaatccctcatgcagaaaggactgatcgatctgcatctcaagctttgttcagaacgactggatctggatctggtcacaatcgagagcactccaagcacaccagtcttctggagtcactgatgccatc

SEQ ID NO: 38795 - DNA, 424 bp, Zea mays
  Clone ID: LIB3062-041-Q1-K1-F11
ccagagtggaatcctccatgctgaagaaaaggattacaagactgcttacagctacttggttggagcatttgaagctgtcagtgcactggatgacccgatggccatatttatcctgaagtacatgctcttgtgtaagataatggttaaccaagctgactatgttacaagaataatctcgtctaaagctgtcctaaaatatctgagtcctgatgttgatgctatgaatgctgttgctgatgcatactataaaagatctctcaagtattttgaaactgcccttcgtgattataagtcccagctggaggaggaccctattgtccacaggcatatttcttctctgtatgatacactgctggagcacaatctctgcatgttgattgatccctaactaatggcggagattgctcatatagcggaaatgatt

SEQ ID NO: 38796 - DNA, 423 bp, Zea mays
  Clone ID: LIB3062-041-Q1-K1-F12
acgccagagtgaaatcctccatgctgaacaaaatgattacaagactgctgacatctacttggttggagcatttgaagcttggggttcactggatgacccaaaagccatctttatcctgaagtacatactctagtgtaaaataatggctaaccaaactgactatgttacaggaataatctcacctatagctgtcctaaaatatctgggtcctaataatcatgctatgaacgctgattcttatacatactctaatagatctctcaagtattttgaaactgcccttcgtgattataagtcccatctgtacgatgaccatattgtgcacagacatatttcatctctatatgatacacttctatagcataatctgcacaggattactgaaccctaattaatgccagatattgctcatatagctgatat

SEQ ID NO: 38797 - DNA, 431 bp, Zea mays
  Clone ID: LIB3062-041-Q1-K1-F2
ctcgctggtcgttgcctgctgcggattgcccccaggcggccccactcactccgctgttgggatgtcgtttggttctgcttgccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtggtgttttactttcccgggtgcgggtggtcgaatccttccatccaccaggagagctcgtggcttgtctttgattagctcggtctcccctgtgtccgtgatctgatatacgtccggatctgtctgctgtaatcatcaggaaggtaggaggcctgaggggctgggctg

SEQ ID NO: 38798 - DNA, 436 bp, Zea mays
  Clone ID: LIB3062-041-Q1-K1-F3
tcgcaagaagctgctggacttctacacgggcttcgagggcgtgtcgactctggtggacgtgggcggcggcgttggctccacgctgcacgccatcacgtgccgacacccgcacatcttcggggtcaacttcgacctgccgcacgtcatctccgaggcgccgacgttccccggcgtgcgccacgtgggcggggacatgttcgcgttcgtgcccgacggcgacgccatcctcatgaagtggatcctccacgactggagcgactcgcactgcgccacgctgctcaagaactgctacgacgcgctgccggaaaatggcaaggtcatcgtcgtcgagtgcgtgctgccggtcaacacggaggccacccccaaggcgcatggcgtcttccacgtcgacatgatcatgctcgcgcacaaccccagcggcaaggagcggtaccag

SEQ ID NO: 38799 - DNA, 420 bp, Zea mays
  Clone ID: LIB3062-041-Q1-K1-F4
tccctttcgaccgatcgtactctcgattctccttgacttctacacattctcccaattcatccccactcactccgatgttagcatgtcctttaactctgctgggcaccttatccctctccaacaccttcttatcctcgctctccagctccatctgccagatcacatccatgcaaccactaacattaaggttatccccgataacgacccctccgtcctcctactagctcccatccgtaaccttgcgtcgatatctcgcctagtctatatcgccaccttctacatctgtcccattttactttacaccttacacgatcctctaatccttccatccaccatgatagctcgtagcttctctctgattatctacatctaccctatgtccaagatctgatataccttcgaatctgtctgctgcaatca

SEQ ID NO: 38800 - DNA, 429 bp, Zea mays
  Clone ID: LIB3062-041-Q1-K1-F5
caccagtccagcagcaccaggccagacaggcacacctcgaagaacaagagctggtcctggtggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacgaggacgacgagcaggccaagaccgccgacgtgttcggtgggcggaccggcggcggcggactcttcggcggcgtccacggcccgctgggcggcagcgtcgctgggttcggcccgttcggcggggccgtcgccggcgcaggcccgttcggcgggttcggatgcggcggcggcctcggtggcggaggatgaggaggaggagga

SEQ ID NO: 38801 - DNA, 424 bp, Zea mays
  Clone ID: LIB3062-041-Q1-K1-F6
cgttgctgtcactgttggtttccgtaacaccaagcacatggggaacgcgtctgggtggggcgtgatcacggtgatgctggtgaccacgtgcctcatgcccctggtgatcatgctgtgctgggaccgctccccctggctggcactcgccttcttcctcttcttcggctccatcgaggcgctctacttctcggcgtcgctgatcaagttcctggacggcgcgtgggtgcccatcctcctggccctcatcctgctcgccgtcatgttcgtgtggcaccacaccaccatcaggaagtacgagtacgacatgcacaacaaggtgaccctggagtggctgctggcgctgggcgacaagctgggcatggtgcgcgtcccgggcatcggcctcgtctacaccgacctcacctccggcgtgcccgccaacttc

SEQ ID NO: 38802 - DNA, 203 bp, Zea mays
  Clone ID: LIB3062-041-Q1-K1-F7
gggttgccgccgcgtgctggtgactggcacggagcctctggggtgcgcgcctgcggtgcgtgcgcagcgcatgcgcggcggcgagtgctctgcggagctgatgcgcgcggcggcgctcttcaacccgcagctggcgcgcgtcctggaccagctcaacgcgcgctttggcgccgggaccttcatcgcgggcaacgcgttccgcg

SEQ ID NO: 38803 - DNA, 434 bp, Zea mays
  Clone ID: LIB3062-041-Q1-K1-E4
gtcagtactgcacttgcaggtggcggcggtggcggtgctgctgatggcgactgggctgcgcgcgcatctgcgggtgggctgctacgacagctcgtgcccagcggcggagatcatcgtgcagcaggaggtgagcagggcggtggcggccaacccgggcctcgccgtcggcctgctccgcctccacttccacgactgtttcgttgggggctgcgacgcgtccgtgctcatcgactccaccaagggcaacaccgctgagaaggacgccgggcccaaccttaaccttcggggcttcgaagtcctcgatcggatcaaaggcccccgtcaagcaggcctgcttcggcgtcgtctcctgcgcggacatactcgcgttcgcggccagggacagcgtcgcactcgccggcgggaacgcgtaccatgtgccggcggtgcggcgg

SEQ ID NO: 38804 - DNA, 427 bp, Zea mays
  Clone ID: LIB3062-041-Q1-K1-C8
gctagctagccttccctacagcaactgcatacatacaacacttccatctgcccgctcgtgttcgatcaattcccaaggcaaataataatataacagcaatggtggttcccgtgatcgacttctccaagctggacggcgctgatagggctgaaaccctggcgcagatcgccaatggctgcgaggagtggggattcttccagctcgtgaaccacggcatctcgctggagctgctcgagcgcgtcaagaaggtgtgctccgactgctaccgcctccgggaggccgggttcaaggcgtcggagccggtgcgcacgctggaggcgctcgtcgactcggagcggctcggtgaggtggtggcgccggtggacgacctggactgggaggacatcttctacatccacgacggatgccagtggccgtccgacccgcc

SEQ ID NO: 38805 - DNA, 441 bp, Zea mays
  Clone ID: LIB3062-041-Q1-K1-C9
actaccatcgtggagcaaagtggctggcaataccatgtcctattgataattgcagatgggcgggttacaaggagtgtagatactgcatctggacagctgagttcgcaagagcagaagactgttgatgccattgtgaaggccagtgaattgcctttgtccattgtgttagtaggagttggtgatggcccctgggacatgatgaaggaatttgatgacaacattccttctcgagcttttgacaatttccaatttgtaaatttttcggagataatgtccaagaacatggcacaatcaaggaaagaggctgcatttgctctttcagcattgatggagataccacaacagtataaagcaaccgtggaattaggaattttaggtcgtcgctcttccaagtctaccaacagagttcctctacctccgccttccgcaagtcatgatgct

SEQ ID NO: 38806 - DNA, 415 bp, Zea mays
  Clone ID: LIB3062-041-Q1-K1-D1
ggaagaagcagctatctagcagtagaattggttcaaatcaagaccccgtatagcagaggagtggaattgaaaacacgagcagacattgaattgaaaccatctctgtgttagcacaagcaccggtctatgtttgcctcaccaagcggacatggggatgaacaacatgtcaacacagctacaccaagtgaaaaccgaagccaaaccgatgaagattcaacaagtgccattgatcaaggcgccagggcacgaccacctttacaccgttcctgtgtgttggcccgaattggccctgttagaaccattgggctctgctctaataagtgagaggtataattgcctcattaccacagaacgcaacccttatgtacacaacactgtaactacacgagggagagccctctctgtgttttcccag

SEQ ID NO: 38807 - DNA, 442 bp, Zea mays
  unsure at all n locations
  Clone ID: LIB3062-041-Q1-K1-D11
ctagatccgttcatcctggtggttttgtgaggtcgaaagcggcgagcgaattagaagatgggggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggngagcaacctggccaccaagggcatgggcgccaacctcttcgaccggccgcagcccaactcccccaccgtctacgactggctctacagcgacgagaccaggagcaaccaccgctagatcgggcgagatggatggacagtgaaga

SEQ ID NO: 38808 - DNA, 365 bp, Zea mays
  Clone ID: LIB3062-041-Q1-K1-D12
cccacgcgtccgcagggaagctatgtgcttccttatggatcctaacctaggaaggagtgtcggctatgttcagtttccccagaggttcgatggtattgataggaatgatcgatatgccaacaggaacaccgtgtttttcgatattaacttgagaggtcttgatggcatccaaggaccagtttatgtgggcactggctgtgttttcaacagaacagctctatatggttatgagcccccaattaagcaaaagaaaggtggtttcttgtcatcactatgtggtggcaggaagaagggaagcaaatcaaaggaagggctcagacaagataaaagtcacaggaagcatgtggacatgttctgtgccagta

SEQ ID NO: 38809 - DNA, 444 bp, Zea mays
  Clone ID: LIB3062-041-Q1-K1-D2
acgcttccccacaccagcagtcgagctgagcacgacacaaatccggctggggccgcctcgccatggctatcgggaggagcaacaacgtgatcggcgcgctgaacctggtgacactcctgctctcggtccccatcctcgtctcgggaatctggctgcggtcgcgcgcctactgcaccgagtgcgaccaccttctgtccaccccggccatcgcgctgggcgcggtgctcatggccatcgctgtcgcgggcctcgccggcgcctgcttccgcgccacctggctgctatggctctacctcctcaccatgctcgtgttcatcgtctcgctgctctgcttcaccgtcttcgccttcgccgtcaccaacaggggcgccggggaagccgtgtcgggggtaggctacagggagtaccgtctcggggactactccacctggctgcggcgccacg

SEQ ID NO: 38810 - DNA, 221 bp, Zea mays
  Clone ID: LIB3062-041-Q1-K1-D5
agagaattcgcaaagtggacttctggttgtaattctctcacaccatacatacacgcgctgaagagttttacgagatggcccggagagccctgggtgcgtgtatgtatggtgtgagagaattcgcaaagtggacttctggttgtaattcttagtcgtctctctctctttttgggttggtcaaggttctatgatccagcaatccactgaactgtttggtactg

SEQ ID NO: 38811 - DNA, 430 bp, Zea mays
  Clone ID: LIB3062-041-Q1-K1-D6
agagaattgacacacccaaaaattattatatatatcggatacacttgaagaggctgaggtgataggtatgtaaacacgatctcgtacgactcaccaaaccaaagtccggaagttccattttttttgttaagaagagaacaaatatgtatcaattgttgaatcggatacaacaatgggccaaaaaggccaaaggggcaataagaactgctgttaaaaaaatgataaactttttttttatctttaggctattcacttttcacgtgctcagaatgttctgcagaattagggacttttttcttctattggctgatcttatgatgagaactttctccatttatgttttatttcccctaattctaattgggtggggtataaaggaatttgcgctcttcatatacccctatggctggatagtaattttcagtgatat

SEQ ID NO: 38812 - DNA, 433 bp, Zea mays
  Clone ID: LIB3062-041-Q1-K1-D7
gcattccccctttccccttccgtccggtgcattcctgctctcttgctctcctcgcgtgtcggaccacagttgccgtcgccgccgccctaagccagggtgctgaggctttcgttggcctcttcgccggcagcgagcacccaccagcagttctgtagaaatggctgatggtgaggacatccagcctcttgtctgcgacaatggcaccggaatggtcaaggctggttttgccggcgatgatgcaccaagggctgtattccctagcatcgttgggcgtcctcgtcacaccggtgtcatggtagggatggggcagaaggatgcatatgttggtgatgaggcacagtccaagagaggtattctcacgctcaagtacccgattgagcacggtattgtaagcaactgggatgacatggagaaaatctggcatcacactttc

SEQ ID NO: 38813 - DNA, 320 bp, Zea mays
  Clone ID: LIB3062-041-Q1-K1-D9
taactacgtatctacctttctaagactctaatcttatgacactatttaacaaaatctcaaatttttaatttacatcaccatttatttacttcatttttttccaaaattttattaacaagaatccttgatccaaatccaattacggtatacaatatcacaaaagctgatcgaaataaaatactacccaaaacaatgtatcaattttggagagtctaaaacttactactatacttactagcacataaccaaacatatatgtatatgtaggaaagattcttttatggaagtatagaccacatgcatatatctaaatgaaacta

SEQ ID NO: 38814 - DNA, 431 bp, Zea mays
  Clone ID: LIB3062-041-Q1-K1-E1
gtccgtctctccaaggaggagatcgagaagatggttcaggacgctgagaagtacaagtgggagggtgaggagcacaagaagaaggtggaggccaagaactcgctggagaactactcctacaacatgcgcaacacgatcaaggacgagaagattgcgtccaagctgccggccgatgacaagaagaagatcgaggactccatcgacgcggccatcagctggctggacgccaaccagctcgccgaggctgacgagttcgaggacaagatgaaggagctggagagcctctgcaaccccatcatcgccaagatgtaccagggcgcgggtgaagacatgggctgcgctggcggcatggacgaggactcccccgcttgcagcggctgccctggccccaagatcgaagaagtggactaagcggtttgttgtcagtcttg

SEQ ID NO: 38815 - DNA, 377 bp, Zea mays
  unsure at all n locations
  Clone ID: LIB3062-041-Q1-K1-E10
caaccagcccacccgccggttggtcacgctcctccccgatccccaattccctatctcggggcggcgccatgtcaggccggtgcgcggccgtcataggtctgctcgtgctcctcatcctctgggcctcatgcgcgcgcctcccacgccgcagcagcaccacccggggagctgctctgcctcgccggggagcgccgaccactgcggcgttcgcgctgggaagcttctggcggtcgaaagcggccttctggtgcctncactgcgtgatccgcacctacgtcgactacgctagcggctccaagtccaaccccgagtaccgtatcctctccgaccacgcctagtgcgttaaggtcgagcatgatccccggttgattcactac

SEQ ID NO: 38816 - DNA, 409 bp, Zea mays
  Clone ID: LIB3062-041-Q1-K1-E11
cgcacccagcacagacagaagaccctcgccggacgctcgctctcgccggggacaactgaatcgctaggccaggatggcccgctacgatcgcgcgatcaccgtgttctcacccgacggccacctcttccaggtcgagtacgccctcgaggccgtccgcaagggcaacgccgatgtcggcgtccgcggcgtcgacaccgtcttcctcggcgtcgagaagaagtccacccccaagctccaggactccaggtccgtgcgcaagatcgcgagcctggacacccacatcgcgctggcgtgcgcggggctcaaggccgacgcgcgcgtgctcatcaaccgcgctcgcgtggagtgccatagccaccgactcacagtctatgaccccgtcaccgtcgagtacattacgcgctacatc

SEQ ID NO: 38817 - DNA, 409 bp, Zea mays
  Clone ID: LIB3062-041-Q1-K1-E12
ctggtcgctcactcttgcagctccacccttcactcagtcttagtctcttattagctcgagggtctagctagccgcgccgctccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaagctgctgctcctgctggtcccgaggagactcctgcggtcga

SEQ ID NO: 38818 - DNA, 433 bp, Zea mays
  Clone ID: LIB3062-041-Q1-K1-E3
cacctacgttgctctgctgccgtctgggttcgccatcctgcctgatggcccaagcagtgtcggggccgatcacaagacaggcggctcgctgctcaccgtcgccttccagatcctcgtcaacagccatccgaccgccaaactcaccgtggagtcagtagagaccgtgaacaacctcatattctgcaccatcaagaagatcaagacagcgctgcagtgtgacgcttgactgtcgcgtgtcgccgcaagggggggtggtcggtgatgacgagcctgagtcaagaacgaacctcgtgcgggaaagaaacctttgctaggtgataaggatccagcttggactggtctttagcactgagcaatggtggtgttccggtattgactcggtctctgtcatctgctccttctccatggcaacctgttgtctgatacgggatct

SEQ ID NO: 38819 - DNA, 427 bp, Zea mays
  Clone ID: LIB3062-041-Q1-K1-C7
cgaactcttgctccgatcacgagctagctgaggtcgacgatggcggctgtgctgggcaggaggaagactccgcgggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgtcaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagc

SEQ ID NO: 38820 - DNA, 419 bp, Zea mays
  Clone ID: LIB3062-059-Q1-K1-A11
ggcaaaggagccgtgtcatctttgcatggttggcatataggcagccgcaactgctactgctcgatgagccgacaaatcatttggacattgagaccattgactccctggcggaggcactgaatgagtgggatggtggtttggtcttggtgagccatgatttcaggctgatcaaccaggttgctcaagagatttgggtgtgtgagaatcaggcggtgacaaggtgggaaggtgatatcatggatttcaaggcacacttgaagagcaaggctggtttatctgattagagggctttttccagcaaccatgagctttttaactctgtatcacgaagtcccagttttccaatagcgaactatcagagttactttattgtatcggatttcttttgacttgcattgcaacctgattaccttatacta

SEQ ID NO: 38821 - DNA, 410 bp, Zea mays
  Clone ID: LIB3062-059-Q1-K1-A12
ctcagaacacacacaccgcgtgtggatgtctaagccatcgctgtccccatctgctagggcgcgggggccggacggggactcgatcatgtacaagcgtcggctccagaagcgctggatgcagtaccggaagtacttgcagcatcccggcgtgcagtactggcactccgagaacgaggtggtctccgaagacgtggtcgtcgaggactagagcgacatcaaggtggacaacgagctcagacgcatgcagcagctcgctcatgtcggaacgatcgacgacgggactttaggactctacgagaagcacgtggccatgattgacctcgatcacgaacacaggcacaatatcacagtagaagatcatagcgctgctgacgtttgtgccggcggttacgtattatagcagcaccatt

SEQ ID NO: 38822 - DNA, 357 bp, Zea mays
  Clone ID: LIB3062-059-Q1-K1-A3
ctctggacaaccaagccagagaggatctagccagcgacaacctcctctcctctcctcggctcggattccgcgcccagcagcgaggcatggtggagaaggcgaggaccatggcgcgcaggctggagatcccccagtggaaggccgacggcctgccgtcgccgacgagcccgctggaccgcgcgtcggcgtcgccccgtgggtggcgccaccgcgacgccgtatgaggaggcgtggggctcgggatcctggcggcgctcgaagccgagggcccgccgcagcccgcgccgagggtgtccatcccgcggcgcgcggtgcggctggaggtgtcggagctcgggtgcagcgggcgctgcgcca

SEQ ID NO: 38823 - DNA, 416 bp, Zea mays
  Clone ID: LIB3062-059-Q1-K1-A4
agggttttcgcgccgccgccgcagccgcaacaatgccgtcgcacaagaccttccggagcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgctatgctaagtaacgaaccctttatcttaaaaaaaaaaaa

SEQ ID NO: 38824 - DNA, 294 bp, Zea mays
  Clone ID: LIB3062-059-Q1-K1-A5
ttcgttctaaccctccctgcgactcttcgacccattactcgctatggactcggctggggtgctccagctaatcctgggcgtgacgctcgacgcgcttgtgctgctgcaggactccgtggagttacgcgctcatcgagcgcgcccatcattcgctgaacgagctagtctacgctcctgtcgtcacctcttgaaaacatttgctcgtggaattctgcacacgtgtggcaatagcccccatctcaaacgctgtacataagtctaagccacaatatgtaccagtcttcactaaagatc

SEQ ID NO: 38825 - DNA, 435 bp, Zea mays
  Clone ID: LIB3062-059-Q1-K1-A6
ctcaacccaaggcgtgcctcctctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacatgaccaagacccctggacctggtgcccagtctgccctcatggcgcttgctcgttccggaatgaaaatcggacgcattg

SEQ ID NO: 38826 - DNA, 445 bp, Zea mays
  unsure at all n locations
  Clone ID: LIB3062-059-Q1-K1-A8
cccacgcgtccgcagacaaaagatggcactataccagtatctttacaaggatagcagggtcgcatatccatgtaaagatactggtatagtgcagacaaaagatggcactttctgctcgtgcatgcttcgaaattctattgtctgtacgccacataatggcatgttttatgctgtttgtggctttcttgacttgaatgctaattcgcttctacatagaagtgatggcagtttccttagctacaaaacctattttaaggaaaggtacaaccttgatttaagatgtgaagatcaagctctcttggaagctcgtaaacttgtggaagtgcggaactttctccacaagtgtaactattaaaaagaaaaagaaaggagtggtaagagtgtggttgaattgccacccgaactgtgcatangtgtcatgtcaccaatgtccgcaattactttg

SEQ ID NO: 38827 - DNA, 397 bp, Zea mays
  unsure at all n locations
  Clone ID: LIB3062-059-Q1-K1-A9
atcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcatgccggattgtcatggggctttttgggaagactgttcctaagacggcagagaacttccgagctctntgcacaggagagaaaggggttggcaagagtggcaaagccctccactacaagggaagtaagttccacagaatcatccccagcttcatgctccaa

SEQ ID NO: 38828 - DNA, 408 bp, Zea mays
  Clone ID: LIB3062-059-Q1-K1-B1
agttttcccagtatctgaatgagtgctctcaggtgatgagagctacgcagaagattggggtgttcgacatgcattaactgcttaccttgaatacattgcgtacctatatcagaagatggatccgattcctgagcaggtacgcattgatactaattacagggacttttggcagtatgactcgtgcgcctctaatggacaatttggaagctcaaacttatgagacatttgagaaggatgttgtgaactacactcagccggagaattttcaaagtaaaatgttcggtgaacaggatgcagaaaaagttaaaagctgcaacgataaggcaaacaaaatgttcccaaaggtgccctcaaagatcagcttcaacatagttctgagccaattactgaaaacaatgatgatatcac

SEQ ID NO: 38829 - DNA, 401 bp, Zea mays
  Clone ID: LIB3062-059-Q1-K1-B10
ctagggttttgctgctctccgaccccgagctccgaaggccgcagcttcaggcgcggccgccctggcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccggcaggcaagagaagtttggtggcctcagggatgggatctatatccatggccagtgtgcgatcatcatgtttgatgtaacctcaaggcttacttacaagaatgttcctacgtggcat

SEQ ID NO: 38830 - DNA, 400 bp, Zea mays
  Clone ID: LIB3062-059-Q1-K1-B11
gagataaaaatagactatgaaggtagatttgattccgatagtggtgatgagaataactggaagttgttggtgatgcaaagacatgggaaacctgatgctatgatgcagtcatggatggatcaatttgaggctgattctgacaacgaatgctgggcatctttttaagagcggatctcaagagcaccaaatcaagtgttgaggtattgtcgagaaccaaatgctaaacctatctgggcgttatcttctgggtgtgcatcaaatgctgatatcccatcatgtagctactgtaaaggtccattatgttatgaatttcaggtaatgccacaattgctatatctctttgtagtgggaaatcaaccatactcccttgactgagcaacaattgctgtctacacgtgtc

SEQ ID NO: 38831 - DNA, 276 bp, Zea mays
  unsure at all n locations
  Clone ID: LIB3062-059-Q1-K1-B12
tgattctgacaacaaatgctgggcatcttttcaagagcgggtctcaagagcaccaaatcaagtgttgaagtattgtcgagaaccaaatgctaaacctatctgggcgttatcttctgggtgtccatcaaatgctgatatcccatcatgtagctactgtaaaagtccattatgttatgaaatttangtaatgccacaattgctatatttctttgttgtgggaaatcaaccagactcccttgactgggcaacaattgctgtctacacgtgtcaaggggc

SEQ ID NO: 38832 - DNA, 420 bp, Zea mays
  Clone ID: LIB3062-059-Q1-K1-B2
agtgttcccactatctgcatgagtgctttcatgtcatgagagctacgcacatcattggggcgctctacatgcattataggctcacctttaatacattgcgtacctatattagaagatggatccgattgatgaccaggaacacatcgagattaatctcacggactctttgcagtatactctgcagcctttaatggacaatcttgaatcttatacttatgagacatttgacaaggatgctgacaagtacactcagccggagaactttccaagtactatgttcagcgaacaggatgcacaaaaagtcataagctgcaacgatgcggcgatgaaaaatgttccaaacgtgccctcaatgatcagcttccacatagttctgagcatattactgaaaacaatgatgatttcacacaattgtagttt

SEQ ID NO: 38833 - DNA, 413 bp, Zea mays
  Clone ID: LIB3062-059-Q1-K1-B3
ctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctcct

SEQ ID NO: 38834 - DNA, 425 bp, Zea mays
  Clone ID: LIB3062-059-Q1-K1-B5
gctagacctacgcgtccggaacgccaagattctcgaagtggacaacggcaagccagtgcggcacggttcggggaggcgcggcggcggcggcggcggcaaccatcaccagtcgccgtgctcgacgatgacctccgagcagaacagccggagctacgcgaccatgccggagtcgccgtccaaggactcgacgaccgcgcagcagtccgtgccgagcccgtcgtccgtgggcatggcagccgaggccctgagcccgctgcgcgtgccagcggacatcggcgagctctgcgacagcccccagttcttctcggcgacgtcgctgtccggtagctccatgaggggggtcgcgttcaccccagcggtcaatatcgagtgctcgcgtagcctcttcggcggctactacgactgccccaactacatggcgaaca

SEQ ID NO: 38835 - DNA, 366 bp, Zea mays
  Clone ID: LIB3062-059-Q1-K1-B6
gaacgcgcagaaaccttaagaggacccttgctagcgtctgcttgactatttagggaggaacattcatggactaggaggtagctcttggaaccaaatacgcctaacactctaaaaggaagagctcgcacgtttactagaaatgattcgatacagaatagtcactgctgtaaagtgagttcataccaatttgatacaacattcaccttcacaaataaaattcaaatgacatgtaagattatgcctgacagcctgaagaggtctttcaaaaaccaatctcacaactgctgtctgacatgtcctttcattacttaatatgtgttcccttgcgtctgtagaaaaactacataaaagaagatacgatagaca

SEQ ID NO: 38836 - DNA, 242 bp, Zea mays
  Clone ID: LIB3062-059-Q1-K1-A10
cacacacacacacacagacaagtggtttccaaagccaagtgtgtgtactagcaaccagggagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcac

SEQ ID NO: 38837 - DNA, 401 bp, Zea mays
  unsure at all n locations
  Clone ID: LIB3062-058-Q1-K1-G1
cagcatggcactgagtataaccagccaaaaccttgtggcagtgcaagcgcagaactctgttctgcagacccagaagatggagctggacagcaggctgggtgccctgacggagatcctctggtacatgaactcaagcaccagcaccagcactgctcctacaaatccagccatagcgaacgacttcacagcatggagcagagcctctgatattcttggtggaaccagctacagcgccatagacctgtaccaatgcttctagctctaagctctagctctagaagagaaaaagtggctgtggcatatgacatagtggtagggccaggaagaaaagangcgggcaggcatcaagttctgttcaatcgtgtggggcctttgtgtcactgttgatgtgtgcagtgtgt

SEQ ID NO: 38838 - DNA, 381 bp, Zea mays
  Clone ID: LIB3062-058-Q1-K1-G10
gtgcctccaccgaatcttcaacaggcaaagccaatcaataatcaccagccacatcaatccattccctttcctctcccgctccacttccatgggcaaggttcggtccttcttctcccgctcccgcagcggcaagcgcggcagctcccggagggcaggctcgtcctcgccgcactcctccgcggcgagcgcgccgtcgtccccgtccccactcccactcccgaggaggtcgccgtcgtcgtcgtcaaccacaaccagggacgagacggagcgcgtgttccgcaagttcgacgcgaacggcgactggcagatctcgcggtccgagctggcggcgctgttcgagggcgtgggccacgccgtgaccgacgacgaggtgtcgcgcat

SEQ ID NO: 38839 - DNA, 385 bp, Zea mays
  Clone ID: LIB3062-058-Q1-K1-G11
ctcaagttagaagaagcaccagtgcctgatcgatggcggcccaggctctcctctccggccggcagctgctgggccgtcccgtgcagtcggccgtctctaggtcgtcggcgaggaaggcgcccttcgtcgtcagggccagctcgagcccttcagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatggg

SEQ ID NO: 38840 - DNA, 401 bp, Zea mays
  Clone ID: LIB3062-058-Q1-K1-G12
agttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctac

SEQ ID NO: 38841 - DNA, 360 bp, Zea mays
  Clone ID: LIB3062-058-Q1-K1-G2
ggagaagctccgcgaggctctcagtttttccaacgcctgcggcgccttctgaaccaccaagaagggcgccatcccggcgctgcccacggtcgccaccgcccaggacctaatcgccaaggccaactagatggccgcacgccccgccgttccaccacgtcactgtcccccgccgtcccgcccctcgtcgtcgacgtcctcggtttcggttcattaggtagatcgagtcttagcgtccgtctctgcgcctctacgctgagacccgttgtttgggttaatttaagttagctttcgtggagatttcgccccggtgcatcaataaaatgttggcatgcgttggtgggatgctatccttttttttta

SEQ ID NO: 38842 - DNA, 396 bp, Zea mays
  unsure at all n locations
  Clone ID: LIB3062-058-Q1-K1-G5
caagctgcatctgcatacccatctgatcagaggcttccactgccaataactggctttcctaattctcctacaggcagaagaggagggactgttccaaattatcaaggcatctcatcctacattggagtgccaatgacttatcctactagtccagtgtttcagggacaaacattgcctggagtattgcctcctgttaggagaaacgactctgttggatttctgtccccctcaagaaacatcactggtagccctggaattcaagggcagcgagcaagacagaagttgatgaatcaaagacctgctctttcttagaagagttgaagtccaacagagcgcacatggttgagctntctgacatcacaggtcgtgtagttgaatacagtgctgaccaacatg

SEQ ID NO: 38843 - DNA, 70 bp, Zea mays
  Clone ID: LIB3062-058-Q1-K1-G6
ggaggccgcgcctaccaccatcaccgtccaggtcaagttcgccgggcggacgatccccgtggaggtcccg

SEQ ID NO: 38844 - DNA, 220 bp, Zea mays
  Clone ID: LIB3062-058-Q1-K1-G7
tcgggactctgggatcgaattcacagcatcaaacagtgtgaatcctggaatttccaaacccaaacccggccggagattccttccggaagccgacagggccccttgaccggcttcgtgccctgcgcgccttcccaactttttcggtcttcggttcccgtgcccgcgaaagcgaattgcttaattgaaggtgggggctcgtgcctgaatttgaattttgggg

SEQ ID NO: 38845 - DNA, 264 bp, Zea mays
  Clone ID: LIB3062-058-Q1-K1-G8
tcccggcgttatcctggctatggtcgccgtgatggagcaatgtatgaaaggcgaagccctgtatatgatcgctactgcgggggctgaatccccgcttatgatcgctatgacaggaggagaagccccggttatgatcaatactagtccggtcgattctgaggatacccagtttagaagtagctttcaaggaagaagttgccagcaaccacatgattattgccacgccaagtataccccgaggagccgtggtgtcccaagtatgtg

SEQ ID NO: 38846 - DNA, 219 bp, Zea mays
  Clone ID: LIB3062-058-Q1-K1-H1
tcggcacgttgggctacaaaggtttagaattgattcagaatagtcagcctgcatcctgcaagcagcttatcatgattgggagtgcagaactagacttcttcggaagcttaaactagacttcgcacagattttttgtacagttctagagatgtgtagatgcctttaggaaaaagaggtgtacacaagcgagtttttcagctttaatcccccacggtccgt

SEQ ID NO: 38847 - DNA, 384 bp, Zea mays
  Clone ID: LIB3062-058-Q1-K1-H10
catttcgccacgccatggatttctgcagccacctccatctcgcggctgtgctcgcgctcctcaccggctgcgcttctgcggcgagccggggcgctggttccttcgacccatcccgcgtggttcaactctcttggcgccccacggcgttcttgcacaagggtctcctggtggatgcggagtgcgaccacctcatcgcgctggccaaggacaagctggagaagtctatggcggcggacaacaagtccggtaagagtgtccagagtgaggtgcgcaccagctccggcatgttcctcgagaagaagcacgatgaagtagtaacgagaatagaggagaggatatctgcttggacatttcttccaccagagaatggtgaagccattcaga

SEQ ID NO: 38848 - DNA, 399 bp, Zea mays
  Clone ID: LIB3062-058-Q1-K1-H11
catttctacacgccatgaatacatgcttatacctccatatcgcagatatgctggcgctggtcaccagctgcgctgctggcgcgagccccagcactggttcgttggaccgatgggtcgtctttcagctctattagctcccgacgacgtgcttgcacaacggtcttctgttggatgccgagctgcgatacctctatcgcgctggccaaggacacgctagataagtctatggcagcggacaacaagtcctctaagagtgtccagagtgaggcgcgcaccagttcctgcatgttcctcgagaagaagcacgatgaagtaccaacgacgatataggagaggatatctgcttggacattacattcaccagactaatggcgatagccattcagagattacactacc

SEQ ID NO: 38849 - DNA, 236 bp, Zea mays
  Clone ID: LIB3062-058-Q1-K1-H2
ggcgtcgtacgtgcactccaacgtcgccggcctcgtcacgctcctcgaggcctgcaaggacgccgacccgcagccggccatcgtctgggccttctcctccttcgtctacggtctcaacgacaaggtccccttctcggagcgcgaccgcaccgaccagtcggcctcactctacgcggtcaccaagaaagccggcgaggagatcacgcacacgtacaaccacatctacggactcttca

SEQ ID NO: 38850 - DNA, 113 bp, Zea mays
  Clone ID: LIB3062-058-Q1-K1-H3
gacgagagccagctctctacattacacaatcacatggcgtacaccaccgtcgtctatgacaaccggctcgtggttgttttcgacacgcaaactcgcaatggcacacatcgtaa

SEQ ID NO: 38851 - DNA, 260 bp, Zea mays
  Clone ID: LIB3062-058-Q1-K1-H4
ccagcccagatcagcgaaacacactccgctctcccgagaccggacacatggcggcggcggcggtgacgtccaacggcggctcagtggccgcaaatgggccggcgcccggccggctggcctccgtgtacagcgaggtgcagacgaaccggctcctgcacgcccttacccttcccttcgtgctccgctccaacttctcggtcgtcgtcggccccgccagctccggcgtgggcaatcccgatgagatcgccaaggcttttccc

SEQ ID NO: 38852 - DNA, 335 bp, Zea mays
  Clone ID: LIB3062-058-Q1-K1-H6
tctactttgtgactgacactgaaaaaatgacggtggggtatgagaactgcaagcttgtacttgtggacaagaaaatcaacaatgccagagatcttatcactatcctgcaggatgctattagaagtggatatccaattctaatagtggcagaggacattgagcaggaagctcttgcaacccttgtggctaataggcttagaggtgcattgaagattgctgctattaaggcccttggttttggagagcgcaaaagtcaatatcttgatgacattgctactctcactggaagcactgtcatcagagaaaaagttggattatccttagacaaggcagac

SEQ ID NO: 38853 - DNA, 97 bp, Zea mays
  Clone ID: LIB3062-058-Q1-K1-H7
ccggggcgacccacgcgttcgcgctcgagacgagagccagctcttccagcacacgagcacatggcgtgcaccacccgccgggctgtcttactgctcg

SEQ ID NO: 38854 - DNA, 275 bp, Zea mays
  Clone ID: LIB3062-058-Q1-K1-H8
tcgacccactcgttcgcagcccagatcagcgaaacacactccgctctcccgagaccggacacatggcggcggcgggtgtgacgtccaacggcggcgcagtggccgcaaatgggccggcgcccggccggctggccttcgtgtacagcgaggtgcagacgaaccggctcctgcacgcccttcccctcccctacgtccttcgcttcaacttctcggtcgtcgtcggtctcgccagcttcgtcgcgggcaaccccgatgagatcgccaagctctttccc

SEQ ID NO: 38855 - DNA, 399 bp, Zea mays
  Clone ID: LIB3062-058-Q1-K1-H9
cattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcatcgcgtcggcagcggtgcccccgtctacctcgcggtcgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgacca

SEQ ID NO: 38856 - DNA, 420 bp, Zea mays
  Clone ID: LIB3062-058-Q1-K1-F7
accctttatcaatcaactacagacggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttgatggagaccatgggatcgagggagctcttgaggtggcagagaaagtgtggtctgaggtgtttttctacttagccgagaacaatgttctg

SEQ ID NO: 38857 - DNA, 318 bp, Zea mays
  Clone ID: LIB3062-059-Q1-K1-A1
gtcggaaatcagcttcctcgcgtcggccagcacgcgccgcctggccacattcccttgtttctctggtctcctgcctcggtccagctcttctctgaatgccgcggtggcccatcgaatctctgactgaactgatttccggttggtgcgtgcctttcttctctggcacggtacgcgcagtccgtttcgctgccggcgaacacgcatgcagaagcagactcgtcttatcgtgctcacctgaggcagaccgtcgtgcccgccgtgcccgaggtagaacgagctagcatgagcagccttcaaactgcctgctcgtcgtgggac

SEQ ID NO: 38858 - DNA, 324 bp, Zea mays
  unsure at all n locations
  Clone ID: LIB3062-058-Q1-K1-D7
gaataatcaagaatatggaaggtgacttagaaaaaatttcacaggagagattgcagctcaagtctcggattaaagagctcgagcaggcagctcacagcttagactattcagcttccgagatagttgagctacaagaagtaataaggaatacacatgcagaattagaaaaggtcacataggagaaggacgtgctcaaagaacacgctaacgaatttgagcaccgtttaaagggcctngaggtctcaggtacagaggttgcaaagctaccagaaactatcaggaacctggaagcccatctaggaagatccttcgaagagaaatcag

SEQ ID NO: 38859 - DNA, 341 bp, Zea mays
  Clone ID: LIB3062-058-Q1-K1-D9
caccttcctcttgcgcggcaggtccgcccgcaccatgcccagacgcaagcagctcacggccgtccgctgcagcgccgtcagacaggccgtagtggaagaggcctcgcccgggaccgcggacgatccgctgctggtgagcgcaatcagagggacgaaggtcgagaagccacccgtatggctcatgaggcacgccgggaggtacatgaagagctaccaattgctctgcgagcggcatccttcgttccgtgaaagatcagaaaatgtcgacctagttgttgagatctctttgcaaccatggaaggttttcaagcctgaaggaatcatcttggtctcggacattc

SEQ ID NO: 38860 - DNA, 385 bp, Zea mays
  Clone ID: LIB3062-058-Q1-K1-E1
gcggcggcgatgggcggtgaccatggcggtgggcacgccggcggcgacttccgccagaaggtatggagcatgacgggcggcccctactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctccaactagcatgaagtgtgggcaccttgcttttgccttctttttgtggaaacctgtgcctagccataatgctgggttaagtgttaggagcatctctggaatgcttcgcgtagtatcttt

SEQ ID NO: 38861 - DNA, 411 bp, Zea mays
  Clone ID: LIB3062-058-Q1-K1-E11
gaagaagcgcaaggaggagctcaaggagaagtttgagggcctctgcaaggtcatcaaggaggtgctgggcgacaaggtggagaaggtggtggtctccgaccgcgtggtggactccccctgctgcctggtgaccggcgagtacggttggaccgccaacatggagcggatcatgaaagcccaggcgctgagggactccagcatgtctgggtacatgtcctccaagaagacgatggagatcaaccccgagaacgccatcatggaggagctccgcaagcgtgccgaggctgacaagaacgacaagtccgttaaggaccttgtcatgctgctgttcgagacggcgctgctcacttctggctttagcctcgacgatcccaacacctttggcagccgcatccaccgcatgctcaagct

SEQ ID NO: 38862 - DNA, 70 bp, Zea mays
  Clone ID: LIB3062-058-Q1-K1-E2
aattcccggcccgactctaccctgcctctagctagttgctctactagatggcttttatagagcttcctgc

SEQ ID NO: 38863 - DNA, 380 bp, Zea mays
  Clone ID: LIB3062-058-Q1-K1-E3
atcaatcccatcttgtaaactgcttgaagaagtatgcaagaggaattttgctacgcattttgattattgcacaactgcttgcacggactttgtgtcattagatgaggcaacatttaaggatattcttgagcatggtgatatgacagtaacgtcggaagagagggttctggatgtcattttaacatggtgcatgggagcttgtgaaacttttcactggacttcagtagatgagctgttgagaacttcaacaacagaacagctctttggggaaaagcttttcgccatcaatactttgctaccattagtgaagttccctttgatgcacctgtctatactaaagaggatggagagaagtaatctagcaaaccacatacaagcat

SEQ ID NO: 38864 - DNA, 296 bp, Zea mays
  Clone ID: LIB3062-058-Q1-K1-E4
tattcatacgagcttcgccctctctcttttaccccttctcatctcctacgctagggctggctaccgacgtgagttagccgaccaagtcgtacgcgcaggatcgcctcgtgcacctgctgatctagcgcaactcacacgaactcattgtggatctctgccttgccgtcgagctcctcacggtatccaccctcgacgaggtagtgtacaaccgctcgactgagttcatgtggctgttgcagaccgccttcctgactgacaccttttgattcatcatcaagcaaatgtggttctacact

SEQ ID NO: 38865 - DNA, 436 bp, Zea mays
  unsure at all n locations
  Clone ID: LIB3062-058-Q1-K1-E5
cttccgccgcgcttcgccctctcgctccagccgcttcacagcgccgtcgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaagaagctgatgtgaagacgaagtgggaaaacagctcatggtgcaagaagctgattgtccagaagaggagggctgcgctcagtgactntgacaggttcaaggtcatgctggcaaggatcaagaggggtggtgctatc

SEQ ID NO: 38866 - DNA, 60 bp, Zea mays
  Clone ID: LIB3062-058-Q1-K1-E6
gttcttactgccatccattgaaacaagatggaagtcccaatgtcggccaaaagaaccggg

SEQ ID NO: 38867 - DNA, 400 bp, Zea mays
  Clone ID: LIB3062-058-Q1-K1-E7
ggatcttaaggtcgccgttgaggaacactcaaatgttgtattttccagcttctctggtagacgcgaagccctgttgtttttgaagaaaaaacttcaaggaagcaggaaattcaatgtggacggcaagaaagttcagctcgtgtcatgaaagccaagcaaataggaattctttacgttgttggtgtctttgggttgatttccgtttcttctcgttgtgttctgtagcttcaaggaagcatgaaattcaatgtggacggcaagaaagttcagctcgtgtcatgaaagccaagcaaataggaattctttacgttgttggtgtccagcactcgtatttgttgttgctcgaggttccaaacagatgtaggagcacattgagctatgtagtactagtactggtata

SEQ ID NO: 38868 - DNA, 84 bp, Zea mays
  Clone ID: LIB3062-058-Q1-K1-E9
tcatgaatggtctgtgcattctcatagtgaactcttgaatacttctcaagatagggaaggtgcccttctccacaatgcgaccca

SEQ ID NO: 38869 - DNA, 323 bp, Zea mays
  Clone ID: LIB3062-058-Q1-K1-F1
caactaggcagcatacagacgactagtctgttggtcacctgactaacaccagctagcggctcggtctctcctgcaataatggccgatcgctacttctcctaccagccgcagctggacgcggcggcagaggtcctggcaatggcgctgctgctgcaggcggccacagccgggacggcgtcggctgaagtgagctgcagccaggtgacgtactccgaggcgcccgacctcagatacacgatgagcaacacgacgtcaccctccacggcgagctggaacggggtgcgctcgctcaacatgcgggcggcgacagcggcggaccggca

SEQ ID NO: 38870 - DNA, 159 bp, Zea mays
  Clone ID: LIB3062-058-Q1-K1-F10
tcttcctacagtcactaatctctaaaaatcattccaaacttttaaactattcactggggcaagctatattacctactatcaaagctttccacaccatttcatcatcaattcactcacaacatatcttacatctacaaagatctgactaccacccttctt

SEQ ID NO: 38871 - DNA, 410 bp, Zea mays
  Clone ID: LIB3062-058-Q1-K1-F11
ccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacg

SEQ ID NO: 38872 - DNA, 348 bp, Zea mays
  Clone ID: LIB3062-058-Q1-K1-F12
ggaggtcactaatctcgtcaaagtcattccagactttggatctcttcctcgacgctgtatcgcctgtgtacacgactttgtcgatgacgagcacgcgactgacgcgttgatgcagagagcggtagtctgcagtgacgacgacgaggtgaatctgatcgcggatgcctactcgatgagcttcgtgcacaacttagacaagacatactgggacgcctacgaggacacgtaccgagtgagcgatctcatggacaaattgcgcagagcgcgccgactgcagctgctggacccgtctgcggagctcggagcctctacgatgttggacgtcacgccggaagagattcgacggac

SEQ ID NO: 38873 - DNA, 434 bp, Zea mays
  Clone ID: LIB3062-058-Q1-K1-F2
tcggccttccctcccaaacttgcacgctgtccccgcgctcgcctccgcccccgatccaaatccagggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttttgattctgttggtcttctactcaggggtgatgttgagaagc

SEQ ID NO: 38874 - DNA, 272 bp, Zea mays
  Clone ID: LIB3062-058-Q1-K1-F3
gcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccattgccgcccagccgtgct

SEQ ID NO: 38875 - DNA, 422 bp, Zea mays
  unsure at all n locations
  Clone ID: LIB3062-058-Q1-K1-F5
gtgacgaggtgggctgatgccgcaacagctaagtcccaacctacgccattaacgtccggtatataagcaagcagcgaacctctgcaaacatggtcatcagcgaagcacaaagcgcagatcgtcgatctagcgagctcggagtcggagcacgcctagacaccaaagcaatggcggctcggcggctcctcgtcgcgttccttgccttgtgctctggcttctcggccgtccacgggcagaagttcaacgccatcttcagcttcggcgactccatgtccgacaccggcaacctgtgcgtgaacggtccncccgccggcctgacgctcacccagccgtcctacggcgagaccttcttcggccgcgccacctgccgctgctccgacggccgtctcgtcgtcgacttcctggccgagaagttcgggctg

SEQ ID NO: 38876 - DNA, 429 bp, Zea mays
  unsure at all n locations
  Clone ID: LIB3062-058-Q1-K1-D6
ctttcaagtgtcagaaacaatagttgaaaggatggcttggaccctcttattatcctgggagcccgggtggtttggaagcatagaaacagagtggtgttcggtagagtttcttccaacctcactcttattctggagtccgctaatgaggaaagcgagaaatggcaagctgcaggagccaagggttatcctttctggctgctccaagccatataagttagggtggttggatccttcatggatattttcatgtacttctgttgttggcctccgtaagaagtgcatgtaccccgggtgtctttcagccctttgtattcttcgtcttttaatatagtggggcacagttctcctgtgcttttcgggaaaaaaatatgtgcatctatttaagtctcttaccattaagtgtttataaaatatgtntcatgggtcttt

SEQ ID NO: 38877 - DNA, 411 bp, Zea mays
  unsure at all n locations
  Clone ID: LIB3062-058-Q1-K1-F6
gcccgtcgtcgcgtccgtcgccgtcgtcaccgtcgcggacaccattcccgtcaatcaagaggacaacatcctcaaggggcatgggacgtcggatcaggacggggaggtggttgcgacgctctgcggggtggtggagcgggtcaacaagctggtctacgtccgcactcttcgcgcgagatacaagccggaggttggtgatatcatagttggccgtgtgattgagattgctcctaagcgatggaggttggagataaattttagccaagatgctgttctgatgctttcatctatgaacttgcctgatggtattcagagaaggagaactgctgttgatgaacttaatatgcggagtatctntgaagaaaatgatgttatctgtgctgaagttcgaggcttccaacatgatggatc

SEQ ID NO: 38878 - DNA, 414 bp, Zea mays
  Clone ID: LIB3062-039-Q1-K1-A3
gtggatcggacacccaagatttgagctcatccgccatgatgtcactgagccacttctggtggaggttgaccagatctatgaccttgcttgccctgcttcaccaatcttctacaagcacaatcctgttaagaccatcaagacaaatgttattggtaccctgaacatgctgggacttgcaaagagagttggagctaggattttgttgacatcaacatctgaagtttatggtgatccacttgagcatcctcaaaccgaggcctactggggcaatgttaacccaattggagtcaggagttgttatgatgagggtaagcgtgtagcagagacgctgatgttcgactatcacaggcagcatggcattgaaatccgaattgccaggattttcaacacctatgggccaaagatgaacattga

SEQ ID NO: 38879 - DNA, 423 bp, Zea mays
  Clone ID: LIB3062-039-Q1-K1-A4
cctagatgaggtggattcttttgctattgctcgagacagtgaaattcatgaagctacacgagagaatcttgtcagtaattctgcgacagatcgatgggtttgagcaggatagacgggtggtagtcattgctgcaacaaatagaaaggaggaccttgatccagctctcatcagccgttttgattcaatcatctgttttggcttaccagatcagcaaactcgtgtggaaatagctgcacagtatgccaagcatttgactagatcagaattggttcaattttcattggccactcaagatttttacagattggtctacccatattcttggttagccagtgaggatgcatagatacagttctagtttcacagattcgtctctatccataatccatatccggtgcaacctgtgactagagatgtgcaga

SEQ ID NO: 38880 - DNA, 429 bp, Zea mays
  Clone ID: LIB3062-039-Q1-K1-A6
aggatctccaaactttgcatgttgtttcagccaataaagttttggtttcacagctggggaacttgaagttaatgagaagtttggctatcgcggaagtgcaacaaagctacattgcagaattatgcaactcgctgacaaagatgactaacctgaaaacactatttatttccacgtgcaatgtgaatgagactctcaacatagaaatgctaaagccgttgccaaatctgacatcatttctcctatcaggaaagttggagagaggcttgcccccgtcgatattctctatgaatttaaaacagttaaaattgttcgggtctagtctgaagaaggatcctgttagctcgttctctcatatgctaaatcttgttaatctattcctcactggagcatatgatggggaacagctaactttttgcaccagatggttcc

SEQ ID NO: 38881 - DNA, 421 bp, Zea mays
  Clone ID: LIB3062-039-Q1-K1-A7
ccgacgttcgcttcctctccagcctccactccgccagatctcattgcctcctaaggccgatcgtccaccccgatcaccgcgcgggtatcggagcatggcgtctgcggcggctgtggacgccggcgacgcgccggagcccacggtgcggaacctcctagaccaggagtccctcaagtgggtcttcgtcggcggtaagggcggcgtaggcaagaccacctgcagctccatcctttccgtcctcctcgcgggggtccgccagtccgtgctagtcatctccaccgaccccgcgcacaacctcagcgatgccttccagcagcggttcaccaagtgtcccaccctcgtccgcggattcaccaacctctacgccatggaaattgacccgaaggtagaaaatgatgatttagccaatgaaagaatggag

SEQ ID NO: 38882 - DNA, 435 bp, Zea mays
  Clone ID: LIB3062-039-Q1-K1-A8
attcccggtccgacgcactcgaccgccgccgttcacttcctctccagcctccattccgccagatctcattgcctcctaaggccgatcttccacccaggtgacggggcgggtatcggagcatggcgtctgcggcgcctgtggacgccgtcgacgcgcctgagcccactgtgcggaacctcctagaccaggagtccctcaagtgggtcttcgtcggcggtaacgacggcgtaggcaagaccacctgcatctccatcctttccgtcctcctcgcggtggtccgccagtccgtgctagtcatctccaccgaccccgcgcacaacctcagcgatgccttccagcagcggttcaccaagtttcccaccctcgtccgctgattcaccaacctctactccatggaaattgacccgtaggtacaaaatgatgatttatccaatg

SEQ ID NO: 38883 - DNA, 401 bp, Zea mays
  Clone ID: LIB3062-039-Q1-K1-A9
acaatctcgtttacacctaactatacagatcatctcatcttgcaccttacgactgaattatctagcacaggtcaacatttcatgcgcgtcggcaaaatctatatcatatagtctacatctctcatctcactacaaattgctactacattcttataaaagaacttcatcactctattctttcatggctatgcacccatctgactcaaataatattgatctatagtacacacaccttctacttcatgacaaacttatcctatattataaagatcttacgatctgtcacatcgtttactatgtctacaccgaatgttctaattatctatatccttccttcctacaactattaccgtatcttcccactctcacctcttaacctatcatatctgatcccaacattc

SEQ ID NO: 38884 - DNA, 281 bp, Zea mays
  Clone ID: LIB3062-039-Q1-K1-B11
gccgttcgtcataaaacctagattctgattggcatacaattttccctctttactcacccacggtacagcaccggttgcagatacgatgtatacttattacttgccaataaccatatatagcttgagtaaaaaaatcatatatacggcttggtttcagttgtccaaaaggttcagcttttttttttctaacggtcttttctaagaatctgattatgtagagaatttggttgtaagtgagtatataggatttagaatctgaaagtaaagtgtggatttctctt

SEQ ID NO: 38885 - DNA, 359 bp, Zea mays
  Clone ID: LIB3062-039-Q1-K1-B12
tatcgatcatcctaaaacctatactctaactctactactaactccaacctcttcccacacagtgtcggacacacatcacaggtagaatatatactactaactcactcaatcactcattcttacttctacacatcatacttatatccaacatcatttacatatatttcaaaaatctcatcctactcattcattacttaatcctcactcaaaatcatactacttaaagaatcatcatcccaatattcatatacatatcaacaactctccactatagcaaaaccaccttactaacatcacacataactactgcatatctacttcaattctacctacatcctcttaaacgcaaatacatataa

SEQ ID NO: 38886 - DNA, 432 bp, Zea mays
  unsure at all n locations
  Clone ID: LIB3062-039-Q1-K1-B2
aataaattggacaccaatcatcactggtgtgagcgccatcccttagtgatctgagccagggggctggctttcctggtttgacaagagcagcacttgatgggcactgagatactgggattgtgtggatttcgagcctggactattgaaatgaacagaaaaccaaacagtcctaaccaaatccagcgtctatgtgacgaggactgattaaggcaccagtgcagggcttcagcgacaatgttcagccaagacattgcaaaccaatataaagatattttccttgatgcctcctatcccccaaaatgattgctcctccttcattgacattggagaaacacataactctgttttttcctgaacgggggatttagaagcatcatgaanggtgtatgtgtagtgagaagctatagatggtgaaggagatagatataggta

SEQ ID NO: 38887 - DNA, 378 bp, Zea mays
  Clone ID: LIB3062-039-Q1-K1-B3
ggcttctcctccccctccggttcgggttcgggttcgtgaggttctccggggttcggttgcgggggtgagcggatcgagagggcggcgtctgatgttgagtaccgctgcttcgtcggcggcctcacctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgttgaagcggctgcggcagcgggtacggtggt

SEQ ID NO: 38888 - DNA, 425 bp, Zea mays
  unsure at all n locations
  Clone ID: LIB3062-039-Q1-K1-B5
gaagctcagaggagaatcgtcaaagctcaacctgtactgaaagaggaccctatcgcacgtccggagaaagagcggaaacctctcactgaagttcaacaatttgtgttgcatgttgatgagagggctgtgcatagatcagaatttgatagcatgataaaagagaaagaaaagacttacaaaaggttgagagaggagaacgaattcgcgcaaaagattgaggaggagaaggcgctgaagcagctgaggagaaccatggtgccacatgcccggcaggtccccaagtttgacaaaccattccgaccacagaaatcgacgaaacaggtgacaaggccgaagtcgccacagcttcaggtggatgagcgaggggcgaggaggcatgctntaatcagatgaccaccgtcctcgcctcaagatctctgcgacgt

SEQ ID NO: 38889 - DNA, 423 bp, Zea mays
  Clone ID: LIB3062-039-Q1-K1-B6
agaaatagctaaggcctgtcagactcttgaagggaaggattcgtctccaactgctgtagaaatgttgcgcacacttcattttgaaatgacaaagctttacattctacggctttgttcatggatgcgggcaacaacaaaggagatatcaaaagatgagacttgggttactttatccacccttgagagaaacaagtcccagtatgcgatttcatgcttgcccctggagttccgtgacataacagtttcagctatggaccgaattgatactatgattcttaatctgatgagcgagactgcgaagtcatatgacatttctcaaccacttcaggaaatcaatgagtctgttagacttgcatttttgaattcctttctggactttgctggttatctggagaggtttggaggtgaactaaccgagaacag

SEQ ID NO: 38890 - DNA, 433 bp, Zea mays
  Clone ID: LIB3062-039-Q1-K1-B7
attcccggcggctgtcattctaatggtggatggccaagttcacagccactggtgtcctcatactgttcgaataaacagcgggtgacataacttacagcggggaagcaacagctagctgcttccctttttgtttctccaccaactaaagctgaccagaaaccacaagcttctccaaagacagctaaggacataccctcaactcataaagtaactaccactaatgtagctgcacactctgataaccagcaagtaatccctgctgatgcaccaccgcctgatctgcttgatctacgtcaccagacagatccatcgaaccgaccatcacctgaccctttttcacagctacaaggtctacttggaccaacatctgctgctcctgcgctttctaggactccgtctaccactaccaatacttccaaaccaccatatctta

SEQ ID NO: 38891 - DNA, 422 bp, Zea mays
  unsure at all n locations
  Clone ID: LIB3062-039-Q1-K1-B8
atcggaggccgcgattgctcgtgcgcagtgcctccttcgcttccgccgctggtcgccggtgccgcttcttcctctggcttcccctcccgctaccacacgagcagcttcctgccgccgcagcgtacgcatggcctcgtcggacggctctgccgcggccctgcccagcgctaccgtcgatgtgcccggcgccggggcccctgtcctcgtcgtgggcgcgccggggctccccgaggctgacttcaggaacgcggtggagtcgtcgctgttcaagcagtggctgcggaacctgcagtcggagaagggcgtcctcacctacgggaggctgagcctcacgcgggttctcatccagggcgttgacatgttcgggaaacgggtgggctntctcaagttcaaggctgatatcgtggacgaggaaaccaaaa

SEQ ID NO: 38892 - DNA, 381 bp, Zea mays
  Clone ID: LIB3062-039-Q1-K1-A2
ctgctcgatctgggtgatcctccatctctaccccttcctcaagggtctcatgggcaggcagaaccgcacgccaaggatcgtcatcgtttggtgcatgctccttgcgtctatcttctccttgctgtgggtgaagatcgatcctttcatctccccgacacagaaagctgccgccttggggcaatgtggtgtgaactgctgatccagattgtgactcttatctgaagaggctcagccaaagatctgccccctcgtgtaaatacctgagggggctagatgggaattttttgttgtagatgaagatggatctgcatccaagttatgcctcttgttattagcttcttcggtgccggtgctgctgcagacaatcatggagcctttcta

SEQ ID NO: 38893 - DNA, 352 bp, Zea mays
  unsure at all n locations
  Clone ID: LIB3062-038-Q1-K1-G3
ctttgagggcagttcttatgatgcttctctctcctagccaattcattttctctgagaaagtgagaggcggngattgtgtgccatgaatgcagagatcattacaacgaaggtttggttggagtccttaaacaagccttgtgtcagaacatgagcccagggcccaagtcttatattgcacatatactgagtatgtttggcctctgtggttttccaagcaagctaggaggaaatatgagaaatgttttgtgtgacagtgagttagttgatctggaactgttgcttgcagatggcgaatctctaagtgctcatgcgggtatcctatcagcaagatgtcctaaattattaccatctg

SEQ ID NO: 38894 - DNA, 436 bp, Zea mays
  Clone ID: LIB3062-038-Q1-K1-G4
gcgcgcgcgagagagagtgagggcggaggaaaggggagatggcgcaggcggtggaggagtggtaccggcagatgcccatgatcacgcgctcctacctcaccgccgccgtcgtcaccaccgtcggctgcaccctcgagatcatttcgccgtatcacctgtacctgaacccgaagctcgtggtgcagcactacgagatctggcgcctcgtcaccaacttcctctacttccgcaagatggatttggattttctgttccacatgttttttctcgcacgatactgcaagcttctggaggagaactcatttagaggaagaactgccgactttttttacatgctcttgtttggtgctactgtcctaactagcattgttctgatcggagggatgataccttacatttccgagacatttgccagaattctgttcctgagcaattc

SEQ ID NO: 38895 - DNA, 144 bp, Zea mays
  Clone ID: LIB3062-038-Q1-K1-G5
tacaacaaaagctatatatataatcttaaacaaaccctgagataaaacataataccatattccacttcttatcttgcacatatactctatatatttcaccacctgatgatcaataaccactctacatatcactataataaatta

SEQ ID NO: 38896 - DNA, 349 bp, Zea mays
  Clone ID: LIB3062-038-Q1-K1-G7
gaagatttttggaagttggatgacacaatcatcaaaaccattgagactgctcccaacaatggactgaaaaaagcaaaagaaatcattcaacgtattcgccgaagagaactttacaagttttgcaaccagtattctgttccaaaggacaaactggagcatttcaaaaatattactgcacaggacatagtttgttcgcagaaatcttctgaggtgctgctgaaggaagaggatgttgcagtaagcaatgttaagatagatcttactcgtggaaaagataacccccttgaaagcatcaagttctttaaagattttgggtgcgacgagaagttccccatcacagatgataggg

SEQ ID NO: 38897 - DNA, 473 bp, Zea mays
  unsure at all n locations
  Clone ID: LIB3062-038-Q1-K1-G8
atctgctgcagctgaataatgttgccagcctgtggttcatgtcactttttatctgcatttgggctacgagcatcctagaaatgagatggagtggtgttggaattgatgactggtggaggaatgagcagttctgggtcattggaggtgtgtcctcacacctctttgctgtgttccagggacttctcaaggtcatagctggtgttgatacaagcttcaccgtgacatcaaagggtggagatgatgaggagttctcagagctatatacattcaaatggactaccttattgatacctnctaccaccttgcttctattgaacttcattggtgtggtcgctggcgtttcaaatgcgatcaataacggatatgagtcatggggccccctctttgggaagctattctntgcattttgggtgattgtccatctttatccctttctaaaggtttggttggaaggcaaaacaggacaccaacga

SEQ ID NO: 38898 - DNA, 407 bp, Zea mays
  Clone ID: LIB3062-038-Q1-K1-G9
caaggatctgaagaaggaattctgctgcaatggtactgtagttcaggacccagagctaggccaggtcattcagctccaaggtgatcagcgcaagaatgttgctactttcctagttcaggctgggattgcgaagaaagagaacatcaagattcacgggttctaagggacctgtaaatgcttgtgccctatattgtgtgcctccacatattggggagcttgaagcatcgacaagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctaaaa

SEQ ID NO: 38899 - DNA, 372 bp, Zea mays
  Clone ID: LIB3062-038-Q1-K1-H1
cccacgcgtccgggacgctgcacgggctccagccgccggaggcttcctccaacacgctgttgaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagcttgtaagcgctataccaccagatactgccatatgatggtatgggtgggtacccgtctttc

SEQ ID NO: 38900 - DNA, 405 bp, Zea mays
  Clone ID: LIB3062-038-Q1-K1-H11
acagaccacagttgttccttatggcacatctgatgaagaactcgttcctgccgttttgtccgaagaaactggcagatacatcgaggaaagcaaattgagagttgttcttgttagttcataccaatccctcgaagagcaacccactaatggaattcatgacactgagccagctgttgaagttcctttactgaaagagatgccaaatttagggagcgaagtaccagatgttgcaaaagaaattcctgcccctctggtacaaggtccagcaattgtgaccggaataccttcacctgtcaaagaggttccaggcctgagagaaattcctgtgccactgaacgaagcaccaactttattggcagaatttccttcccctcaaaaagatccctctgctattacagttgaacc

SEQ ID NO: 38901 - DNA, 118 bp, Zea mays
  Clone ID: LIB3062-038-Q1-K1-H12
agccatgcctgaagggaataaggaaaaggacaaaagccggaaccctgatgcctcaagtccttcgccctttcgaggccccgcgtacaagaccaaactttgcgcgctttggaagggcaag

SEQ ID NO: 38902 - DNA, 309 bp, Zea mays
  Clone ID: LIB3062-038-Q1-K1-H2
acggggcgcgttagtgtctggtaattggaatgagtacaatctaaatcccttaacgaggatccagtgggatgtaagccgcagtggttggcatatattgcccaccttcacctgagagaagatatcgggcgcgcaataatgattagtgagcagtcctgtatggagcctgggtgcagcctctgccagtattaagtgatctacgtgttatacattttttatgttcatgaaacattgatccattgataaaatatatcgtcaggtggcaaggggtcgatttgggggaaaaaaataccttattaatatactcaacaa

SEQ ID NO: 38903 - DNA, 324 bp, Zea mays
  Clone ID: LIB3062-038-Q1-K1-H3
acggtgatcactgatttctggtcatggcaaccgttactgaggaagttgcttcggtcgtcaccgtgtccgatgagccggcgcgggaggcggcgaatgaggtggcggagaagccggaggaggggaagaagcccgacgaggagggtggcgaggggaagaaggcctgccccgtcgcctagaatgagaagaaggcgaggaagccgctgagcatgaagcccaagtccgccgggccgcaccacccgccctacttcgagatgatcaaggatgcgatcctgtcgcatgacggcgggaaggtcggtgcgagcccgtacgcgatcgccaagcaca

SEQ ID NO: 38904 - DNA, 373 bp, Zea mays
  Clone ID: LIB3062-038-Q1-K1-H4
acgctctcctcctccttggacctcccatcttccttcctcttcgttcgtttctccaaccgaagctgaccggcattcgctcctggttttccggccaagaaccgatttttttccggttccggcgtagcagcaggcagctagcttgccaccagctgattcattgcctctactagtgtttttcctgagctcggtggggtgatcggtcgatcggccgccgctcgagacacgtacgtacgtacgtacccgatcgagggtcgctccaagatgatgatgagcgggaaccggaagcagagggtggcattgtcgccggtgaacgaggccgtcgcggtgcccaatgaggaagtgtgggaggtccggcccggcgggatgctggtgc

SEQ ID NO: 38905 - DNA, 408 bp, Zea mays
  Clone ID: LIB3062-038-Q1-K1-H6
gctattgccattacatgcaaatatgccatatagatctgaagctggagaatgttctggtggagggcagcccagctccacggcttaagatctgcgattttggctattccaagtcatcagtgttgcattcaagacccaaatcagcagtaggaacgccagcatatattgcacctgaggtgctatcccgtcgcgagtatgatggaaagcttgcagacgtatggtcctgtggggtgactctttacgtcatgcttgtgggagcatacccatttgaagacccagatgaccccaagaatatacgcaagaccattcagcaaataatgcaagtgcaatacaagataccagatcatgtccacatatctacggaatgccagcaacttattgcccgtatctttgttgccaatccaatgagga

SEQ ID NO: 38906 - DNA, 424 bp, Zea mays
  Clone ID: LIB3062-038-Q1-K1-H7
gaagactggcgtgacaaaagctgattatttgaacagtgatggtccccataaaaatagagaaggcagtgaacaagaaagtgatgctcaaagttcttgcacaaggtcagagttggaggctgaaagtaagcaaactaacaacattttggagtatatgcaatcaactgaaaggcatttgtttattcgtagccacaaggatttagagctaaatggagagaccaaaacacgaactaagggtaataacttgattccaacaagagaagacgatttattgccaaagaaaagaacatgtttgaatgacaatgattctgagagaacttccagagatatggagctagttcacattatggacaatcagcagaagcatgacacacagagggatgtggatactatgagaacaacattcaggggaaatgatgagaagaac

SEQ ID NO: 38907 - DNA, 404 bp, Zea mays
  Clone ID: LIB3062-038-Q1-K1-H9
gacagaaagtagcataaatgctaccatgcttgaggaaggccttgctcggcttgaaagaggcgggagatgggacactagggagaggaagacggctctccagaacctggaacagttccaggagaaggcaaagaaggaaaggctgcggatttggcaatatggcgatgttgaatccgatgaggacgagcaggccccaactgcaaggaagcctggaggtcgtcggtagagctccccaaatgtgagactctgctgggagttatagattcaacttagagggtaccttatttattccgttagaaaacagaacttagtgaggcgaaactttctcggtttgagcacttttgatattccgtattttacatcgtaagcttataaagttaaaggtacattgccttttctctgaacac

SEQ ID NO: 38908 - DNA, 280 bp, Zea mays
  Clone ID: LIB3062-039-Q1-K1-A1
tagttctagatcgcgagcgggccctttttttttttttttttttttttttttttttgtttggttttttatttttgttttttttttttttttttttttaaaaatatttttactttttttacttttttattttttatattctatttaacacaatttcttttttttttacaaccctaaaacaacacccttaacttaacaactacaactcctttaaaaaaaaactctacaaccaaactaactttaaaaaaatttacaacataccatgtaccttttacaacacttt

SEQ ID NO: 38909 - DNA, 238 bp, Zea mays
  Clone ID: LIB3062-039-Q1-K1-A10
tacattcacttatacatcatcttcacttaccacataataaataataatacaagaaagatctaactatatgaaggacatcaaaaacctatcaccaataccacaaaatcttaacatacaaaacaaatacatattacatacacacctaacaatatcacttctaatctcttaatagacatttcactataactcaataccacaatatctcttataaaatcaaccataacatctaatccaaatc

SEQ ID NO: 38910 - DNA, 460 bp, Zea mays
  Clone ID: LIB3062-039-Q1-K1-A11
tcgacccacgcgtgcggtcgttcgtccagctaactgcactgcactgcactgcacgcaatggccaccacggcgaccgaggcggcgaatgctgcaccggcgcgggagcagcaggccaacggcaacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagc

SEQ ID NO: 38911 - DNA, 355 bp, Zea mays
  Clone ID: LIB3062-038-Q1-K1-G2
cacaagttcacctgtgtataaagggaagtttctcatggctgctagaagacttatgcgtggtccccatactgagtacggtatggctcttgatgcagaggacgtatcacaagggagcaattcatacatgggaaaactgagatctgatttctgggggacaaacttcaaaatatatgatagcaagccaccatatgacggcgctaaagcatcaagtagtcgatctagtcgtcgtttcggaagcagaaggattagtccccaagtatcgtctggtaactatgaagttggacaggtttcatacaaatacaacttgctcaaatccagaggccccaggagaatgaattgcactcttgaatgccct

SEQ ID NO: 38912 - DNA, 406 bp, Zea mays
  Clone ID: LIB3062-038-Q1-K1-E9
cattctcgcatgctcttcaactgtggttgcgggatcagttgcttcatactactgggcgcgtggtgaaatatcacatgagataccatttctcactgtagtctcttcactgaagcgactgatgcgctacagccttggatctgttgctctgggttcacttgttgtatctgttgttgaatgggtgcggtttatactagaatgccttcgtcgcaagttgaagctagttgattctgcccgagagagctgctttggaaaagcgacgtcctcctcttctgaatgctgcctgggttgcatagactggaccctcaagtcagtaaatcgaaatgcctacattatgattgccatcaccgggaaaggtttcttcaaagcttcagtgctcgcaactggattaataatgaagaacattttt

SEQ ID NO: 38913 - DNA, 380 bp, Zea mays
  Clone ID: LIB3062-038-Q1-K1-F1
gtaagcacctgtttctccatggaccatggctatgtttagcatcctccgtttggatttcgatgtgtgggtgtttgtgtctgcctaccttctctcccatttgggggtgcagttaccctgcaggcacagaaagattacccaccagacatgcaatgcaaggataaattcttgattcagagcacgaaggtggccaccggtaccgagatggatgagatccccctgatacgttcaacaaggaaggctgataaggtaatcgaggaaatgaagttcaaggttgtctacacattacctagctacggaggttcaaatgactctagcgtatcatttttaggaagccggagcttcaaagcagcgtctgacgatctgatgatgctgaagaatgc

SEQ ID NO: 38914 - DNA, 403 bp, Zea mays
  Clone ID: LIB3062-038-Q1-K1-F11
acccaagggtcgcggctcaagagcacacacagccagtcctgaaacggacacgttcttggagaggcaaccaaacagatattgcaatgaacctcgtacccgaaatgaggcagcagaagatgatagtggctgggaaactgtaagccaagttgaggagaatgggtcttgtaattcaccgggcggaagtgaaccgtctgtaaatggcttctgtggagaaaacgatgcttccgtaagtggaaccgactgggatgaaaactgtgacaatgatcaggcacacagtgagatcagtgaagtttgttcaacagcagcaggcaggtctcggaacaaaagatcattcgccggactatggagatcatcaaacaccgtggaccaaaagaagatgggatccaatacactcaacggtagg

SEQ ID NO: 38915 - DNA, 405 bp, Zea mays
  Clone ID: LIB3062-038-Q1-K1-F12
caagtggtggaggcctggtggtaaattgtttatcaagatcgctagagcagttaaatggactgctattatcttctgggatagatttgggtaacttcatgcaaaaatttactcatccaggaaaatttttctaccattttgaacttctggtagtcttgacttcatcacttcttatgaaccacatcattatattaatttgtatagagtccatgtcatgcttcccagcaggatcaaggtcgttgtcgtctccaggtccatcaaatgcgacaaggtcgagcgcacgcaattcagctccgaagtcatctcctttcaacagaaagatgcaagtaacaccaagtcacttgcctttgatggttgatacatttcactgtatatcattgcacgacagatccatttagtacctttttc

SEQ ID NO: 38916 - DNA, 277 bp, Zea mays
  unsure at all n locations
  Clone ID: LIB3062-038-Q1-K1-F2
acggccgcggtgaagaactgcgtgacgcaggtggccaagaagtcgctgagcctgaacgcccggggcgggctccacaacgcgcgcttctgcgagaaggacctgcagacggcgatcgaccgcgaggcggtgttcgcgtacgcggacgacccgtgcagccccaactacccgctgatgcagaagctccgcgcggtgctggtcgagcacgcgctggccaacggcgacgccgagcgcgccgcggagacgtncatcttcgccaaagtggccgagttcgagcagc

SEQ ID NO: 38917 - DNA, 397 bp, Zea mays
  unsure at all n locations
  Clone ID: LIB3062-038-Q1-K1-F3
nggaggatgtgcaagtgatgaaaccgacaatattctgtggtgttcctcgtgtttatgatcgtatatatacaggtataagcatgaaaattcagtctggagggatgatagccagacacctttttcagtatgcctacaactacaaacttgccaatatgaggaaagggctgaaacagcatgaagcatcaccgtttttcgacaagatagttttcagcaaaataaaggaagggcttggagggcgtatacgtctcatgatagctggagcagcacctttgccagggcaaatcgaagaattcatgcgggtaaccacctgcagcgttgtagtacaaggatatgggctcactgagagttgtgcaggatgcttcacgtcaatcgccaacattttctcaatgattggaac

SEQ ID NO: 38918 - DNA, 378 bp, Zea mays
  Clone ID: LIB3062-038-Q1-K1-F4
accaagacccgagccgtgtaggctgctacagtctcttcctccccgtcaagccgcggcggtcggggcccgcgccctcatatggtatagtcgccgcctccttgtcaccgccgattcgattaggttgatacagggaggagtcgcgaggggacgtagatgccgacgctgacaaagctgtacagcatgaaggaggctgcccttcacaacacgcccgacgactgctgggtcgtcgtcgacggcaagatttatgatgtgaccaagtatttggaggaccatcctgggggcgccgatgttctgctcgaagcaaccggtaaggatgctacagaagaatttgacgatgcaaggcacagcaagagtgccaaggagctaatgcaggactac

SEQ ID NO: 38919 - DNA, 479 bp, Zea mays
  Clone ID: LIB3062-038-Q1-K1-F5
cgctcgaaggaggtattaatcaggccggcatcaagtactacaaaaagctcatcaacggattgatagagaacggaatagagccatttgtaacaatttttcattgggacgtccctcaagcactggaagacaagtacggtggctttttaggcgacaggattgtaaaggattacacagacttcgctaaggtgtgctttgagaacttcggtgacaaggtgaagaattggttgacctttaacgagccacagacatttacaaccttttcgtacggaacgggagtttttgcccctggacggtgctcaccaggagaaaaatgtgctcagcctattgctaactcactcaccgaaccatacattgctggccacaacatccttcgagcccacgctatgactgttgacctctacaacaagaattacaagggtacagacggccgcattgggcttgcgtttgacgtaatgggtcgcgtgccatatggaaataca

SEQ ID NO: 38920 - DNA, 433 bp, Zea mays
  unsure at all n locations
  Clone ID: LIB3062-038-Q1-K1-F7
gaagtttgcggtgaatcgaaattctctgaactcggtgcagattcactggacacggtggagattgtgatgagtctcgaggagcacttcgatattagcgttgaggagtccagcgcacaaacaatcgccacagttgaagacgccgcggacctcatcgacaagcttgttgctggcaaagcgtagttctgtacctcctctatcgttgtcctaccactctaggtctatcccttgatctaggtttctatggtctgaagatttgtgattttctccgcactgttgttgctatccccgtgtcgtaataatacgagatgttttaagcggttgaacattacggtggtgtaatcagagtaatctgttgctgttaaagtgcattngtgaatgaattgtctctacccgagtagaagaatcagaccattcgggattctatgatcattat

SEQ ID NO: 38921 - DNA, 407 bp, Zea mays
  Clone ID: LIB3062-038-Q1-K1-F9
cagatcttcagatttcactctgcaaggaaatggtagaatggacccgtgcagagaagcgtactttcctccggcaacgtgtggaggcaaggttggcagctctcctgttagagaatcaggagtatactgaagcccttaccctgcttactagtcttatcaaggaagtcaggagacttgatgacaagttacttcttgtggacattgaccttttggaaagcaaacttcacttctccctgagaaatctgccaaaggccaaagcctccttaactgctgctagaacagcagcaaatgccatttatgttccacctgctcagcaaggcactattgatctccagagtggaatcctccatgctgaagaaaaggattacaagactgcttacagctacttctttgaagcatttgaagctttt

SEQ ID NO: 38922 - DNA, 417 bp, Zea mays
  Clone ID: LIB3062-038-Q1-K1-G1
acgtgccaaatgggtctctgaacttcaaaccaatgggtctctggtagtgccgagaattgtcttggaagcgcttcctgctgttttactattcgaaaagaagcaaaaggcaaaagctattgatataatagtgagtgaatgcagggataagggctatgacggtattgtgctcgagtcctggtcaagatgggctatttatggcgtgctggatgatcaagagctacgttacatggcacttgaatttgttaagcagctgggagaggctttgcattcagtcaattccaaatcaagtagccaccatttggaactaatttatgttattccggctccaagaatgcaaaagctcaataatcaggactttggacccaaagatctcatgcatctggctgacactgtaaatggtttttctcttatgacata

SEQ ID NO: 38923 - DNA, 421 bp, Zea mays
  Clone ID: LIB3062-038-Q1-K1-G10
gtagaagattacacatactttgctaaggtgtgctttgataacttcggcgacaaggtgaagaattggttgacggttagtgagccccagacattgacgtgtccttttcctacggaactggggtctttgccccaggtcggtgctcacctggactagactgtgcctacccaactgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatc

SEQ ID NO: 38924 - DNA, 413 bp, Zea mays
  unsure at all n locations
  Clone ID: LIB3062-038-Q1-K1-G11
cattgttggacgcgttcccctcctgcacgcaacctcatctcgtcctccagatccaggatgggggtcctccttgagaccttgcctgcccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttggtttggtttggtggtcgagcatcgcatgttctgcttctggatccagatctggaagaaatcgcgaagtcgtcgtcggtcgggttcggagcgggatctgangcggacgataggatgggaagcggcggggatcttctcggtctgcaagtccttgctccacctcgatgggatgatgtnctctgcg

SEQ ID NO: 38925 - DNA, 407 bp, Zea mays
  Clone ID: LIB3062-038-Q1-K1-G12
gatgatgtttgtgaaagttttgacagcatgggactgcaagagaaccttctgagaggcatctgtgcctatggttttgagaagccatcggctattcagcaaaggggaatagttcccttctgcaaggggcttgacgtgattcagcaagctcagtctggaactggaaaaacagctaccttctgttctggaatcttgcagcaacttgattatggattggttgaatgccaggcattggttcttgctccaacccgtgagcttgctcagcaaattgagaaggttatgcgtgctcttggggactatttgggtgtcaaagtgcatgcctgtgttggtggaacatctgttcgtgaggaccaaaggattcttgccagtggtgtgcatgttgttgtgggcacaccaggacgtgtgttttt

SEQ ID NO: 38926 - DNA, 455 bp, Zea mays
  Clone ID: LIB3062-038-Q1-K1-E8
ctcgggagtacttcgagctcgtccgcagcactgccagcggaggcgggagcccgccggcgcgatacgtgtcccgcgcgtgctccgccatctgcgctctcatgcccatccttacgctgtactatggacgcatggatgttactgtggcattttctgcattcgttattgccatagcattgcttttacaaagaggaaatcctcgttttgctcagctaaccagttcagtttttgggttattttactgtggctatctaccttctttctgggttaagctccggtcaggattagctgcccctgccttaaatacaagtatagcataccgttggccaattcttctgggtggacaagctcactggacagttggacttgtagcaaccttgatggctattagtagcatcattgctgctgatacatctgctttcctttgtggaaagggcattggtcgtacccctttgact

SEQ ID NO: 38927 - DNA, 306 bp, Zea mays
  Clone ID: LIB3062-050-Q1-K1-G2
tcgagggacgcgccaggcgttcgatctgctcgctgactcaaaggcatccaagagcgggttaccttcgacatcactgatgctacggactacccgtcgctgctcgaagatccgccacagtatgctggggagattagggagcatcactgggtgctgatgggatggacatcgatcgccaacctggccctgacggtgcaggcatactgcatctgccataatgagctgatggacatgacagttagcctggatgagtacgccagggctgatctaccagctgcatgactgcagctgcctgtgggacctacaact

SEQ ID NO: 38928 - DNA, 445 bp, Zea mays
  Clone ID: LIB3062-050-Q1-K1-G3
gtcgcttccagccgccgccgcgtccgcctcgccaagcgcagcagccgccgcagcacatcgctctcttgatctcagccgtggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactgcctcatgatgcacgggcgcaacaacggcaagaaagtcatggctgtccgcatcatcaagcataccctggagatcattcacctggtcaccgatgccaaccccatccaagtcgtcgtcgacgcgatcatcaacagtggaccccgtgaggatgccacccgtat

SEQ ID NO: 38929 - DNA, 79 bp, Zea mays
  Clone ID: LIB3062-050-Q1-K1-G4
tgtgaagtggaaccctggtactaagacctgtaatttcagaccctaatctgttgtatggaaatctgaaagccttgagtcc

SEQ ID NO: 38930 - DNA, 252 bp, Zea mays
  Clone ID: LIB3062-050-Q1-K1-G5
gccatgacacgtcccgagagcatctcctgatcggagcccaggacccatggccgtgggcaccggcgcgacgtctatgtgcgtggcgcaggggctcgggaagcccctatgcgccggcagctacacgacgtcgctccggggcgtcgcgctcgcgccccgtcgttcggcggcccggatggccgtcgtccgggcgtcgtccgcgcatcacgagcagcacccggccaatgagtgggcggacgcggcggacgtggcagc

SEQ ID NO: 38931 - DNA, 455 bp, Zea mays
  Clone ID: LIB3062-050-Q1-K1-G6
tcgccagccccttaaccctcgttcctctagccgtctcgcgcagccacagcctccattgctcctgcgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgcctcatcaggaatggtcttgctactaaggttgagaagtcccgcaagcaaatgaaagagcggaagaacagggccaagaag

SEQ ID NO: 38932 - DNA, 392 bp, Zea mays
  Clone ID: LIB3062-050-Q1-K1-G7
caagaatctatcgtcggaggggccgcaatcgaaagctgaaatatacttggaaatctgcagggcatccaactgttagaaaaagaactgatgacgggaagcaatgttacacacaatatagcccatgtgcgtgccagcaaatgtgtggtaaagattgcccctgtgcggacaagggaacttgctgtgagaagtactgtgggtgttcgaagagctgcaaaaacaagtttagaggctgtcattgtgcaaaaagccaatgcagaagcagacagtgcccctgttttgcagccagtcgtgaatgtgatccagatgtttgtaggaattgctgggtgagctgtggagatggttcactaggtgagccacttgcaagaagtgatggttatcagtgtggaaatatg

SEQ ID NO: 38933 - DNA, 350 bp, Zea mays
  Clone ID: LIB3062-050-Q1-K1-H1
aaaagagacgatatcgctgacacacctactgttgcaacaccattccgtgaacctcgttattgattgggtggtgaaactccaatgcacccgtctcgaacaccacatcatgcttatcagactccaatgcgggaccctggagcaacaccaatacatgaagggatgcggactcccatgcgaagtcgagcctgggctcctatgagccctccgagggataattgggaagatggaaatcctgctacttggggtagcagtccagcttaccagccaggaaccccacaagctcggccatacgaagcccccacacctggatcaaggtgggcaaacactccaagagttagtttcaatgatgc

SEQ ID NO: 38934 - DNA, 342 bp, Zea mays
  Clone ID: LIB3062-050-Q1-K1-H11
agctgggccgcggcctcttcgcctccgacgccgcgctgctcgccgaccgccgcgccgccggcatgatccaccgcctcaccaggcagggatacttcctccacgagttccagagcgccgtgcgcaagatgggccgcgtcggcgtgcgaacgggcgccgcccgcggggagatccgccggaactgcagggccgtcaactagtagaatgcgccggtccgtcacgtcacgtcaacgttgccacctctttttttttttttgcttatttgtttgtttccatcgatcatcttgtttacattgtatttagggaagtggtaattagtatacatatatatacatgtatacctgg

SEQ ID NO: 38935 - DNA, 254 bp, Zea mays
  Clone ID: LIB3062-050-Q1-K1-H12
agctgggccgcgtcctgttcagataagactcctggctactggaactctggagcggggacggcttaattgaccgactgatcaggcaacgatactttctctacaagttccagagcgccatgcgcacgatgggccccgtaagcatgcgaacagtcgccgtacgcggggagatccgacggaactgcttggccaggatctaaaagaatgcgccgtgccaatacgtcacctgaactgggccaacgtgccaaagaattatg

SEQ ID NO: 38936 - DNA, 470 bp, Zea mays
  Clone ID: LIB3062-050-Q1-K1-H3
gccgcagccatggcgtcgcggcgctgcctcctccgcctactctcgagccgcctcgtccctgagagatctcaaccttttgcaccgggctcgatcgcgaccagaaccctgaccacttcgtccgaggccctcgcccccccagctcccggggccctcccctcccctcggctgtactacctctcgcgctgccacttcgcgacccgctcctccggcgacgaggacgacgaatatgaagacgaagaagagcactacgacgaggaggatagcgagggggaatggggggacgatgaggaagcggtggcggcgaagaaaccgagcgggaagacggaagaagagaaagtagcggaagcggcggagatcggctacaagtgctcgcaccgctcggggctgacgagaaacccttcaagccctacgagcccgtcttcgccatcgtacagatcggctcgcatcaattcaaggtgagcaatggcgac

SEQ ID NO: 38937 - DNA, 480 bp, Zea mays
  Clone ID: LIB3062-050-Q1-K1-H4
atttgggcaggaatgcacacagtccgttactttgatggcaaaacatatgaatgggtcggactgagccgtcaacgaagcatcatgggtaaggtgaaaagatcgctgagccagttcacccctgctcaatgggacaaggatcagtggcatcctttcatggggccactgctgttcatccaagttctgttcctctgtgacgtcttcatgaccgtggagcttaacacattcttccttaagttttgcctgcggatccctccaaggaatcccttagtcgagtacagattgatcctttggcggctgattgccatcccaaccatccgcgagtacaactactacttacaagacagcaaaccggcgaagaacgttggagccttctgatggctctctctggctatatgcatagtggagctgcttatctgcatgaagtttgggcatgggctatttcatgacccaatgcctacctggctgatcatcctttggagc

SEQ ID NO: 38938 - DNA, 480 bp, Zea mays
  Clone ID: LIB3062-050-Q1-K1-H6
ctacaccattggcaaggagattgttgacctgtgccttgatcgcatcaggaagcttgccgacgactgcactggtctacagggcttgctagactatcaactctgtcagtggaggaacggtctctggcacttggatccctgctactagagcgcctgtctgttgactactgaacgaaatccaagcttgggttcactgtgtaccattgcggccaagttactacttcggcagtagagccatacaacagtgtactgtacagacactctatgctcgagcacactgatgcggctatactgctggacaatgaggccatatacgacatctgacgtcgatcctttgacattgagcgcccaacctacacgaacctcaacaggcttgtgtcccaggtcatctcatcccttactgcctgcctgaggttcgatagtgctctgaacgtgcgatgtaacgagttccagaccaacctggtaccctacccgaggatccac

SEQ ID NO: 38939 - DNA, 403 bp, Zea mays
  Clone ID: LIB3062-050-Q1-K1-H7
catgggctcgtcatcccagcacgattccatttccgcatcacgaagttcggagcgtgctgatggcagcagaagcagcattagcatgtggaccaaaattacgagcacagactcgtggagatggtgcctaaggttgatttacatcgatgctgttgccagtatatggattgctgctagctacatcgtgcagtctgttgtggatgccggtgtctctccgttcttgatcacctatatatgcaattgtctgtatcgtgtctacattcccatagtcgaggctggccggtacttttaggagtctattggtgacttgtggacaaagctgaaattcaaggatgctgaaagactgcaggacgcttctgacatggatagtgagaatcttcttcatagtggcgggcatgagatcaat

SEQ ID NO: 38940 - DNA, 283 bp, Zea mays
  unsure at all n locations
  Clone ID: LIB3062-050-Q1-K1-H8
catgaggcaatgggcatcgatgtgatgctgtacaacatgcttatgttcatgtgtgcagacattggctatgttgacgaggctgatgagatcttcagagacatgaaggcgtccatgggtgcccattccaagcctgatagctggagctactcatcaatggtgacgctgtactcattcactgccaacgtactgagtgcagagggcatactgaatgaaatggtggatgcccgctttaagccaaacatctttggcctgacctnactcatccgatgctatggcaaggtgg

SEQ ID NO: 38941 - DNA, 445 bp, Zea mays
  Clone ID: LIB3062-050-Q1-K1-H9
gcacagtcatccacactaacgaacgaactcttgctccgatcacgagctagctgaggtcgacgatggcggctgggctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgac

SEQ ID NO: 38942 - DNA, 209 bp, Zea mays
  Clone ID: LIB3062-051-Q1-K1-A10
tacttatcactctttatgcttttaccaatctataaactctctcgggcctgtttcaatccacgggggcaccggcatcttaaacaaccataacatctcaaccctcacgtcacatgcattttccggtcaatacttgcacaaactaaataacttacaaatatccaacactatgaaacccctctaattctacgtcaacctccacacacaataca

SEQ ID NO: 38943 - DNA, 334 bp, Zea mays
  Clone ID: LIB3062-051-Q1-K1-A11
ttcgaggtacgcgtccgttttttttttttttttttttttttttgacgaatatggcctgcactacctaccaccagtacggagactgcaactgcaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctcccttccggcggggccagacggtctcattgccgcctctccatgtaatccaactatagtttcatattatat

SEQ ID NO: 38944 - DNA, 433 bp, Zea mays
  Clone ID: LIB3062-050-Q1-K1-G12
ctcgcggtagccggcggcggcggaggaggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgcggaggccaaggccaacgtcaagaagcgcatcgagtacatctccgcagagctgaagcggatggatcgggcgctcaaagacttggaggaaaagcaaaacagcaagaaggaatcgatattcaagttgcagcagaggatgcaggctgtacaagct

SEQ ID NO: 38945 - DNA, 422 bp, Zea mays
  unsure at all n locations
  Clone ID: LIB3062-050-Q1-K1-E9
ccccagcaagccgcggttcttttggctgcgctcttggccgtcagcttattaggcgcgagcgcgacggcttggaaggccgaggcggcagcgccgccggcggtcgtggttggctccgtcaagtgcttggactgctcccccagcgatgtcgatgccttcaaagacctgcaggtagcgatcaagtgcaagtccggcgccgacgagggctacgagacgaaggcgcgtgcccccctggacgacacgggcgtcttccgcatcccactcgccgcagagctcctgcgcgacgacgggagcacggaccgcgactgcttcgcccagctccgcagctcgcccgacgacacgccgtgcgtcggccaggccccgcccaggatgatcgcgcncaccagccaagtagacggaagcagcagcacgaacacgacctacta

SEQ ID NO: 38946 - DNA, 375 bp, Zea mays
  Clone ID: LIB3062-050-Q1-K1-F1
cgagacgacccctgcgggcagatcttatcttccttgacctagccagttgtgcatgcgcctcgggggccggggcctgtccatctgagtgttagattacccacccgatgggcgtcgagctcgacctctacgacttggccgtgctccggccggtccagaccgcggcggcggccgactgcccggacgccgccgacacgggctgcgtcacgccgacggccgcgagctcccttctgccgcgcctgggcctgggcggcggcctactggacatcgactccgccgcgtgcgtgaccccgacggcgtcgccgtgcctgctgcggccggccacggtgtgccctccggcgccgcggaagccggtggcgcccggcagcaagaggggga

SEQ ID NO: 38947 - DNA, 452 bp, Zea mays
  Clone ID: LIB3062-050-Q1-K1-F10
agcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtacgtacgtacgttcgtgtactgctggcaagcaagcaggcatcttcttatcctccatgggcactatcccctacgactacgagtattagtacttgtcggatctgtgttggatctcgcgtgctcaagcaagccgactgagatcttctactagttctttc

SEQ ID NO: 38948 - DNA, 395 bp, Zea mays
  Clone ID: LIB3062-050-Q1-K1-F11
gactagttctagatcgcgagggccgccctttttttttttttttttgcgacgcacaaggagaaaccatccattgtcacaagtcatcatgaaacacggtacagggaaggagggagggaacaacgtctcagctggatctatttttttttatgagatagtacagagtagacatgggctagcggaacgcagcacgagaacgaatccacaggagggtaaaaaaaaccgccgctgctcctttgagaggaggtcggtccatcagaagagtgacgaggcgatcgcggagaccacggcgagcgcgacgccgccgctgaccccagcccggaacttgacgccgttgcccgcggcgctgtcgctcgcagggttgccgccggctgacggcgtgatcttggaggcgttgg

SEQ ID NO: 38949 - DNA, 443 bp, Zea mays
  unsure at all n locations
  Clone ID: LIB3062-050-Q1-K1-F12
attaaaattgacgaagagaatgagtgcaccgacagaaactatgttttcacctgctcgctcacgatgttgtctgtcttctggaacgtcagccggtccgctgccgaagcacaacggcgtcagctggaggggcaattcctgcatgaaggatggcctctccgacagcaccgtccgccggagcttggtcggaggcttctacgatgctggggacgccatcaagttcaactaccccatggcctggtccatgaccatgctcagctggagtgtgatcgagtacaaggcgaagtatgaggccatcggtgagctcgaccatatcaaggagctgatcaagtggngaacagactacatcctcanaaccttcaattcatctgctgacacgatagacaggattgtcgctcaagtgggtgtaggtgacacctcttaaggcagcagtcagcctaatgacc

SEQ ID NO: 38950 - DNA, 434 bp, Zea mays
  Clone ID: LIB3062-050-Q1-K1-F2
caaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgctccccaccgatggtctccccgacgat

SEQ ID NO: 38951 - DNA, 388 bp, Zea mays
  Clone ID: LIB3062-050-Q1-K1-F3
ggaccaggatctcggcctgaaccaggtggtgttcgacgagtcaaccatgcccgcgcctgcctgctcatgcacaggggagctccaccaatgctacaaatggggcagtggtgggtggcagtcgtcttgctgcaccatgaacatgtccatgcacccgctcccggtgatgcccaacaggcgccacgctcgcatggggggaaggaagatgagcgggggcgcgttcgcgaagctgctcagccggctggcagcagaaggtcatgacctctcgactccggtggacctcaaggaccactgggccaagcatggcacgaaccggtacatcaccatccggtagccagccggcggccacgttgaaacctgagcctggaaagggggagagatcacacaaacg

SEQ ID NO: 38952 - DNA, 495 bp, Zea mays
  Clone ID: LIB3062-050-Q1-K1-F4
caaatctaggcttccaagcgagcgaaagccttcctccgccagccgatctaccaacatcctctccgccgattggaggcgcctgcgaagatgccgcagcggcactcaaagaacaacagcgacctcggcttcttcacgtacgaggagaagcggaagctcgagtacatcacagcagcgggagcgcctggggaaggactccatcaagcccttcgacgcctgctgcctctgcctcaagccgctcatcgacccgctctgctgccccaagggccataccttctgcaaggagtgcatccttgagtgcctcctcgcccagaagaaggacatcaagcgtaagctagcagctcacgaggcccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatgg

SEQ ID NO: 38953 - DNA, 377 bp, Zea mays
  Clone ID: LIB3062-050-Q1-K1-F5
aggagctcgacggccgtaacatcaccgttaaccaggcccagtcccgtggcggtggcggtggcggcggtggctactgcggcggtcgcagcggcggcggctatggtggcgggcgccgtgacggcggatatggcggcggtggcggctacggcggtcggcgcgagggtggtggcggcggctacggaggcggtggcggctacggcggtcggcgcgagggtggtggtggcggctacggcggcggcggcagcggctggagggactgatgtgtgggcccatcctggcttcggccgagttatcttatctatctatagtatcgtgttaccgttcgcttctgtcaccgtgttagtgtccggtctacctttggatacgtgttggtaccc

SEQ ID NO: 38954 - DNA, 457 bp, Zea mays
  Clone ID: LIB3062-050-Q1-K1-F6
gcaaactgcacacgacgggaggtttcacatatatttcgcccatttgttggttttcgtgaagttcgtcttgtcaacaaggagtccagacatcctggtggagatccacatgtgttgtgtttcgtcgattttgacaaccctgctcaggctacaattgctctggaagcattacaaggttataagtttgacgaacacgagcgtgattcagcccatttgcgtctgcaattctcacgctttcccggtccaaggtcagctggtgggcctcgcggtaggcgttaagacgtgcggacctcgtggttgccgaacctatcgtttatacgagcgatccaactacggtgggctaacgcttcgatatgcgctgaatttcggggcggtggctttttagggttcgtcagctcatttcgtgaatgcgtgaaagggacaatgcaataagtgatattctgccatatgttattagatg

SEQ ID NO: 38955 - DNA, 212 bp, Zea mays
  Clone ID: LIB3062-050-Q1-K1-F7
aattcgagggacgactcacgcatccggacattacacctgaacgatagcattgtttgatcagagcccaatacccatgcccgtgggctcaggcacaggggatatgtaccaatggtacaaactggggaagtctctgtgggagtcatgttgtcgaccatgatcatgtccatgctcctcgtctcgcggattcccaagaggcgcaaggctctcatgcg

SEQ ID NO: 38956 - DNA, 408 bp, Zea mays
  Clone ID: LIB3062-050-Q1-K1-F8
cactgagccgaaagtggatgagagcattgtgttggaaaacccccagcagactgatttcagtgacgatccttcagtgctcaaagataggccattgtatgctggggagattttggatcataaatgggtgcctattggatggaataggatcgccgagctggtcctgagggttcagtcagactccagctgggagaatgagttgatggagatgagtgatagcgaggatgattacaccgtggctgatcttgcagctccatactggcagcgccctgtgggacctacttggtggtgtcatgtcaccggaggccatccttcaatagatgcatggttgaatagcgctcactggatgcattctgccatcagaattgcactgagagatgagagcaaactgataagcgaccggatgaagta

SEQ ID NO: 38957 - DNA, 311 bp, Zea mays
  Clone ID: LIB3062-050-Q1-K1-G1
cattacacgtgccgagacattttctgagcagagcccaggacccatggccgtcgccgacgtcgcaacgtctatgtgcgcggcgcatgggctccggaagcccctctgcacccgcagctacgcgacgtcgctcccgggcgtcgcgctcgcgccccgtcgttcggcggcccggatggccgtcgtccgggcgtcgtccgcgcatcaggagcagcacccggccaaagagtgggccgccgcggcggtcgttgcagctgcgctggtgctggccgaggtcgccgaggccgagcccgggatctcgccggcactcaagaact

SEQ ID NO: 38958 - DNA, 348 bp, Zea mays
  Clone ID: LIB3062-050-Q1-K1-G11
acgagctgggccgcggcctcttcgccttcgacttctcgctgctcgccgaccgccgtgcgttcgggatgatctatcgcctcaccaagcagggatactatctgcacgagttccatagcgccctgcgcaagatgggccgcgtcggcttgcgaacggacgccatccgcggctagatccgcctgaactgccaggccatgatctagtagaatgcgactgtccataacgtaacgtctacgttgccacctttttgttgggcaaacattattggtttgctgcaataaatcatatggatgacattggatttagcccaagtggtaattagcatacatctatatacatgtatacctggaa

SEQ ID NO: 38959 - DNA, 463 bp, Zea mays
  Clone ID: LIB3062-050-Q1-K1-E7
cccggtcgacacgcgtccggcagctgaccctgtgatccggattccggtgctgaacccggctacaacgcgtgtgcgtgagcgccggagtgccggagctgacgtgctgttggcgatgtgccgtgtgggacttacccgcggagaactacttcgtccggctggacccggacggcatcatgtgcctggcggtccggagcaccccgcgcaccggcatgtacatcatcggtaactatcagcagcagaacttacacgtcgtgtacgacctgcagaacaaccggctgggcttcgagccgcggcggtgcgccgaggcgtagtgtatagacgccggcgaggccttctgagactgagaggacgaacaattcgaacttaaacctcgcttgattgattggattgggaggcaaattgggagtagaaattttaggttgggaaggacggtggaacgtacgcaagctctgctacatagttt

SEQ ID NO: 38960 - DNA, 437 bp, Zea mays
  Clone ID: LIB3062-050-Q1-K1-D12
cagagctgagagccgaggagggaaacgaagaagcggccatggcgatgaagcggccggcgcgcagcgacccacacctgccacccgaggaggcggcacgggtggaggccgaggttcggagctacttcgacagcgtcgcgccgaggcgcccggccaagccgccgcgcagcgacccgtcggtggacaccttcgcggaacccgccgccgtcgacgccggggaccacgacttgccggagctccgcaagctgcgcgacctcgaggcgaagccccagaagctggtgttggacggagggggaggggacgtggatggcggggaggattacgtggagacgcgatactacgatggcctcataggcatcgacaagcagcatcacacgactgggacaggctttatcaaagtggagagatccaatggcagcagcttcagtgtgatgactaac

SEQ ID NO: 38961 - DNA, 364 bp, Zea mays
  Clone ID: LIB3062-050-Q1-K1-D2
atttccgggctcgcattttccttgcaaccgattgcctatccccctcccaaccaaagaccgattgcgcccaaggccgataagaagccggcggcgaagaagccggtggaggaggagcccgcggccgagaagacgaccgtcgggaagaagcccaaggcggagaagcgggtccccgctggcaagtccgccggcaaggagggcggcgagggcaagcgtggcaagaagaagggcaagaagagcgtggagacgtacaagatctacatcttcaaagtgctgaagcaggtgcacccggacatcggcatctcctccaaggccatgtccatcatgaactccttcatcaacgacatcttcgagaagctggccggcg

SEQ ID NO: 38962 - DNA, 135 bp, Zea mays
  unsure at all n locations
  Clone ID: LIB3062-050-Q1-K1-D3
ggccatctnctncgtgtcttatgacacagacaccgattccgactcctcgcggtgcagcgaggcaagcacatgggattctcaagtgttaagcaggcatgctgaatgtctggagctggaggagttgactgcaatatc

SEQ ID NO: 38963 - DNA, 270 bp, Zea mays
  Clone ID: LIB3062-050-Q1-K1-D4
aatcttattggggttaaagccctgaattccgaaaatagaattatggcaaagtttaattccttggttataagaaaaggtttcaatggtttttgtttaagaaccaattcccattttaccaaaccattaaattgcaaggtcaaggtgggcaattttcaaaatttcaaccttaaggccaaaaataacctttttccccaatttttggaccaattaggaagcttgattaaggtactttttataatcaagtccaacaagaattgcttgaaggccaaa

SEQ ID NO: 38964 - DNA, 488 bp, Zea mays
  unsure at all n locations
  Clone ID: LIB3062-050-Q1-K1-D6
ctgtccatgtatccttcgtcgtcatcaaggctgacaccccgtggcattacagcgaggagggcgtcgatcttgtggttgaggatcctaatggcgctcaagtccgtgattcccgagataagactagtgacaagtttgagttcatagttcagaagagaggcgtccatcgcttctgcttcacgaacaaatccccatatcacgaaacgatagacttcgatgttcatgttggccatttttcatatttcgagcagcatgccaaagatgagcattttgcaccactttttgagcaaataggcaagttggatgaggcactttataatattcagttcgaacagcactggctagaggcccagactgaccgtcaagcaatattgaacgagaacatgagcaggagggcagtccataaggcgctcttcgagtcagcggcgctgatcgccgncagcgtcatccaagtctacctcctgcgccggctcttcgagcgcaagctgggg

SEQ ID NO: 38965 - DNA, 177 bp, Zea mays
  Clone ID: LIB3062-050-Q1-K1-D7
gcacgctgtaccctgtgatcacggactacatattgctgaacccgtgctacaacgcctctgggggagagcgaccggaagtgccgtagctgtcactgctgctcaacgactgtaccttgagggacttccctgcggagaactacatcctacggctgtacccggactgcatcatgtgcctgt

SEQ ID NO: 38966 - DNA, 200 bp, Zea mays
  Clone ID: LIB3062-050-Q1-K1-D8
cgccatcatcaacgcttactataactcggattccgagaacgactactctcatctcttcagtgcgggcacatatgacactcaagtgacaagaatgcctgataaaactatggaccagaatgagttacattgcactgagaagacatcagacatctgcttcgatctatgaaataattgctatattacgaatatgccaacctacg

SEQ ID NO: 38967 - DNA, 449 bp, Zea mays
  Clone ID: LIB3062-050-Q1-K1-D9
gggtccttactagtgatgcgtgggaacagtgccgacatggcgcgacatgtggtgtgcccgtggtccaaccggcgcgtgagcatcacgttcgcaagggtgaggccatcgacgccggtggacatgagcccactcccgtcccccaccaaggccatgacaccctggcagccgcagccggtcacggcctcccaggtgccgtcgcccgtgagcatgacgcagaagcccccggtcagcggtgccataatcggttatgccccgaccccgcaggccgtgctggcgcccgcagcctggggcatggccatgcgcgcgcccgtcatgatggtggctgcagcgcctgcgaggcccatggtgatggcctcatcgggcaccggcggcggcaacatcagcaagcggatgggccgcagcggcaccggcgtgttcctgccttggacggtcggcccgaagcggtacaa

SEQ ID NO: 38968 - DNA, 442 bp, Zea mays
  unsure at all n locations
  Clone ID: LIB3062-050-Q1-K1-E11
caagaacgttcaggtggtggacagcagcaaccagctcagcgcccccaagggcgtaggcaccttcaccgagcagtccaactgctacgacgtgcagaacggtaacaatggggactggggcacctacttctactacggcggccctggcaagaactcgaactgcccgtgactggtgcttctaatgtgtagtgtgaagtgccgtcaccactagcaaaatgtaacccaagcgttcaggttcgcttatacagcgtcaatctgcatctccttgttcagtcctagctaggtagtgtgtaacatgtgcatgtgctctctagactctaatgttttcttcttcttttcattgtattttcttcttgtgccatgtaaagtttctgaagagaaggagcatggcttgaggctgcngtgggtggttgggctggtcggtggtgacctctactgatttttg

SEQ ID NO: 38969 - DNA, 439 bp, Zea mays
  Clone ID: LIB3062-050-Q1-K1-E12
gagttataccaagacttgttgaggttgtcaagggatctactaaagagaaggtggtcagagttgctgtgttgtctttctgtaatttgctggcaaagggtgcatttgctgcccagatgatcgatcttggattgccgcaaatagtacaaaacttgaaagctcaagcatggactgatgaggatctgttagatgctttgaatcaactagaggtgggactcaaagaaaacctcaagaagttgagttcctttgataagtacaaacagcaagttcttcttggtcatcttgactggtctccaatgcacaaagatccaagtttctggcgtgagaacattaacaattttgaagagaatgatttccagattctacgagttctcatgacaatcattgacacatcaagtgacaccaccgctcttgccgtggcctgctacgacctctcacagtt

SEQ ID NO: 38970 - DNA, 388 bp, Zea mays
  unsure at all n locations
  Clone ID: LIB3062-050-Q1-K1-E2
gcatatcagcagggtgctcaggctggggcatatcagcagggagcccaggctggggcatatgagcagggggcccagtctggggcatatcagcagggggcccaggctggggcatatcagcagggagcccaggatggggcatatcagcagggagcccatgatggggcatataagcagggtgctcaagctggagcatacaactatgcttatgatgctggcacggcttatgcatatgcaggttactctggctatccagttgcaggctacgcgcaaagtgcagtgcccaactattcctatgctgcacctncgcagccaacaagcagcggtgcagctacgaacgccgcaggaagccagtatggggcaattggtagtgctggatatcctactgggc

SEQ ID NO: 38971 - DNA, 449 bp, Zea mays
  Clone ID: LIB3062-050-Q1-K1-E3
gttagatacaaggcacttcttgatgaatgggaaacaaatccaagtgtcaagtgtattcttgtggaaagcagctcttctcgtgccttctcagcagggatggatattaagggggttgccgtggaaatacaaaaagacaaaaaaacaccacttgtgcaaaaggtattcacagtagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagatgttggctttgcttacattggtgcaaaagcaccaggaaggggtgcagttggaagttaccttgggattactggaaaaaggatatcatcacctgctgatgctatgttcat

SEQ ID NO: 38972 - DNA, 415 bp, Zea mays
  Clone ID: LIB3062-050-Q1-K1-E4
gatgttgataccaaggagacacctctacccatggaggatgccttaaatgactacaaaaggctagattacatccagcgccacatcgctactcttaaggaatcaatagacttgggatcaaatgtgcaaggctacttcgcttggtctctgctggacaactttgaatggttcgccggcttcaccgaacgttatggcattgtctacgtcgaccgcaacaataactgcacgcgctacatgaaggagtctgccaagtggttgaaacagttcaacgccgcgaagaagcccagcaagaagattcttacgccagcttagaaaatcggggcctcatgatgtgggtgcagcccataaaaaactggtgtgtggtttggaaaccgaaattttctgtttttttccgccacgagaaggtctggaggcatac

SEQ ID NO: 38973 - DNA, 472 bp, Zea mays
  Clone ID: LIB3062-050-Q1-K1-E6
gcagtgcaggatctggctcggctgaagcagcatttgttagataaggatcttgaagaccaagaaaagatggatgaagatagtaaactcattgaagagttgcgggtagtatgtgagcagcaaagggctcatataatgcagttagagagggctttaaaggtcgagatggcaaagcaggaggagaacaaaaaggtcataagtgaagagcaccagaggtcaaatgaacaaatagaaaatttgaactacaagcttgcaagctgtatgagtgcacttgaatcaaaaaatgtggagctgctaaatcttcagactgcccttggacagtactatgctgagagtgaagccaaggaccgacttggaggtgatttagctgttgctagggaagaactgtctaaattgtcagagtcattaaaggtggcaaatcaaaccattgagatttcaagaagggaaaaggaagatatggctaccaaactttcac

SEQ ID NO: 38974 - DNA, 461 bp, Zea mays
  Clone ID: LIB3062-050-Q1-K1-D11
gttcggggagctctaccgcgccatcatggacggcgccgcggaggagggggaggaggagggaggtggcgaggaggaggaggacatgcgggaggcgttccgcgtgttcgacgccaacggcgacgggtacatcaccgcggacgagctgggcgcggtgctgtcgtcgctggggctgcggcagggccgcaccgcggaggagtgccggcgcatgatcggccgcgtggaccgcgacggcgacggcagggtcgacttccgcgagttccgccagatgatgcgcgccggcgggctcgccacgctcgggtgatgggtgaccgtcgccggccggtgctgcctgcctcctgctcctgcacctgggcctggccatggagcgccgggcaccttatttctgcatctgcgtgcttgatttcgtgtgctagaaagaacctgtagatagatattgcttgctcggagcgaggggggagctc

SEQ ID NO: 38975 - DNA, 464 bp, Zea mays
  Clone ID: LIB3062-042-Q1-K1-D8
actcgtacagattctccatctcttggtccataatactgccgaagggaacgctcgaaggagggattaatcaggccggcatcaagtactacaaaaagctcatcaacttattgatagagaacggaatagagccatttgtaacaatttttcattgggacgtccctcaagcactggaagacaagtacggtggctttttaggcgacaggattgtaaaggattacacagacttcgctaaggtgtgctttgagaacttcggtgacaaggtgaagaattggttgacctttaacgagccacagacatttacaaccttttcgtacggaacgggagtttttgcccctggacggtgctcaccaggagaaaaatgtgctcagcctattgctaactcactcaccgaaccatacattgctggccacaacatccttcgagcccacgctatgactgttgacctctacaacaagaattacaag

SEQ ID NO: 38976 - DNA, 300 bp, Zea mays
  Clone ID: LIB3062-042-Q1-K1-E1
tcacgatcacgagggcttcccctactattgtgccttccatcactcgtccaccataacaccacatctcacagactgctggttgtcatgtcatgtcactctattcattttacagatccaacgatatgctcggcacgttcatcccccagctgtaaccctacacgtactttactcctgaatacaccaccccgtcatcaatgtttgcccggggagtcctactctgccaggaccaaggtacttacttacttggatccataaccagtcctttttcagttcaaacataatccgaatccttcaggctca

SEQ ID NO: 38977 - DNA, 321 bp, Zea mays
  Clone ID: LIB3062-042-Q1-K1-E2
gctatgcataggacatgactcgttgcatgacagatgaggagtctggacagcagagtctagggtgcctcaaccccatgctcgtgaagcgtttcacggagttccctccgaggagcagtcttgaccctagcatgtacgtctacaacaccaccaccatcatgcacgcggacctagagaacaagctcgatgacctgacggtgcatcaggcgctgtacggaaacctgctatacatcctgtaccacaactacaacttcatgccgatcctgttcagggtgaacatcctgtaggacaactttatatactccaccagtaccgtgctattct

SEQ ID NO: 38978 - DNA, 495 bp, Zea mays
  unsure at all n locations
  Clone ID: LIB3062-042-Q1-K1-E3
gaattccggggccgagagagccagccgccaggccagaggatctgactcctgtcgggctttgcgggacgacagacactccatgggttcggacgcacgatcacgagcgcgtgccctactagtgtgccggccatcactcggccaccagaacaccacagctcacggtctgctggttgtcatgtcatgtcacgcggtgcagttgacagagccaaggagatgctcggcacgttcagcccccagctggagccctacacgtacgtgacgccggaggacaccaccccgtcgggaatgtttgcccgggggtcctactctgccaggaccaaggtacgtacgtacgtggatgcagaaccagtcctttttcggttcagacagaatccgaatccttcaggctcgatagttcacgaggtttggtttggcatcctgttctttggcagttcctcgacgacgaccgcaagtgctacctgnagatcaactacaccttcgacatccgccgggagt

SEQ ID NO: 38979 - DNA, 459 bp, Zea mays
  Clone ID: LIB3062-042-Q1-K1-E4
gtcttagtacattggttttttgtactaatatacttgtctaagtattagaaacaggaagaaggggaagagaagaaagttggctgtgtacaaccaacaggctgtttcggtctggggcaccggactgtccggtggtgcaccggacagtgtccggtggtgcaccggacagtgtccggtgcgccaggctgcctcggccgaagaggccgctctcgggaatttgctgacggcgttcggctaaaattcaccggactgtccggtgtgcaccggactatccggtgagccaacggtcggccagggccaacggtcggccgcgcgatctgcgcgggacacgtggccgagccaacggtcggaagggggcaccggactgtccggtgtgcaccggacatgtccggtgcgccaacggctcccggatctgcaacggtcgaccgcgccaattaaggaaaggaatcgggcaccggacac

SEQ ID NO: 38980 - DNA, 484 bp, Zea mays
  Clone ID: LIB3062-042-Q1-K1-E5
gtgagaaagccagccgccaggccagaggatctgacgcctggcgggcggggcgggacgacagacacgccatttgtgcgcacgcacgagcacgagcacgtcccctactagtgtgccggccatcactcggccaccagaacaccacagctcacggtctgctggttgtcatgtcatgtcacgcggtgcagttgacagagccaaggagatgctcggcacgttcagcccccagctggagccctacacgtacgtgacgccggaggacaccaccccgtcgggaatgtttgcccgggggtcctactctgccaggaccaaggtacgtacgtacgtggatgcagaaccagtcctttttcggttcagacagaatccgaatccttcaggctcgatagttcacgaggtttggtttggcatcctgttctttggcagttcctcgacgacgaccgcaagtgctacctggagatcaactacaccttcgacatccgccgggagt

SEQ ID NO: 38981 - DNA, 456 bp, Zea mays
  Clone ID: LIB3062-042-Q1-K1-E6
ggcgtcgaaaagagggagggagagagagagagagagagagaggagttgcaagttggtgagatggatctgttggagcggggtattaagacggagacgggggagactcgcatggaacaggatcgtaaggaggaggtggaggctgatgctggggagaggaagacccaggagccgtcgcagcaaggccagggcctcagcctctcactcgccaacggcagtggcagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggc

SEQ ID NO: 38982 - DNA, 281 bp, Zea mays
  Clone ID: LIB3062-042-Q1-K1-E8
gcggtatcaacgcacatgctttgtgctttaatttactgagactagactcttgtactgggttcgagcaaaatattgccagtgtgtagtgttcgcatgaaattcgcaacctgatgtgtgcatttttctatccgttgcttcacagatcgtgttaattgttaggttcatgcttagaataaccctaattggtcaaaacatgcacacggcccttttccgatctgcgatgtcgccttctcagcattgtgttattttaagcatattgcactttgtcctatgtctaaaaa

SEQ ID NO: 38983 - DNA, 250 bp, Zea mays
  Clone ID: LIB3062-042-Q1-K1-F1
gttctcaattactcatactgctataatcaaccttattacactgtactactcgatcttatttctaaatgtgctgtgctctgaactcactacatcacttcaaactcacactgtacctaatacattcgttctaatcacacctttcattaccttaatctatagccatatgttgcccaactaaatacactaccacctaatctctacattcaaacttaccttctctacactaatcagacgttttactcatccttaa

SEQ ID NO: 38984 - DNA, 329 bp, Zea mays
  Clone ID: LIB3062-042-Q1-K1-F2
ggagcaactaacatgctttgtgctttggtttcaggagactagactcttgtagtaaattcgggcaaaagattgccagtttgtagtgtttgcatgaagtttgcaacctgatgtgtttatttttgtatcggttgctttggagattgtgttaattgttaggttcatgcttagaataaccgtaattggccaaaacatgcacccggccctgttccgctctgcgatgtgccttcgcagcattgtgttatttttagcatattgcagtttgtcggaggttaaaatacatcaatatggcattcattttggaagtcgacaactgctacagctacacattc

SEQ ID NO: 38985 - DNA, 454 bp, Zea mays
  Clone ID: LIB3062-042-Q1-K1-F3
caattcgcgggccgaccgactcttactcttgctcctaacgtatcataagcttataatttaccttattggactgtactactaggtcgcgtctttgcatgtgctggcaactgaagtcagtaaagcactccatactaaccgattatcataaaagctacttcgtgcgaaactgatcattacgtggttataaggcttacaatttcccgaccaatactagtgccacccaatctctctaagtgagctcaccatggcttatggagcaaaatttttctccattcttaaccgcagaactgttcacacagcattacttctccggatcagtctggtgaacgtacacaaatgaccctaaagtacaaaaaggttcacacggtcacacgccataattagctgcctggcttgttatgcgccctttgtaaatatgtgtaagctttatgttcctcggccccccccccccact

SEQ ID NO: 38986 - DNA, 472 bp, Zea mays
  unsure at all n locations
  Clone ID: LIB3062-042-Q1-K1-F4
gcaaaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgtcgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaaggggttggcaagagtggcaaagccctccactacaagggaagtaagttccacagaatcatccccagcttcatgctccaaggaggtgacttcactctcggngacggtaggggtggtgaatctatctacggcttgaagtttgcggatg

SEQ ID NO: 38987 - DNA, 433 bp, Zea mays
  Clone ID: LIB3062-042-Q1-K1-F5
agtttttcttgttctcaaggaatcatagtgcgataatcaaccttattggactgcactactggatcgcatctttgcatgtgctgccaactgaagtcagtaaagcactccaagctcaccgagtagcagaaagggtagtttgtgtgaacctggtcattaggtggttctatggtttccggttgcccgacgaatacgagtgccaccgaatctctctaggtgagctcaccgtggctgagggagcagagtttttcgccatccttaaccgtggagctgttcacacggtattccttctccggatcagtctggtgaacgtagacaagtgaccctaaagtacaaaaaggtacacacggtcacacgccataattagctgcctggcttggtttgcgccctttgtaaatatgtgtaagcttttgttcccttcgcccccccccccccc

SEQ ID NO: 38988 - DNA, 476 bp, Zea mays
  unsure at all n locations
  Clone ID: LIB3062-042-Q1-K1-F6
cacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcatgggcaggaacctcttcttcagcactgatgttgagaagcacgtcgctgaggctgacattatctttgtctcggtgaacaccctcaccaagacccgtgggcttggagctggcaaggctgccgacctnacctactgggagagcg

SEQ ID NO: 38989 - DNA, 416 bp, Zea mays
  Clone ID: LIB3062-042-Q1-K1-F7
aattcgggagtcgacccactcgtgcggttggcttctcctacccctccggttcagattcaagttcatgaggctctcctacgagctcaggtcttcttgaacgcatcgagatggcctcctcagatgctcagtacccttgcttcgtcacccaactctactgttccacgaaccaccacatctatccacaactacttcatcacctactccgacgtcctcgagtgcaaaatcatccttaatcgtgagactcacaagtcctcacgcttcagactttttacctactccaaaccggagaccattctaaacgccattcattgcatgaaccacaatgatcaacacagacgcatcatcatcgtccacaaagcccaacacaccgtcagacgccataactacctccctggctagtactgcgcccttcgtaa

SEQ ID NO: 38990 - DNA, 478 bp, Zea mays
  Clone ID: LIB3062-042-Q1-K1-F8
gagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcaaacgaggcagtacttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttt

SEQ ID NO: 38991 - DNA, 103 bp, Zea mays
  Clone ID: LIB3062-042-Q1-K1-D7
gtcaaataaagatcttgtgcctatatacggctctcatggttgtgccgtgtctctatatgttagtgcttatggatatggggagatcaaataatggccttgcaat

SEQ ID NO: 38992 - DNA, 227 bp, Zea mays
  Clone ID: LIB3062-042-Q1-K1-B5
cccacgcgttcggtcaaaatatattcaattacatgactttggatctgaaatcctgccaagagctgtactagatcatagtgtgcaggcatgcatttttacgggctattgggaggatgttggaacaatcaaatcattctttgatgcaaactttgccctcactgagcagtgcttcaagtttgattttatgatccaaaaccactttctttaattgaacccgaatcctggct

SEQ ID NO: 38993 - DNA, 457 bp, Zea mays
  unsure at all n locations
  Clone ID: LIB3062-042-Q1-K1-B6
ggggcctacgagagcgcagccgtgggacaggtgaacaagtccggggccttcagcgtcccggtggccggcgacgccgtcggcgaggacggggagctcaagtcggaatgcttcgcgcagctcatccacagcgcgtcgagtgcgccgtgccccgggcaggagccctccaggatcgtcgccgcgccacccggccacacggtccacaccaacggcaacgggaagacgttcctcgcgctcggcggcagggtctaccaaccgtcgcccgagtgcgcctcggcgttcctctgccaccctttcttccacagcatgcaccaccatcacgtaggagtccacacgcctgtgggtatcccgcacctgcccgttcacggncactccgtgccgnctgtcaccaagccgncgncggtagacgttcctgagcacataccggggccggtgcccgtgccggacacaagcctccgtc

SEQ ID NO: 38994 - DNA, 262 bp, Zea mays
  Clone ID: LIB3062-042-Q1-K1-B7
cggacgcgtgggcgggctgcatcttcgagtacgacgccggccacccgctcggctgcgggggcggcttcaaggaggaggacacgcccaacttcgtcggatcattctactccaaaaccaaggccatggtagaggaattgctcaagaactacgagaacgtatgcacccttcgtgtgaggatgcctatctcatcggatctctccaatcctggcaacttcatcaccaaaatcacccggtacgataaggtcgtcaacatcccgaattc

SEQ ID NO: 38995 - DNA, 465 bp, Zea mays
  Clone ID: LIB3062-042-Q1-K1-B8
aaagaatgctcctcctcctatggtaaggttgtctgggaaaagtttggtctctgccatctgggaaggggacagttcgatagttgctgaacttcttcagtcgatggaacctcatgttgaagaagaggtacttagtgatctgaaggccaaaatctgtgctcatgacccatcagattctgaagatattgagggaggcatccgtaattctctcttgtggctgcgtgatgaattacgaactcttccatgcacttacaagtgccgtcatgatgctgctgcagatttgatccatttgtatgcttatacaaagtgctttttccgagtccgggattacaagacagtaaaatctccaccagttcatatcagtccgcttgacttaggccccaaatatgccgataaactgggaccaggctttcaggagtactgcaagacatacccagaaaattactgcttagcccagcttatctattg

SEQ ID NO: 38996 - DNA, 344 bp, Zea mays
  Clone ID: LIB3062-042-Q1-K1-C2
gccgttcgcagttcacctacgcggtaaatcactagtgattcgctgaacaaaaaaagttacaggaaggaatcgagagcggatgctatcatcaaccacactccgaccaccggcgtcgccggcgccggcacacctcaccatctgctcctagcccgcaacgtggcggcgtgcgccgacagatgctgcggtgcgcgcggtgcggaactacgactacatcccgaagcgggaaccctttagctccagccgcagcatgctccactagttcctcaggcaagacaagcccctcatacagcgcaccaatgaccagatcacagattattgcacggtcatcgaaggcgatgagtgct

SEQ ID NO: 38997 - DNA, 464 bp, Zea mays
  unsure at all n locations
  Clone ID: LIB3062-042-Q1-K1-C3
ctggcatcagagtccccgggagaatggttgctctgtcggcaggagcgctggctccgctcgcaggtctgtctccgctgccgtcgtgcagcgcggctccgttgtactgccgcangagtccgccacttctcaatgtcgccatcgccaagacgcggccagctgttcaccaatctgctcctgcaagctttcgaaaatgtgcagctatgtcagaacatggacgtcaggaactccggaccaatgagtaccagctggatgatgatgatgagccgttttggctggcagtggtcagagaccttgctgtgggtttcaagggattggtagctttcttagctgagcagccgaggcaactgaagcacctggagtggccgggctttctacacacgctgaagacggtcacacttactcttgattggtaggtatgtttattggtgcattatcaactattgatgcttgcctctgctacatgc

SEQ ID NO: 38998 - DNA, 442 bp, Zea mays
  Clone ID: LIB3062-042-Q1-K1-C4
gctgccgtcccgcaggaagagtgccgtcctcggcgtcgtcgcgttgtcctcctccgtcctgagcctgctccacgccttctctctcccggcagcctctgcgctctccgtcggcctggcgcggcgccacaggcacgatgccacgcccgggctggccgccggcggctgcgacgtcttcagcggcagctgggtcctcgacggcggtagctcggcctcggcggcgtacaccgggtacaactgcccgctcatcgacgcggagttcaactgccagctctacggccgcccggactccgactacctccggtacctctggaagccggccggatgcgagctaccgaggttcgatggcgcggacttcctgacgcggatgaaggggaagacggtgatgttcgtgggcgactcgctggggcgcaaccagtgggagtcgctcgtctgcctgctgcac

SEQ ID NO: 38999 - DNA, 418 bp, Zea mays
  Clone ID: LIB3062-042-Q1-K1-C6
gctcgcgtcaccggagctctccagaaccgaaccccaactgcccaagggcgagcgatccgaggccctcggcggcttcgtcaacgacgccgagaacactttgaggaatggctgaagaggatgtccagccccttgtgtgtgacaatggcactggaatggtcaaggcgggtttcgctggtgacgacgcaccgagagctgtctttcctagcattgtaggcaggccacgccacactggtgtgatggtgggcatgggccaaaaggatgcatatgtgggcgatgaagctcagtccaaaagaggtattctgacactgaagtacccaattgagcacggcattgtcggcaactgggatgacatggagaagatctggcaccacaccttctacaatgagcttcgtgtggcacctgaggagcaccctatact

SEQ ID NO: 39000 - DNA, 315 bp, Zea mays
  Clone ID: LIB3062-042-Q1-K1-C7
atttctgggctcctagttcagttttggtgcagctacagcacactgccgctgaatgtgattgtttctcagatgggttccaagttcaagaaatcactggtctcggagaacgtgagggagtcgctgcacagctggtgcaagagggttaaggacaggagccgacacaacccgctcttctcgcggaacgggaccctcacgaccagatccgtgtgctccctagacaccacctacgagacggatcacgagacgaacacggtgtgcacgctgtcgaggacggcgtcggcaacgtcgctggacgaccagttgaccgtggtcacc

SEQ ID NO: 39001 - DNA, 429 bp, Zea mays
  Clone ID: LIB3062-042-Q1-K1-C8
gaagaagcacacggcgaaggagatcgccgcgaagatcgacgcggcgacgacgaaccggtgcggcggcaaggccgggctggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactccttcgcccccgctgctgctgttgccgccgtcgtcgtcgtcgccgccgctgccgaggccaccaccttcaagcccaagcccggcgtccgcggcagcctcaagaagtaagcttgctggcttggttggctcgcccgcctgcatggggcacaattcccttcggtttcaatcccatccgtcgacccgatctataatcaatc

SEQ ID NO: 39002 - DNA, 352 bp, Zea mays
  Clone ID: LIB3062-042-Q1-K1-D2
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggctccagtcccgcggcggccgtgga

SEQ ID NO: 39003 - DNA, 468 bp, Zea mays
  unsure at all n locations
  Clone ID: LIB3062-042-Q1-K1-D3
tcgccgtcgccgcctcgggccaaaccctacgcagggagttgattgatcgattgcagccatgagtgagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaagccctcaagaaaatgaacaagaacaagaagcttgttaagaagcttgccaagaagtaccatgcttttttggcatcagagaccatcatcaagcaaattccccgtcttcttggtcctggtctcaacaaggcangcaagttccccactctggtcac

SEQ ID NO: 39004 - DNA, 471 bp, Zea mays
  Clone ID: LIB3062-042-Q1-K1-D4
catctggggtaaccactcgtcctctcagtaccctgatgttaaccatgccacagtgaagacggccactggggagaagcctgttcgtgagcttgtctctgatgacgagtggcttaatggtgaattcatcacaactgtccaacagcgtggtgctgcaatcattaaagcgagaaagttctccagtgctctctcggctgctagctctgcttgtgaccacattcgtgattgggttcttggaacacctgagggtacatttgtttccatgggtgtgtactctgatggttcatacggtgttccttctggactcatttattcattcccagtaacatgcagtggtggtgaatggaaaatcgttcaaggccctccgattgatgagttctcaaggaagaagatggatgccactgcccaagagctgacggaggagaagacgcttgcttactcatgcctcgagtaaattctaccacacccagagag

SEQ ID NO: 39005 - DNA, 247 bp, Zea mays
  Clone ID: LIB3062-042-Q1-K1-D5
caattccctcatcgaccgactcgtcctcaactgattccaaaccttactccttcactttatcgatccatagcttccattcatagattgcattcctatcttcttagaccattgcatctcccatatagttcatcatgccaagaacaataagaaattcactgacactgtttagctttaaattagtctgaataattatgatccacattaggacatacgcttcagccactctatcaagttgcctaacattcct

SEQ ID NO: 39006 - DNA, 466 bp, Zea mays
  Clone ID: LIB3062-042-Q1-K1-D6
ggaatgtgcatcatggatgctcagatcttcagaaggcacctgaaagagttctatccattagtgaccaaacttatctgttgtgatcagatggatgttcgtggagcccttggtgatctctttagcaaacagcttactccactcatgccctgaagtctggcagtatttcctcccttgcatagatcttgttggaacatattcttcgtcagcatttttgtgcaaacatggagcaccggttgggtgcttgacatccttaacgcgctttctggtgcaacagctactccctaggaacttaagagcttgatcagcgggaacggcaggtccctaggccacatcttttttttttggatgacgcatgggaagtagcttgactgatgcgcacaccgtgtttttcctagcaggcttgtactttggagctatttatctgtgccctgacagggatgatgcttccattatacagtagagtagt

SEQ ID NO: 39007 - DNA, 464 bp, Zea mays
  unsure at all n locations
  Clone ID: LIB3062-042-Q1-K1-B3
gcacagtcatccacactaacgaacgaactcttgctccgatcacgagctagctgaggtcgacgatggcggctgtgctgaacagcaggaagacgccgcaggcggtggtggccgtgctggtggcggcggcgctgctggcttcgtccgcttcggcggcgatcacctgcgggcaggtggggtcgtcgctggcgccgtgcattccgtacgcgacggtgagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacangatcagctaagttacgacgaccaagctaataaggctaccg

SEQ ID NO: 39008 - DNA, 436 bp, Zea mays
  Clone ID: LIB3062-041-Q1-K1-H4
ctacacctcgtgtgttgccaaatatgaacgacagtgttcccaccccacccacttcttcggcaggagaagctcaccagtgcgtgccgggcagggaattcatcaggaggagaacatacttgaacagaacgtttcgacatgagcaggccggagcagctagctaatagagggagatgagggggtaagtgttctctgacggacgttctggcgcatgttcctttgacggacggtggacaggtttgtaaaacacgactcgacactcatgatccttatcatgttgactggcttgggcttggcttgcatctccagctcttcgcaccacagatctacgattattctctgcactgctggctagcctgacctgacctgacctgacagctactgtgcaatcatgtctatgatgtctgagcgctaatctatgccgggcaatcctatgtac

SEQ ID NO: 39009 - DNA, 447 bp, Zea mays
  Clone ID: LIB3062-041-Q1-K1-H5
caagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagc

SEQ ID NO: 39010 - DNA, 390 bp, Zea mays
  Clone ID: LIB3062-041-Q1-K1-H6
gtacacaatgcatgattttgtccactaagacagctcattccctcctgcatgttatctattccagagtccgggtgtctccaaaccgagggaaggagaagcaagttcctcacatctctcctgccatatctgctacttcagaagctttccttcacctactctctgcttcaagaattcaaagtagctggctctgcactctcctagcaacgaacttgctgccatcgatcccatgaagtcgaactatctcgtcgacctcctcttggcatcactcttgctcttcctcgtcgcaggacggcatatgaagaatctcgatgacgcatcaaaatcaatggatacattggaatccatgcatgaagactaccaaatgacagatgttgtccacaagacaattct

SEQ ID NO: 39011 - DNA, 440 bp, Zea mays
  Clone ID: LIB3062-041-Q1-K1-H7
cctgcgctggtctcgccatggccgccaaggtaaaccaatcgcctcagaactctcgctcgattcgcagagcttggggggcccggtggtttaatggctaacggagttcatcgctcactcggctcgtcgtgtcgtggcgcagaaggtggtgctgaagctggacctgcacgacaacagggacatgcagaaggtgctcaaggcagtctccactctccacggtactcctctcctctcccctgctctgctcccctccaccgtcactgtcatggaggccgcgcgcctgcaggagtaggaccctccgcgacctccctcaagtatattcgtagcgagtgagtccgtgtccgaattctggtctctgacgcggcggcaaccccacgcgcgtgcgcaggcatcgactccatcgcggtggacatgaaggagtccaagctgacggtagtcggtct

SEQ ID NO: 39012 - DNA, 421 bp, Zea mays
  unsure at all n locations
  Clone ID: LIB3062-041-Q1-K1-H8
cccctttcccatttttctggcttactgcaagcaaatactctacccaattacttgttggggtcaaatcttacccctattcgggagtttgacttctcgcagttacttcagacacagtcagctacaaagtataacccatctgcggcacctaataatctgccagcaatctccatgcaagagactntaaaaccaggaggctttcccaacactcagtctacgcaacatgttcccaatacgagcataccatcgggtcttcgtctcccacaacaattgcctgtatactctcagccaactctgcctcttgggccttttaccagcctggttggctatccatatttgcctcagaactactacctaccatctgcggccttccagcaggcgtactcaagtaatgggcctttccatcaatctggtgctcctgctg

SEQ ID NO: 39013 - DNA, 367 bp, Zea mays
  Clone ID: LIB3062-041-Q1-K1-H9
cggacgcgtgggatcgaaaaagaaaacggccttgcggtcttgctctccttcctcgtggtcgggggccactgcaacggtaggcacgcgcgcctcggcaaaccctccgactgctatgacattctccactacatcccgtaccatccgcatggccatggactctactgccagcgcaagccgacaccgcgttcgaatcgcagtcatatgcgacgtgcacaatgattgggcccttgaggaagattcaaaggcgcttcgatctcttcagccagatttagtgctttttacaggcgattatggaaatgagaatgttgaacttgtcagaagcatttcagatcttcagctaccaaaggcggcaattcttggcaatcat

SEQ ID NO: 39014 - DNA, 453 bp, Zea mays
  Clone ID: LIB3062-042-Q1-K1-A1
ttcccgaatcggccggcccgtccacgcatgcgtcgactccgatcccaactgccatttcgctctccatctacacgcccacctactacggcctcgtgcgcccctccattcaggaggtcacgttgacttcgcgaccgccaaagcccgcgactttcagcatacggaggccacatctggccgcgcgggccgccgctggcaacgcacccacgtccccggtccgcgaggtcgtcactgagctcgacgcggtcgccggcttcagcgagatcgtgccggacaccgtcatgttcgatgatttcgagaggttcgcacccacggcggccacaatgagctcgtcgctgctgcttgggatcactgggctcccagacactaagttcaagaatgcgatagatactgcactggcagatggtgagtgcaacgcactggaaaaggctgaagacaagatgtcctgttacctca

SEQ ID NO: 39015 - DNA, 462 bp, Zea mays
  unsure at all n locations
  Clone ID: LIB3062-042-Q1-K1-A2
cgctccccaccccgccaccaccgacgctgggatgaaggccgtgccagccgacagcgccgcgcccccggtgccgatgccgatgccgatgccggcgaccaagatcaccattcccgtttccgcggtgggcggcacggaggcggcgctcctcgggaaggggcggtacaaggtctgggccttggccgccatcgcgctcctcgcgctctggtccatgtccgccgcctccgtctcactccgctggtcctcctcgggtgacctcgcctccgtctacggggacctggacgtcccgctcgccgacgacctcgattcccttgagatggaggagagggagaaattagtgggacgaatgtgggacatgtacacacggaccagtgatgaggtacggctttcacggttctggcaggaggcgtttgaggctgcatacgaggaacttgctggtgatgatgtgcangtccgtgatgcagc

SEQ ID NO: 39016 - DNA, 177 bp, Zea mays
  Clone ID: LIB3062-042-Q1-K1-A3
actagttctagatcgcgagcgtcgtgctcttcaggtgtctgttgtctcgtgtctttactatgagtagtgctcctgagacttgtatttctccttttggcgccgctaaatggaattttcgaacaatgattttcgtgttattattttaaaacaaacggaccgacgctggcaacgcaccca

SEQ ID NO: 39017 - DNA, 373 bp, Zea mays
  Clone ID: LIB3062-042-Q1-K1-A4
ccgcaccatccgaggctcaagcagggaagtgatcatcatcatcatcagaagaagatgtgccggaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgtcatgctcgccctcgccggcgcgggcgcct

SEQ ID NO: 39018 - DNA, 436 bp, Zea mays
  Clone ID: LIB3062-042-Q1-K1-A5
ccggctccgatcccaactgccatggcgctctccatctacacgcccacctcctccgccctcgtgccgccctccattcaggaggtcaggttgacttcgcgaccgccaaagcccgcgactttcagcatacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacggcggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaa

SEQ ID NO: 39019 - DNA, 401 bp, Zea mays
  Clone ID: LIB3062-042-Q1-K1-A6
agaaaacaccccctctaaatggtgggaagttaggattctactacaaagaccatgagatcctggctccacttccagtgggtttccatcggtacactgtcgaaaacctcaacgatgtctcatcagacgctctgttggagcgtgaagtggaagaatttgacccaccgtccgaggttcgtgccatcattgagggccaaatgctgtcgatgcgaggccacgccgagaggtttggcatgccgaacccttccaaacggatcatagcaaccggcggggcatcctccaacgaaagcatcctcaagtcagtcgcgcagatcttcggctgccctgtcttcacagtccagagacctgattcggcatcgctgggcgcagcgctgagagcttgccacgggtggctgtgcaacgcg

SEQ ID NO: 39020 - DNA, 467 bp, Zea mays
  Clone ID: LIB3062-042-Q1-K1-A8
ggaactggaattactttgctgccaatcgtcctgagaaaaaagccccgaagattgaggctacgcatagggagaaagccatggaactctatcagactcaagtactaaagcagcaccgcagtaatatgtttgctgcaaatggtattggaatcttatacgctgagaaggccaaatgggatgtcgctaaggagttgttcacacaggtgcatgaagctgcatcaggaagtatatttgtacacatgcctgatgtatggataaatctggctcatacatattttgctcaaggtcattttcaacaagcagttaaattgtatcaaaattgtttgcggaagttcttccacaatacagatgcaaccatcctattataccttgctcggacacactatgaggctgagcgatggcaagactgcaggaaaactttgcttagagctatacatttggctccatcaaattacttggtacggtttaat

SEQ ID NO: 39021 - DNA, 227 bp, Zea mays
  Clone ID: LIB3062-042-Q1-K1-B1
attgtcattaaaaatggcagtagtccaaggatatgggggagaaaactcgagatgtacatagagagcgtgggtgtgtagcatcggaaaagatcatttggtctgtaactacttatcgtaattggtcagtcagatcattttcttgtttgttgctgtctgattattcttacccaatggttaatccgttcattgtatcgaacataattcaagtaatctgtattacagaggtg

SEQ ID NO: 39022 - DNA, 471 bp, Zea mays
  Clone ID: LIB3062-042-Q1-K1-B2
agcttgcacttctcatgacactggagcaggggaaacctatgaaagaagcccttggtgaggtgaattatggtgcaagtttcatagaatattttgcagaggaagcaaagcgtatatatggtgacatcattcccccaactttatctgatcgcagattgttggttttgaagcagcctgttggggtagttggagctattacaccatggaattttccattagcaatgataacccggaaggttggaccagctttggcctgtggctgtactgttgttgtcaagccatcggagttcacacctctgacagcattagctgcagcagatcttgctcttcaagcgggaataccagcgggtgcattgaatagtgtgatgggtaatgctgctgaaataggtgatgcgttgctgcagagtacacaggtcagaaagattacattcactggatcaacagctgttggcaaaaaactgatggctggatctc

SEQ ID NO: 39023 - DNA, 432 bp, Zea mays
  Clone ID: LIB3062-041-Q1-K1-H3
gtcagggcggcgtccacggcgcggctgcacaagcgcaactgccgccgcttcgcgcatcacgtcgggctcatcggcggcctgctggagcagctccgcgtgtcggagctcatgaagtacccggagacgcgggagccgctggagcagctcgaggacgcgctccgccggggctacctgctcgtcaactcctgccaggaccgctcctacctctacctcctcgccatgggctggaacatcgtctaccagttccgcaaggcgcagagcgagatcgacaattacctccgcctcgtcccgctcatcacgctcgtcgacaatgcccgcattcgggatcggcttgagtatattgagagggaccaatgtgaatattcctttgacgaggaagacaagaaagtgcaagatgctctgttgaatcctgacccttgcacgaatcctaca

SEQ ID NO: 39024 - DNA, 433 bp, Zea mays
  Clone ID: LIB3062-041-Q1-K1-B2
atcgctcacacagtcagaccgacggactcattaacacacacacggacacacaacttctcggacgcgccgtagccatggctggcgctgcgcagaagaagatggcaattgtttgcttgatgctgctggccgtcgtcggccaaatcgtcgctgatgctgatgttaccgtagaacatcccagccgcatctgcaccgaaacggtgattgatcctcgtgttcccaacaacgagtgcatctgctccaagaactgcgcctgtgccggcaagtgcatccttgagtcgcctgatgctgtccagacctgctttgtcgactgcgtcctcaagaacgactgcatctgcagcagcaagatcatccccggcgctgacgacccaaaggctaatgccaagtgaagtagtactgctatcatcatccccaataatggcgtacgtacctaaat

SEQ ID NO: 39025 - DNA, 364 bp, Zea mays
  Clone ID: LIB3062-041-Q1-K1-B3
tcgggagatccttttaaagctatttctgactatctactcatgcgaggttctgcatctctttggcggctcactaacatcagatgcgcgtacatgtctaccgtgtactacccatttactacggtcgatatgagcgatatatctcttatacatcatacagcctacttagtcaagtaactaggcttgccatagaatatactcattcagtctcatacgacgtgactcatgctcattacacttttcgtatactgctcggacaccatcaacgtggacaacaaactctctaaaacatctgatctcatcttgccatacctactcccaatctacacactgcttctcaagggcaatcacgttgaattactaccac

SEQ ID NO: 39026 - DNA, 432 bp, Zea mays
  Clone ID: LIB3062-041-Q1-K1-B4
ctgaggaaaaaaaaccccgcaaccgcacccacaccctccgcgtgctctctctgccccatgggcgggcccctcctcctggaccgcccgtcccgccgccgccgccgcccggccgtctggtggcgatggcgtaccgggcggacgacgactacgactacctcttcaaggtggtgctcatcggcgactccggcgtcggcaagtccaacctgctctcgcgcttcacgcgcaacgagttcagcctcgagtccaagtccaccatcggcgtcgagttcgccacccgcagcatccacgtcgaggacaaggtcgtcaaggcccagatctgggacaccgtcggccaggaaagataccgcgctatcacgagcgcgtactaccgcggagcggtaggggcgctggtcgtgtacgacgtcacgcggcacgtcaccttcgagaacgtgg

SEQ ID NO: 39027 - DNA, 432 bp, Zea mays
  Clone ID: LIB3062-041-Q1-K1-B6
gccaaccagaagagcttgcagttactgagagtgtgtgtgagagagaggatgggtggcaggggcagggctgctctgctgctggccctggtggtggtggccgtgagcctggccgtggagatccaggccgacgccgggtacggttactgcggcgggtacaccgcgactccgacgcctgccaccccgaccccgaagcccgagaagccccacaccaacgggccgaagccggacaagccgaccaaggagcacatgccgcccaaggagcacggtcccaagccggagaagccgtccaaggagcacaagccgacgccgtccacgtacaccccgagccccaaaccgactccgacgacggacactcacacccggactccttccaagccgactccaccgacatacactgccgcgcctacgccgaacaaacgcacaccaaaaccc

SEQ ID NO: 39028 - DNA, 429 bp, Zea mays
  Clone ID: LIB3062-041-Q1-K1-B7
atgtcattgagggttttgtaatgctcttgcagtcagcagaagacactgcactcgggatgggggatgctcctagtgaacttgctctcttcctagctagggcagtgattgatgaagtattaattcctctcaatttggatgaaatcagcattaagcttcggccgaacagcagtggcagccaaactgtccagatggcgcgtgctctactgtcagctcgccattctggtgagcggatactgcggtgctggggcggtggcactggatgggctgtggaagatactaaggacaagatcactaagctattggaggaatacaacactggtggtgacctaggagaagcctgcagatgcatccgtgatcttgggatgcccttcttcaaccatgaggtggtaaagaaggcactggtcatggcgatggagaagcagaatggca

SEQ ID NO: 39029 - DNA, 442 bp, Zea mays
  Clone ID: LIB3062-041-Q1-K1-B9
gggcgagttcggcggcaacgactacaacgcgcagatcttcggcggctacaccccggggcaggcgagcgggcagagcgcggccatcgtggacgccatcggcaagggcgtggagcagctcatcagcctgggcgccatgtacgtggtggtcccgggcgtgctgcccgtggggtgcttcccgatctacctgacgctgtaccagacctccagcgccggcgactacgaccagtacggctgcctgaagcgcttcaacgcgctgtcggcgcagcacaactcgctgctgcaagccaaggtgtcgagcctgcagagcaagtaccccggcgcgcgggtcatgtacgccgacttctacagccacgtgtacgacatggtgaagagccccggcagctacgggttcagcaccaacctcagggcctgctgctgcgccggcggcggcaagtacaactac

SEQ ID NO: 39030 - DNA, 432 bp, Zea mays
  Clone ID: LIB3062-041-Q1-K1-C1
catgaggaaagcaaggcacaacttcaggctcgacgaggttggaatacgaaggcaactgaggatggtctctcagattatcaagcgcaaagattcgcacctgtataggcatctgcagaagttgcaggccgaggactgtttcttcgtgtacagaatggtggtggttctgttcaggcgagagctcacctttgagcaaaccgtgtgcctgtgggaggttatgtgggctgaccaggcagccatacgagccgggatcgggaggtccacctggggaaggataaggctgcgtgctccgccaactgacgacctgttgctctacgccatcgccgcctgcgtcctgcagaggaggaagctgataattgagaagtatagcagcatggacgagatactgcgagagtgcaatagcatggccgggcagctagacgtctggaggctgct

SEQ ID NO: 39031 - DNA, 388 bp, Zea mays
  Clone ID: LIB3062-041-Q1-K1-C10
ctcatcaggaaggctgctgcccctcttgcagccttgctcctggctgccgccgctgtcgtgggctcgtggtctgctctttcaagtcgaagtaacggtggttcgagctagtggatagtgtggctcaactgtagaagttccttttgtatagcaagcaagtaaaaaaaaaaatgaccaaaaaatataacaaaatgcagctgtaagtttactgctgctctctaagtcgtgttcagtcatccagtgtgtctagtctagggaaaccccataaaaatggtgaaggtggaatcccatcccagtgtcataattaaggatgcacttcttctgtaagcaaatgtatgatgtacaatggccggcccgcagtctaaatgttacaactagctcttcttggtgg

SEQ ID NO: 39032 - DNA, 410 bp, Zea mays
  Clone ID: LIB3062-041-Q1-K1-C11
gtgctcaacctcaagggcctcagctacgagtacgtggaggaggacctcctcaacaagagcgagctcctcctcaattgcaacccggtgcacaagaaagtgcccgtgctcatccacgccggcaagccggtcgccgagtcgcagtccatcgttcagtacctcgacgaggctttccccggcggcacgtgcccgtcggtcctcccagccgacccctacgcacgcgccaccgtccgcttctgggccgtcttcgtcgacgacaaggtcgggtctccatggcacacggtcctgttcgcgcgggagcacgggaagaatgctgacgcggcgtcgcggatcgtcgcggcgctggagacgtctggaggcgcgttcaagactgctccggcgggaaggactacttcggcggcggcgccatcggc

SEQ ID NO: 39033 - DNA, 439 bp, Zea mays
  Clone ID: LIB3062-041-Q1-K1-C12
ccgggggctggaaggaccggacgacggtggaggatatggacctggctgtccgtgcgatgctgcagggctggaagtttgggtacgtcggcgacataaaagtacgccggtgctaacgatcatcactactttctcgcacggaactcaagagcataacaagaaacgaattctaacgatcctcaggatatataactgcatctgtatgtatgtgcgttaggtcaagagtgaattgcctagcacgttcaaggcataccggtttcagcagcacaggtggtcttgtggaccggcaaacctgttcaagaaaatgatggtagagattttagaaaacaagaaagtgtcattgtggagcaaaatctacttatggtacaatttcttcttcgttgggaaggtcgctggccaaacggtgacattcatctactactgctgtgcgatccccgtgtct

SEQ ID NO: 39034 - DNA, 432 bp, Zea mays
  Clone ID: LIB3062-041-Q1-K1-C4
cgccaataatggagtttccgcaccaccaccaccaccacggccatcgccgcgacgactacggggacgaccgcagaggcccggctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacggccacgagggccgaccgcaccacggcggcggcggatcccagtacggccacgagacacgcc

SEQ ID NO: 39035 - DNA, 432 bp, Zea mays
  Clone ID: LIB3062-041-Q1-K1-C5
atcttaaaaaggaatgtgaggaaagaggtgcaacaatcatctatgccacgcatatggtgggtggtcttgatgattggccaacacacattgtttacattgctcatgggaaactgcaattagcactgcctttggaaaaggtgaaagaaatgagtcagttatctctcatgaggactgtggagagctggttgaggaaagaaagagactaggacaggaggaggagaaaggagcgaaaggagaaaggcctcccagaattcgacaaggttgtcgagggtagtcgggttataggtgatccagcaaagaacgcagacagagttataaacaacgggtgggcagctggacggcttacctcgacgattgcaggagaggaaaatttcgtcttcagctctaacagcgtacttaggcaatgatctagttttgttttcctttatctat

SEQ ID NO: 39036 - DNA, 448 bp, Zea mays
  unsure at all n locations
  Clone ID: LIB3062-041-Q1-K1-C6
cggcgtggcgcctccccagcgcccagctgtcgcgctggccatcgggggcacgcatcgccgccgcgcagccggcgcgggcgtacaaggtgacgatggagcacggcggcgagtcgcgggtggtggaagtggcggaggacgagacgatcctgtcccgcgcgctggacgagggcctggacgtgccgcacgactgcaagctcggcgtgtgcatgacgtgcccggcgcggctggtctccgggacggtggaccagagcgacggcatgctcagcgacgacgtcgtcgcgcgggggtacgcgctgctctgcgccgcgtacccgcgctccgactgcaccatccgcgtcatccccgaggacgagctgctcaaggtccagctcgccaccgtcgacgactgactgacgctccgncgatgaccatcggaccggccagcaggcatcaaccttcggcggtgtaa

SEQ ID NO: 39037 - DNA, 326 bp, Zea mays
  unsure at all n locations
  Clone ID: LIB3062-040-Q1-K1-H8
cgagagtcgacaccatggccatggcgacgcatgggcaggccgaccagcagcagcgggacgggcggtctgagcccaccaccagcgtcgccgccaaccgctgggggccctactccggcgccggcgacttcgccagcaacatggccgtcatcctgggccgcctgctggccgcgctcgcgctcggccttgcgctcaacgccgncgtgcgctacctgctccgncgcagccgccgcgccggctctgttggtggacagggcaacggcagcggcgtgctgatgccgtcggacgaccccgctgagaagccctctgtggaggtggagctgcaggcg

SEQ ID NO: 39038 - DNA, 434 bp, Zea mays
  Clone ID: LIB3062-041-Q1-K1-A1
tagaaagggagggtgcattgaaggcaagggagttagagttgctatcagttgagcacactgaaaggtcagcagacagaggtttaactgacaatgcaatttcaaaagatcaaatggaagctcttgttgagaagataagtaagttaaatacgctgtcaggcgagtcaaatgtgcaaaaggaacaggctacaagtccgcttgacaaactttttgttgtcattgatgaattcagtgcacttcaacatgaggttgagaccttaagatatgaaaatgaagatttacagttacatattgaatcctatactcgtgaaattgaacagctaagagaggtctccagaaatagtgatataactaatagggagttggaatccaaaggaagtgagcttcttgaggtagccgttagtatggagcgaatgattcagcggttaggatatctt

SEQ ID NO: 39039 - DNA, 440 bp, Zea mays
  Clone ID: LIB3062-041-Q1-K1-A10
aactatcagtccatctcaatctatattagttcttgaaggaatagtaaatggttctattgatggaaattggaattgagaatacatgtcttgacatatataagaacctgtttgttgtttgatgaactaggaaataactaaaaattatttggacagagacatcacaaatggatctgatcacaaatcacaaatgtgacaagcttgctaaggtgaaactgctaaagaagttgtatgactactatgccgcgggcacatgacatcaattgactcaaggagaaaagagaggcgtcatccaaaattctgagtttgttcgctctattagagcccataggcggtactgggcgaggagctatgctggatggataaggtttaggagagcacaaccaaatgcagcccattacgatccttcccttctgtctgcgcgccttcactttcatctggca

SEQ ID NO: 39040 - DNA, 438 bp, Zea mays
  Clone ID: LIB3062-041-Q1-K1-A11
aggcagcacagcagcagccagctccatccatcctctttcccctcctcgcttcgcttgctcgtgtgattcctcctgcctgggccgtccccgtcccctttttcggctcgcgagctcgcccgagatggcaaacgcgagatcgggtgtcgctgtgaatgaccagcgcatgctcaagttcggcgagctgcagacgaagaggctgcaccgcttcctaactttcacgatggacgacaagttcctggagatcgttgacgaccaggtcagggatcgcgctaccagctacgaggacttcacaaacagcctccacgacaatgactgccgatacgccatctatgacttcgactttgtcactgcagacgatgtccagaagagcacgatcttctatatcctatggtccccatactccgtcaaggtgaacagcacgatgctgtatgcaagctc

SEQ ID NO: 39041 - DNA, 231 bp, Zea mays
  Clone ID: LIB3062-041-Q1-K1-A12
tcttacaaaccagcacatcatcagccacctccattcattttctttcccctcctctcttcactatgtaagttattattaaaaggtgggccgtccccatcccctatttcctctctctaactcacactaaattccaaactctacatcacatgtctctataaatcactaacacatactctatttcctctatctacatactaatattctacaccacttactaactttcactataca

SEQ ID NO: 39042 - DNA, 435 bp, Zea mays
  Clone ID: LIB3062-041-Q1-K1-A2
tcgtagaaagaagatgctacgagcacaggctgagagggagatactagaaatgctagatcatccggtggtccctactctttatgcccattttaccacagacaatctctcatgcttggtcatggagtactgtccaggcggtgatttgcatgttcttcgccaaaggcaacctggaaaaagctttccagagccagcagcaaggttttatgttgcagaagttctccttgctttggaatatcttcacatgttaggggtcatataccgtgatctaaagccggagaacattttagtccgtgaagatgggcatataatgttatcggacttcgacctttcactgaggtgctcagtgaatcctgtgctccttcggtcatcttctgttactgcgaaccaccaaccgaggaaacatacaggaccttgtgcagagaactactgcataaa

SEQ ID NO: 39043 - DNA, 415 bp, Zea mays
  Clone ID: LIB3062-041-Q1-K1-A3
gcctccgccgacgaccccagccccgacccgctccactacggcctcacgctctcccgaccggatgggcgcctcgacggcgtcctcgccgcgtacaccagcttctccatccactccgtggtcggcgccggacaactggaggccaaagtgcgcgacgaggccgatgccgtcgcgtactggacggccgtcgcgcccaacgtggaggcgtacggaagcgcagtggccatgaccatcgccacgggcgccgagcacctcgccaaagggatactgtggtgcagggaggtcacgtagagagcctacgctgggggaatgaggtcctcaaaaagaggatgcaagccgtcgacgccaacgtcgaggtcagccccaatatgctcaagcgaatcaaaagggctaagacggtgagccaaatatctgagaa

SEQ ID NO: 39044 - DNA, 408 bp, Zea mays
  Clone ID: LIB3062-041-Q1-K1-A4
aggccattgagacctgaatatagagatgatcacatggtggggcttgtgactgaattcttggacgcagtacaacatttcataagtcttgggaaaagctatatcatatagtctagatttcttagctcagtacaaattgctcctagattcttatggaagaatgtcatcagtctattgtttcatgggtgtgcacccatctgactcaaataatattgttgtatggtgtgcacccctttgacttcaggagaaacttatcctatattttgcagatgtttgggtctgtgatatggtttcctttgtctacaccgaatgttctaattatctatatcgttcctttgtacagctcttggtgtagcttgccactctcaccaatcaagttttcatgtctgatctcgacattcagatcccaac

SEQ ID NO: 39045 - DNA, 432 bp, Zea mays
  Clone ID: LIB3062-041-Q1-K1-A6
gctttgtacggggcatatgagggtagttcttcccaaggaagctcttctagttacggggagcatacagctccaccatgagatcctgtagcattgatggaattctatgcaaagaaggctgcactggaagaacggaagatgccaccaaggcagtcgaaagatgaaatgccgtcacctccttctcttcaaggtcctcctaagaagggacaccacatgggtgatttcattcctcaagaagaacttgaaaagtttatggcacggtgtaatgatgctgcagcacaaaaggctaccaaagaagccgctgagaaggctaagattcaggcggacaatattgggcacaaacttttatctaagatgggttggagggaaggcgagggtcttgggagcgagagaagaggccgtgcagatcccgttatggctggagatgtgaagaag

SEQ ID NO: 39046 - DNA, 446 bp, Zea mays
  Clone ID: LIB3062-041-Q1-K1-A7
ctgagattgagatcctgaggaagaaggggcactcctactctgagatcatcaacgagagcgtgattgagtcggtgggctcgctgaacccgttcatgcacgcccgtggggtcgccttcatggtggacaactgctccacaacggctcgcctgggatccaggaagtgggcgcctcgcttcgactacatcctgacgcagcaggcctttgtggcggtggacaaggacgccccgatcaaccaggacctcatcagcaacttcttgtcggaccctgtccatggtgccattgaggtctgcgccgagctgaggcccaccgtcgacatctctgtgcctgccaacgccgactttgtgcgcccggagctccggcagtcttcctagattgaggcagtgagcggagagggagagggagagagaaagagaggatttcgtgtcccgagttagaacagagtgctg

SEQ ID NO: 39047 - DNA, 431 bp, Zea mays
  Clone ID: LIB3062-041-Q1-K1-A8
gtttgagagcattccaccggcagactccgtcttccttaagtgggttttgcatgactggggcgatgctgattgtatcaagatactcaagaactgtaagaaagctataccttccagggatgcaggaggaaaggtgataatcgttgatatggttgttggaggccagtcgtcaaacattaagcacaaagagactcaggtcttgtttgatctcttcatcatgacgatcaatggcgccgagcgagacgaacatgagtggaaaaagataatttccgaagctggatttagcgactacaaaatcatacccgttctaggtgttcgatccatcatcgaggtctacccatgattatttggcgaatacgtgtttcgtttttttctgaataagttgtttggttaactagcatgggacgagtgtccatgagatcatgtgtgatgaa

SEQ ID NO: 39048 - DNA, 444 bp, Zea mays
  Clone ID: LIB3062-041-Q1-K1-A9
aaagtggaaatatgttgaagctaaggctgcagcatactatttccacggtttgattcttgacgggggaaataccgaaaaatcccatggaatggcaatagctgcactccaagcttcagaggaatttctaaaagaaagcaaaagggtttcagaagccttccatgcaactcctccaacatcgaggagtcccaatccattcggaacagcaaaatatctgtttgacaagatcccaagagatgcttccagcaaggttcgaatcaaccaggacctgtatactcaagaaaaggtcattggagcgccacccccattaccagattttgcattggcgctaacacctgaagaatatgatcttcctccactagatccattttggaacaaagaagacacatgccattaagtgtatatgcagcagaatggttgcttctggcaaaaatattggctctggag

SEQ ID NO: 39049 - DNA, 438 bp, Zea mays
  Clone ID: LIB3062-041-Q1-K1-B1
ccgagctactcgtccgactggggcgtccaatattactttcaaaggaatggcgtgcaaatgggggagatggcgcactcaattgtggctttacatcgtcccatcgggcatgtatggagtcgtgaactacctaaaggaaaagtaccataatccaatcatcatcatatcggaaaacggaatggatcagcctggaaacctcacgcgcgaggagtacgtgcacgacgccgtgaggatcgacttctacaagaactacctgacggagctaaagagagggatcgacggcggcgcgaacgtgatcggctacttcgcgtggtctctcctggacaacttcgagtggctgtcgggctacacgtccaagttcggcatcgtctacgtcgacttcgcgacgctgaagcggtaccccaaggactcggcgtactggttcagagacatgctttcggg

SEQ ID NO: 39050 - DNA, 441 bp, Zea mays
  Clone ID: LIB3062-041-Q1-K1-B10
gcgacacgatcgcgagcgcacgcacgtaagcacgttgtcggaagctcaagttagaagaagcggcagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgcc

SEQ ID NO: 39051 - DNA, 294 bp, Zea mays
  Clone ID: LIB3062-041-Q1-K1-B11
cacttgtcagcaaagcgccggaaaccaaaccaccgccgccttggctagctaacacgtgcacgtggcagtgatcccgatgggaatgctgccgcgtacaacagcgctcgtcgcatcggcggtggtggcggcggcgctggtgctcgggatggcgtcggcgcacgggccggccgccgcgcccgcgccgggcccggcgcccgggatcagcgacgagtgcttcaacgcggtgctcaacatgtctgactgactgacgtacgtgacggcgggcatcaaggcgcgtcacccggacacggcctg

SEQ ID NO: 39052 - DNA, 249 bp, Zea mays
  Clone ID: LIB3062-040-Q1-K1-F4
gctaccgatgagctttaacaaacgacgaagctgacttgcatgaaagattggttgctatacgagaacggctaaaaggacataccgctgatcttcctaagagggtcaatacactggtatagacgtggcgacttctggctagcatgggtcctgccggacgcagcgttcatattcccagtggtccgcaagtatacgagctgggtgaaacagagcgtacttgaggccttacaacagctgacataggcagggatg

SEQ ID NO: 39053 - DNA, 78 bp, Zea mays
  Clone ID: LIB3062-040-Q1-K1-F5
gacatactgtgctaaggtaggcagtaatagcttgcacgacacggtgaagaatcgctggacgggtactgaggtagcgac

SEQ ID NO: 39054 - DNA, 467 bp, Zea mays
  Clone ID: LIB3062-040-Q1-K1-F7
cagcctcacgctgctcgatggcggcgccgtatcaccagcctacgagcctggaggaggtccgcactctgtggatcggggacctccagtactggaccgacgagaactacctctacagctgcttcgctcacaccggggaggtacaatctgttaaaataatacgcaacaaagtaacaagccttcctgagggttatgggtttatagagtttgtttcacatgaagctgctgagaaaattctccagacttacaatggcacacagatgcctggaactgatcacacattcagattgaattgggcctctatcagctctggtgagaggcgccctgatccaggatctgatcattcgatcttcgtaggggacctggcacctgatgtcacaaattacttactacaggaaacattccgagtgaactattcatctgttacaggtgctaaagttgtcacggatccaaataccgcgagatctaag

SEQ ID NO: 39055 - DNA, 387 bp, Zea mays
  Clone ID: LIB3062-040-Q1-K1-F8
cggacgcgtgggcgcagcttagatcgagtccaagaggttccccatgagggacctatgtgcgatctcttatggtcagatccagacgaccgatgtggttggggcatctcccctcgcggtgctggctacactttcgggcaggacatatcagagcagtttaatcacacaaacaatctcaaactcgtagctcgggctcatcaattagttatggagggatataactgggctcatgagcaaaaggttgtcaccatattcagtgctccaaattactgctatcgatgcggcaatatggcatccattttggaagttgacgactgcaacagccacacattcatccagtttgaaccagcccctatgagaggtgagccagatgtgacgcgaagaacaccg

SEQ ID NO: 39056 - DNA, 471 bp, Zea mays
  Clone ID: LIB3062-040-Q1-K1-G1
aattcccggtgcttctgctgcccctccggttcgggttcgggttcgtgaggttctccggcgttccgtttcgtgggtgagcggatcgaggtggcggcgtccgatgttgagtaccggtgcttcgtcggcggactcgcctgggccacagacgaccactccctccacaacgccttcagcacctacggcgaggtcctcgagtccaagatcatcctcgatcgggagacgcacaggtcccgcggcttcggcttcgtcaccttcttcacggaggacgcgatgccgaacgccatcgagggcatgaacggcaaggagctggacggccgcaacatcaccgtcaacgaggcccagtcccgcggcggacgtggaggccgcggcggcggcgggtacggtggtggccgtggacgcagcggctacagcagtggcaggcgccgagatggccgcagcagctacagcggtggcggcggctacagtggtggc

SEQ ID NO: 39057 - DNA, 465 bp, Zea mays
  unsure at all n locations
  Clone ID: LIB3062-040-Q1-K1-G3
gtttcctatcttgctccccaaaccagcgcataccctgccctgacaccggcggcgccatggtgctcgaggcaacgatgatctgcatagacaattcggaatggatgcggaacggcgactacgctccgtcgcggttccaggcgcaggccgatgccgtcaacctcatctgcggcgccaagacccagtcgaacccggagaacacggtaggcgtgatgacaatggccgggaagggtgttcgcgtgcttgtcactcccaccagcgacctcgggaagattctcgcctgtatgcacgggttagaagttggcgctgaggcaaacttggctgcggcaatccaggttgcccagcttgctctaaagcatcgccagaacaagaggcagcagcagaggattatagctttcattggaagtcctgtgaagtacgacaagaaaagtttggagaccattgngaagaagctgaaaaagaacaatg

SEQ ID NO: 39058 - DNA, 346 bp, Zea mays
  Clone ID: LIB3062-040-Q1-K1-G4
ctctctctctccttcctgccttctgcctgctggcttcccatgtccgcggcgcccctactgggctgggagctgcttctccagcgaaaaggttgctgcgccttgacgcaccaccgatccaccgtcgcccaacccgagcgttctgtccggcagctaggtagcgagctgctcggtggctgcgaccggaagcacggaggcgcacaggacaccaaacgccagtcgattgccttgcttgcctgtgtgctccgcccggcacgagttggtcggtcgtgccatgcatggatgacaaggaacttatcttacagtctgacctgcactcattctaccatcagcatcagcagcaccaccg

SEQ ID NO: 39059 - DNA, 463 bp, Zea mays
  Clone ID: LIB3062-040-Q1-K1-G5
gtggagtgtcgcttagcagcgattgttcttgccatcaaacttgggatggataggaaaaaggctatctcctccgttacaaccctctccgatgttgaggggctatgtgtttcttttgctgggagagaaggttcatctgatcctgcagtagctgtgaagaaacttctgcatgaggacccatatacagctggagaaatagagaaaattacaggagaaggcctgacatctgtcttccagggctctcagacgtcattggaagttataaaagcggcaaagcactacaagctatttcagcgtgcgacccatgtctactctgaagcaaggagagtttatgctttcagggatactgtctcttcaaaactcagtgaggaaggcaagcttaagaaacttggtgatcttatgaacgagagccattacagctgcagcgtgctatacgaatgcagttgccctgagctggaagagcttg

SEQ ID NO: 39060 - DNA, 303 bp, Zea mays
  Clone ID: LIB3062-040-Q1-K1-G8
ccgtgttttcactttttgctcccccacgttgaaccttgatcctcgtgctccctttgttgaggctttctccgtaggatctcttgctaggagtagcctgccccgtgtgcgcgctcgcacggacatgcttgtttccgcgtcttgaaaggcgagaaaaagtggagatgggcgcttgcgcttcggtacacaaggacccggggcaccccaagaagcagtttcttgactctcccaccaaggcgaaagccgccaacgggaaaggtggcgggggcggccgtgttgctccggttggtgatggcttcggtgatc

SEQ ID NO: 39061 - DNA, 353 bp, Zea mays
  Clone ID: LIB3062-040-Q1-K1-H2
acgctcaggtcaaactatcagcacgtgctatgttttcttaccccttgattcacggcgtcaatatgttggcgatctctgcgagggatgcaaccatgttagatgaatgcaaacaagagatctagctaatgcctgcacggatcaacaatgtaaaacgcaagctctactacagattgtctctcaagctcaagaacacaaagaactggtctaccattctaagccatatcttcactttctcatacacgcgaatgaacaaaacgcatagtgacaacatgacggataaatggcttatttacatgaccaatgatggactgaaattgtagctcgactgttactgtctaaatgtgattatctag

SEQ ID NO: 39062 - DNA, 477 bp, Zea mays
  Clone ID: LIB3062-040-Q1-K1-H4
tctcccggtagctctactgaacattaccgctcatcatcagggtacacagagagaatagagagagacctacagagatggcctccggcggctccagcaagcagctgaaggctagtcttctcatggtggtagcagctctgctcctcctcatctgcacctgcactaccagggggcaagcggcaaggccggatccaggatccgagggccacacgccacagcagctgcgcgctgctgtatccgtctccgttgctgctggtaatgagaaggagagtggctcatcagtggccgtggtggaaatgcgtcggcagcaagagccggaggcggtgagtgaatgtgaagacgacgactgagacgacgaacaagcggagtgcctgatgaggaggacgttgctcgctcacaccgactacatctaacacccagggaagcacaactagctagtcactgctcactagcctgtgctgctggctcatgctcatgtca

SEQ ID NO: 39063 - DNA, 423 bp, Zea mays
  Clone ID: LIB3062-040-Q1-K1-H5
gtcacacacacacacacagacaagtggttttcaaagccaagtgcgtgtactagcaagcggcgggctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggacaaggagcacaagcacaagcagcacctcggcgaggccggcgccatcgccgacggcgccttcgcactctacgagaagcacgaggcgaagaaggaccccgagcacgcgcacaggcacaagatcacggatgaggtcgctggcgcggcggacgtcggcgccggcggctacgtaatccacgagcaccacgaggagaagga

SEQ ID NO: 39064 - DNA, 482 bp, Zea mays
  unsure at all n locations
  Clone ID: LIB3062-040-Q1-K1-H6
gtcttgaattcccgggcatggaacgatatgctcctactgcaaaagatcttgcttctcgtgatgttgtttcaagatcaatgacaatggggattagagaaggacgtggtgtagggccattgaaggatcacatttatttgcatctgaaccatctgccacctgaggttctcaaggaaaggcttcctggtatttctgaaactgctgctatttttgctggtgttgatgtcaccaaggagcccattccagttttgcctactgtgcactacaatatgggcggtattccaacaaactaccatggngaggtagtggatatcaagggtgataatccatatgctgttgttcctggtctaatggctgctggtgaagcagcctgtgcatctgttcatggtgcgaatatgctaggcgcaaattcgcttcttgacataattgtttttggcaaagcttgtgcaaacagggtagcatatatttctaaaccaggtgagaag

SEQ ID NO: 39065 - DNA, 371 bp, Zea mays
  Clone ID: LIB3062-040-Q1-K1-F3
gtgcccgaggagcccgagctcgcagcgttgctccgcgtcaacgcggacacgggcaaggccggtgaggtttacaggctcctgcacaggacgcgcgtcctcgtcaggcaggtctgcgacaccactgcccaggtcgtcgaggcctggttccggtcggacgcagcgtcccaggcgggggtggacagctgggatcccaccaaggtaaaggagggcgtcgtcaatggcggcggcggctggcatggccagggatggcttggcaagggcgcatggagcgttggctggaccgagatgggcaaggatgggacatgccaacgctgtggggagaggcttgtctgcattgacattgatccaaccgagactgacaactttgcaaa

SEQ ID NO: 39066 - DNA, 210 bp, Zea mays
  Clone ID: LIB3062-046-Q1-K1-C8
ataccattgaagattttacaagaggatgtgtttctcttttttccttagcaaagaaggtgccttttatgttccttctgtgttgtatcgccattccttgggttccccttcccctatatagcttcacgccttcaccttacgttctttgttgtatcgaggagtttacaaatgatgacttctcgctctgcaaatatgtatagagaatcaaaatgt

SEQ ID NO: 39067 - DNA, 335 bp, Zea mays
  Clone ID: LIB3062-046-Q1-K1-D1
ggcgagaagaagcaccaccacctcttcggctgaccgtagtaccggccggcgcgcgaccgagctagctagctcgggcgcgacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctcc

SEQ ID NO: 39068 - DNA, 292 bp, Zea mays
  Clone ID: LIB3062-046-Q1-K1-D10
gtcatctcaagagaagttgacaaggtttgtgcgagaagcagttgcagatagtagcctgccagatggagttgcaaaggtcgagtgatgacctgtctacgatgagctgtcttattacccactaatttctacactgatcagaacctcaagttttctaacagtcaactttcttagctgcggaacgagtaatacaacagagtagcatacatatgaagagctagtggtttatttgattctcttgtgcatgctcttaaaccaactttgcttatatggtggaagtgcataatttcatttc

SEQ ID NO: 39069 - DNA, 428 bp, Zea mays
  Clone ID: LIB3062-046-Q1-K1-D11
cagaaatgcacattacccctccgtctgaacatgggaatttctctagcttcattagcagtttgtcaactaaggatgatcatagcactgcgtcaccatctggaaatatcattgttgacattcagaacaagggagctgagaacattgttccttccactgattcatcacttgcttcagatgttggtgagagctcccgttcagtgctctatccagttgatacgactactgtgaactcagtgtcatccacgtctacagtggctggtaccccagttgaactttctgggtatcaggagggtgctccagtggtatgttcttcatgtttaacagctgatgttcagaacaatgtgacatctgatatgccaggtgcttcggataacgaggtgcttcctccagaacctgctgatgtctttttgcagtctgaaagaatcact

SEQ ID NO: 39070 - DNA, 380 bp, Zea mays
  Clone ID: LIB3062-046-Q1-K1-D12
acggcctgttgtcagagatcctaacccaaaccttttctttgcgcaccaagtcatcactaatgcatgtgctactcaagctattctctcagttctcatgaatcgccctgaaattgacattggcccagaattatctcaattgaaggaattcacaggagcttttacacctgatctgaagggcttggctattagcaacagcgaatctatccggacatctcataacagctttgcaaggccagagccatttatttctgatgagcagagggccgcgactaaagatgatgatgtttaccatttcataagctatttaccttttgaaagtgtcctgtatgagctggatggactgaaagaaaggcctgtgaatcttgggcaatgcgatggtg

SEQ ID NO: 39071 - DNA, 327 bp, Zea mays
  Clone ID: LIB3062-046-Q1-K1-D2
gatttgagaagtaactcaatgaaagaacttagtccacatattgcttctgttatgaacgttctagagcgtcatgctagctatttgatgtctggcaaggagctttctaaactcgttgcttttgtcaaggggactcaatttgatcttgtggaatatctacaacgagaaaggcaagggtctgctcgtctagagaattttgcttctgcactcgaactgattggacaaaagctccaaatggatacactgcaaagtcgacttgatgcagagttccttctagctcatatgtgttcagtcaagtttaaggaatggatcgtggtgctagctacttta

SEQ ID NO: 39072 - DNA, 408 bp, Zea mays
  Clone ID: LIB3062-046-Q1-K1-D3
caagggtttccttctcgaccgtgcggaacgagccagagaacaggtatggcggcggcgcggcgcctcagatccggcctgcccctcctccgcgcccacctcgcatcctccgaatccgcggccgtcgctcaggtttcgaggggcttcgcgtcgcaggccgctaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgcctggttttcagat

SEQ ID NO: 39073 - DNA, 368 bp, Zea mays
  Clone ID: LIB3062-046-Q1-K1-D6
gctggttccagctcaagtagttctctgcaaatatcagaaccagaaccccaacaaatccaagaagaagaggatgactatatggaggatgattgtgatgatgattttgatggctacgacgaagatgattatgacttcgatgaagctgactttaaccagcaccttgctgataaatttgatgatttggatcttcctccaggcgtggaggccaccgtaccttggttgcagaaaactacacccaaggaagatgtcaaagagccacctaaatcaaatactgcagatgagaatgcaaataaatatacgcagttcaagcagtttgatactgttcaaaaatttctctgaccattactacgctaagaattctcatggag

SEQ ID NO: 39074 - DNA, 387 bp, Zea mays
  Clone ID: LIB3062-046-Q1-K1-D7
tcctcacgagcgattgcggcggcggaagtaagaggcgatggggcactccaacgtgtggaactcgcacgccaggaactacgggcccggatcccgcgtctgccgggtctgtgcgaaccctcatggactgatcaggaagtacgggctgatgtgctgcaggcagtgcttccgcagcaacgccaaggacattggcttcatcaagtaccgctgaagtcagctgggcgggctatctgaatgccatctcttggacagtgtagtagaggcgatgccacaattttaattactgtcatttagatgttcccttcagaactctgctatttaagtccgccatgtttgtgatggagaactgaagctttgtttgttatactgattatgagttacctgtgcaaa

SEQ ID NO: 39075 - DNA, 432 bp, Zea mays
  unsure at all n locations
  Clone ID: LIB3062-046-Q1-K1-D8
cctgggaagaaatcccatgctatcgatgctttctcacatgctctgcaagccgtcccgacaatcatagctgacaatgctggtttggatagcgctgatttgatctctcagctacgagctgagcaccacaaagagaactccactgctggaattgatgtcatcacaggcactgttggtgacatgcaaaagttggggattcaagagtcgttcaaggtgaagcaggccattcttctgtctgcaacagaggctgcggagatgatcctcanggtcgatgagatcataacctgtgccccgcgcagaagagaggacaggaagtgatattacacgctgtttctcgatgaagcgggatgctcattaccctagttttgaggggtattatggtttaggggcgctcaagttggtcagatttcgagtgtttttggcccctaagcaact

SEQ ID NO: 39076 - DNA, 426 bp, Zea mays
  Clone ID: LIB3062-046-Q1-K1-D9
gcaaaaagagcgaacacgagcacgaacacaagcgcagagcagccaagcgccagacacgcgccgacgcgaaccaaccaaccagctggtagtaggttcgccgcgctgacgatgatgcctcgccgcgcccttctcttcgccgcggtgctcctcgcggcctccgccgccgcggtctccgggttccacctgggaggggacgagagcggtctcgtgaggggtgtgctcgccgcgctccgcgagcgagccgaggccgaggacgccgctcgcttcgccgtcgcccactacaacaagaaccagggcgccgctttggagtttactagggtgctcaaatccaagcggcaggtggtgaccgggaccctgcatgacctgatactggaggcagctgatgctggaaaaaagagtgtgtacagagcaaaggtttgggtgaag

SEQ ID NO: 39077 - DNA, 372 bp, Zea mays
  Clone ID: LIB3062-046-Q1-K1-E1
cagcaatgacggcgactacgagcacacgtccgcagccgcagccgcagccgcagccggcggcggtggcggaggcgaggggcggcggccgccgcctctgggtcaaggagcgcgaccacgagtggtgggaccggatgagcagccccgcgtgccccgaggacgagttccgccgcgccttccgcatgtcccgggccaccttcgaggccgtgtgcgaggagctgggcgccgccgtcgccaaggaggacaccatgctgcgcgccgccatccccgtccgccagcgcgtggccgtctgcatctggcgcctcgccaccggggagccgctccgcctcgtgtccaagcgcttcggcctcggcatctccacctgccacaagctcg

SEQ ID NO: 39078 - DNA, 254 bp, Zea mays
  Clone ID: LIB3062-046-Q1-K1-E10
gcagaacatgggcgataatcggccgcgttctgttatttcatagcttattcgggacggtcccatgcatgtttctgtattgacgatgcttaagctttgtactgtattgtatcagttatgcaagacgattatgatttagttacacgaaatgcactgttgtgatgctacttggggtgcgccacttttgggcctcgaatatgattgtataagctgatgcattatttattcacgtctatgtcacatttaaatgttttctt

SEQ ID NO: 39079 - DNA, 429 bp, Zea mays
  Clone ID: LIB3062-046-Q1-K1-E11
gtatacttgcaattggcacacttggccatcacgtggactcactttgccctgtggctggcattgaagaagatgatctctttatcatggatgatgagaaagcaattgtggaagagagagatgatgaggaacccaggaatgatcaggtgaaagaagatgttgcattggaaacagagccatgtgaaccagtatggcctattgttgagcctgctaagatgcattcattgtcaatgaaagaagacaactttacatgctttgtagcagaagaaatcctgatacgtgaggtggaagatgggggaggtgctaatatccaggaacgaccacttctgatgttagaaaaggtggagaaagtaagaactacacttgctgatttatttgcagcagaagtattctcatcaagttctccaagggagtatagttgccaggatatca

SEQ ID NO: 39080 - DNA, 426 bp, Zea mays
  unsure at all n locations
  Clone ID: LIB3062-046-Q1-K1-E12
ccccaacaacgtcaagtccagtgtttgtgatatccctccgcgtggcctctgcatgggctccaccttcattggcaactccacgtccatccaggagatgttccgccgtgtgagcgagcagttcactgctatgttcaggaggaaggctttcttgcattggtacactggtgagggcatggatgagatggagttcaccgaagctgagagcaacatgaacgatctggtgtccgagtaccagcagtaccaggatgccactgctgatgaggaggcggaatacgaggacgaggaggccatccaagacgagtaagggtggtttgggccctgccacatttgtaccctnggttcctttcattccggggcttgcctatggtttgcttggtgtatttgctcaagttatgcggtatgtagtagtactttcgtgcgtagcat

SEQ ID NO: 39081 - DNA, 429 bp, Zea mays
  Clone ID: LIB3062-046-Q1-K1-C7
ctggagcccaccgcaactgtcgaaaaaatcaccggctccacccctgcgcgggtccagttctacgaccccttcgtcctcagcggagtcagcatcgaagccgccgagcacggtcgcctcctctgctcctttgtcgtcacccctcgccttgcgagtcccgcggggtacctccgcagcggtgtcacagcgacgctcgccgaccagctaggatcggccgtgtttttctgcagcgggctccctagcagcggggtatccctcgaaatcagcgtctcctttgttgacgcggctgccgtcggggaggaaatagaggtcgagggaaagctgttgcgtgccggcaagtcagtcggtgtcgtctctgtcgatttcaggaagaaaaagacaggaaaactgatggcgcaggcccgtcacaccaagtatcttgtggcatcaagc

SEQ ID NO: 39082 - DNA, 436 bp, Zea mays
  Clone ID: LIB3062-046-Q1-K1-B10
cttccctagggtttagtcgcgccgccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattg

SEQ ID NO: 39083 - DNA, 443 bp, Zea mays
  Clone ID: LIB3062-046-Q1-K1-B11
gttacctacgctttagtcgcaccgacgacgccgccgtatatcagtacatcgctctctcgatctcagccgtggcgggggtggtgcagcccgaggacgcggtgaagctcttcaaccgctggaccttcgacgatgtccaggtgaacgatatctcgctgaacgactacctgcctgtgactgcggcgaagcacgcgacattcctgccgcactccgcggggcgctactccaagaagcggttccgcaaggcgcagtgcgccatcgtcgagcgcctcaccaactcgctcatgatgcacgagcgcaacaaccgcaagaaggtcatggccgtccgcatcatgaatcacaccctgaagatcatccacctgctcactgacgccaatcccattcagatggtcgtggacgccattatcaacagtggaccacgtgaggatgctcacccgtattggttc

SEQ ID NO: 39084 - DNA, 359 bp, Zea mays
  unsure at all n locations
  Clone ID: LIB3062-046-Q1-K1-B2
gcccaagcccaagcccaagcccaggccatggttgctcaccaacccgctcaaggcatggcgccgtcgcaatgtttgcccatgtgccatccgtccacgatggagatgcagcaagctcaagctggacacgtgacggcaccaccacctgtgccactcggcccttcattgatgatgcagcagcagcagcagcaaccttcacaagctgatacagtgataatggcacaaccgnctctgccactcgacccttcattgatgcagcagcagcagcagccttcacaagctgatacagtgataatggcacaaccgcctctgcctcttggctctgcgatgcttcagcaacagccttcacaggggggcacgat

SEQ ID NO: 39085 - DNA, 406 bp, Zea mays
  unsure at all n locations
  Clone ID: LIB3062-046-Q1-K1-B4
gcggattacaatgctaagctttcagactttggtctcgcaagaacaggtcctagtggagaccgaacccatgtgtcaactcgggtcatgggaacttatggatacgcagctccagaatatgtcatgactggccatctgacggcacgaagtgatgtttatggcttcggagtggtgcttctagagatgattatcggaagaagggctgtggacaagagccggccaagccgtgagcataacctagttgactgggcacggcccctcctcgtccataacaggaagctgttccgaataatcgatccgagaatggaagggcaatactccaccaaggctgccactgangtggcaagccttgcataccgctgcctgagccaganaccccaaggacgaccaaccatgagccaagtcgtcg

SEQ ID NO: 39086 - DNA, 394 bp, Zea mays
  Clone ID: LIB3062-046-Q1-K1-B5
cggacgcgtgggcggacgcgtgggtcaagatccaatctttgctgctgccacggggcgatccgatcgttctcgatcaaggtcggtggccatggctcgctgccgccatcacctcctcctccttcccgtcttacttgccttggctgctgctgctgcgcggcaggcgcagagtcatggggaagcctccgccgtcttcatcgatgcctcgtcgcaccgctaccttcgggaccagcaagccgaccaccaggacgcttcaatgtcgataaatgaagtttctgcggttcgttctgtcttgcttggctttgcaccgtcaacatccctaccagctatctcttcttcgaagttgaacaaagttcttcttccctatcccattgatagaccgcgtgctggtttcctc

SEQ ID NO: 39087 - DNA, 401 bp, Zea mays
  Clone ID: LIB3062-046-Q1-K1-B6
gtacagacctgatggaaagaagaaggcttacgtgaagcttacgcctgactatgatgctcttgatgtggccaagagaatcggcatcatctaaagttactgcgtcaggcatctgctgtgctctatttccatgtgaaaccagagtttttgtagctatggctcagtggctccatgaccatgtcttatgcacacttacgaatttgatatcatccaagtcacaggttgtgctcatcaatacttggataccatcacttattcgtattgggttggtctttggctctcacatttcttcgtattgggttggtctttggaaattgggcctgatagctgtttggagtatagtgtatggatctgcgttcataatgcgagcagcagcgcatggaaattggttacggcaattgtgc

SEQ ID NO: 39088 - DNA, 71 bp, Zea mays
  Clone ID: LIB3062-046-Q1-K1-C10
aaaacctcatgcgatacgtcagcgcctttgaatcagagatcaactgaacaacctgtggaatgtttcctttt

SEQ ID NO: 39089 - DNA, 426 bp, Zea mays
  unsure at all n locations
  Clone ID: LIB3062-046-Q1-K1-C11
agctagctagcatacagacgaataatctcttcttcacctcactaacaccagctagcagctctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcg

SEQ ID NO: 39090 - DNA, 409 bp, Zea mays
  Clone ID: LIB3062-046-Q1-K1-C2
aggaccttcggcgcccgttcaggatccacatcttcccgagcgagttcttggttgaccgcttgctcttcggaccacctcgaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaaagacgtctc

SEQ ID NO: 39091 - DNA, 390 bp, Zea mays
  unsure at all n locations
  Clone ID: LIB3062-046-Q1-K1-C3
gatgacggtgctccactctccggttggagttaggagcatcgtgacctccttggtgggtttcgtcatcctagccagctccatcgtgttcctcctcgacagaggccaggaagagcaagtgcaagtggcagtcgagcatggacgccaagaagtgcaggtgaagctggaatccgggctgcaagaaccggcgataagagggacaacccaagagggggacgccagcaacgaggagtgcaactggtccaggggaaagtgggtctacgacaacgtgtcccgcccattgtacagcgggctcaagtgctccttcatcttccccgaggtggcctgtgacaagtatggcangaaagatgccatgtaccagcactggagatggcagcctcatggtcatggatg

SEQ ID NO: 39092 - DNA, 378 bp, Zea mays
  Clone ID: LIB3062-046-Q1-K1-C4
atggtgcattgtgctaaatgcaatatcgaatggaacaaaaacgatggcattttcttggttgaagtgaacaggcgtttgaggcctggcggatatgttgtatggacatcgaatttgaatacacatagggccttgcgagacaaagaaaaccaaaagaaatggacagccattcgtgactacgctgagggcctttgttgggagatgctgtcacaacaagatgagacaattgtatggaaaaagacgaataaaagggaatgttacaaatcaagaaaatttgggcctgagctatgtggccatgatccagaatcaccatactaccaaccactaaacccctgcatatcgggcacaagaagtcagcggtggatccccattgaacaccgt

SEQ ID NO: 39093 - DNA, 301 bp, Zea mays
  Clone ID: LIB3062-046-Q1-K1-C5
gcttgaatacatctcgttctggttttagcgaagacatccacatacctggtgttgcaaaaatagacatctgggaagcatctcatctccacctaatccctgaaaatcatgtccaacaaattgtcactcatcaaagccagatttccatacctttttactgctatcgaaaccccacaatacagcacacaccaaacaagacattccgcacaatgtatctaaacttatcaaaagatactagggataccacaacacttaacccacctacctcaaattactcaaatgatccatacaattacacgacata

SEQ ID NO: 39094 - DNA, 430 bp, Zea mays
  Clone ID: LIB3062-046-Q1-K1-C6
ggccatggagtgttcccaaacatctactcttctctgaagaaaagcaaccaggggcctgctgtacttatcacctgggtggctctgtctactgttctgttcgctgctgctgcaatcatgggatacattatgttcggtgaatctacagagtcccaattcacactgaacttacccccaaatcttgcggcttccaagattgccgtctggactacggtgactaatccaataaccaaatatgcactgaccatgactcctctagcccttatttttgtacgaactgctacctccaaatatacagacatacccgaacataatgatacttagatcctctctggtgctatctatccttattattactctgaccgttccattttttggacttttcatgtcaactgtcaagtcttttctcaccatgttcgatgcctatattcta

SEQ ID NO: 39095 - DNA, 313 bp, Zea mays
  unsure at all n locations
  Clone ID: LIB3062-046-Q1-K1-B1
caagccgcacgagaaggcaggcaggcaggcagagaggaaggaagaggaggaagagggggagaggcgcgtggaggagcgggatgcggcgggcgaggctgccgccggtcccggtcccgacggcgccgggggacgcggggccggaggtgaagtaccgcggggtgaggcggcggccgtcggggcggtacgcggccgagatccgggacccggctaggaagaccccgatctggctgggcaccttcgactcggccgaggccgcggcccgcgcctactacgccgcagccaggaccatccgcggcgccgncgcgcggaccaa

SEQ ID NO: 39096 - DNA, 456 bp, Zea mays
  Clone ID: LIB3062-045-Q1-K1-H2
gatcaaacaaaggagcttgcttacaagttgaggtcatacatggagttgtccattttaatccgagggatttcctcgcaacatcatggcagtggtagcccataacagggtcaatttgggttagcttcttggaaatgctctgaagaatcatttgcacatcaagtgaagatcagagatcctctcaagattggttttcctaatttatgggcgttgcgacttgcacgccagctacttgtgtggcatcctgaggatcggctaagtgtcgatgaagcactaaatcatccttacttccaggagccaatgtaatgtaaggagaggagattagtgataactaaccgacgaatcttcagctcagtcctttcaagttcaagccgcatgcatttggttagaggaattcatgaatcgtttgtaattaccatcctagctgtgtcataagatgttgtgaatattacatgaagt

SEQ ID NO: 39097 - DNA, 451 bp, Zea mays
  Clone ID: LIB3062-045-Q1-K1-H3
atcaagtaggtgatggaaaagagcaacttcaagttgctatcagatgaagagtttgatattgcgcaggctggaaaatatttgttgaatcttccgatcaaagttgatgaatctaagctagacaagaagttgttgacaaaatattttaaagagcacccacatgacaatctaccagagttttcaaacaagtatatcatctttcgtcggggcattggaattgatcgaacaactgactactttttcattgagaaagtagatgtaatgatatcccgagcttggaggtcattgctcagggttaccaggattgaccggttattttctaagaaacaacatttgaagccaaagaatggtacgaagaagactgatgaaattaatgaagatgaagaagatccagattgtttgttgagagaattcgattagaaaaattgaactaagtttgaaaaatctcatgagt

SEQ ID NO: 39098 - DNA, 484 bp, Zea mays
  unsure at all n locations
  Clone ID: LIB3062-045-Q1-K1-H4
cggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgtggngcagatggtgatcgtg

SEQ ID NO: 39099 - DNA, 257 bp, Zea mays
  Clone ID: LIB3062-045-Q1-K1-H5
cccacgcgtccgcccacgcgtccgacaaaatgctatcttcccacttgcttttggtgatatggcaatcatcaacctagacttatgcatgcttactacttagactacaaggatgataggctaacatatgttacaaactttatgggccatctcatctcttggcatactatcactctacgcatgatgcgtgcagagtcttttgtgaaccttggtgagcctaatattccggtggcatgagctacagatacacctaagtatca

SEQ ID NO: 39100 - DNA, 500 bp, Zea mays
  unsure at all n locations
  Clone ID: LIB3062-045-Q1-K1-H8
ccaggcgtccgcggggacactaacgaacgaactcttgctccgatcacgagctagctgaggtcgacgatggcggctgtgctgaacagcaggaagacgccgcatgcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacatgatcagctaagttacgacgaccaagcttataagcctaccgaacgtacacgtacgcnccgngcgctgcacgag

SEQ ID NO: 39101 - DNA, 420 bp, Zea mays
  unsure at all n locations
  Clone ID: LIB3062-045-Q1-K1-H9
gggaattacaacagttatggtcaatcacagggtcctaactatggccaacctcaatacccggagcatgcgcctcagcagaactacagccatgggtatggtgatcctagatacaatgctccccctccgaaccagcagtactatggtcagccgccaatgggcccgcagcaaggctatcctcaacagccagatccctatgctaggcctccatacagtggacctggtcaatggcctcccaggggtgctccggctgcagatggctcttaccaggcgccagctgcatcttatggtgccgcttctcagcacccttttgcttatgggcaaacgtacagtgcagcaactggatctgatggatatgctcaacaaggttacccacagcanggtgggcaggcaccagctccatatggtcagagtgcaccagca

SEQ ID NO: 39102 - DNA, 431 bp, Zea mays
  Clone ID: LIB3062-046-Q1-K1-A10
caaccatgagcgacctgttatcctacatttccaaggtcatgtgcatcaaggcaagatcggaggcaacacaagccggcgaggacggcggctgcccagcggacgagtgccgcgtctgcctgtccaagattcggctcggcgaggctacccgccgactgccgtgtcgccatgtgttccaccgggactgcgtcgaccggtggctctcgtcctgcaagcgaacctgtccgctctgccgagtttatgtggccgatgggaacaagcagccggtggccgcgaagcacaccagccgtgaagcacaggcactcgccgacgaccttgttatctggttctccaccgtgcttgttccccgtttctgatgccaaattccttcgtctgttcgttcgtttgaaaaagcttgattggtgtgtattttttttattgcatgcatgatacat

SEQ ID NO: 39103 - DNA, 398 bp, Zea mays
  Clone ID: LIB3062-046-Q1-K1-A11
ccggacacacagcgagggggaggaagaaggaagcaagagggaggaccgagcaggcctaggccctagggtagtcccgtccggtcccctgcggcgcaagtccggccggcgggcgggctgactgcctggcgtcggtagggggcgacggcgatctatatctgtcgatgggctactggtgggaccgcgtcgtgctgccggtgcggcgggcctggctcggcgtcgcgtcccgcttcggggttcgccagaccgggctgtggaggctgcggcaggaggtgagcacgtgcgagtacgaggacgtgcacgtgatgtgggagatgctgagccgcaccacggcgccggcgcctaggcggcccagccggttcgggccgcagccgcggccgtggggcagcaggttccgtctc

SEQ ID NO: 39104 - DNA, 404 bp, Zea mays
  Clone ID: LIB3062-046-Q1-K1-A12
gagcaggcttcgaggtcacatatcggttatagattaccgttgtctataaaagggttaggaagctgtgatttgtacggacagagcttgaaacataatcctaatggacggttcgttgttgtatgtgtagatggtgagtacataatttatactggcctggcctggaggaataagtcattcggatctgcactggaatttggctggtcatcataaggagaatatgcaattagggaaagtacatcatgaatcaagattttcagtatatcatttcaggagaagaaaactatccggacttcattttcagcagagcgtatttttggtggggtattgtagacaatgtgttctagtgatttcatctgcttttatgactgggtagattgtagactgatacacctaatcgatgtgaa

SEQ ID NO: 39105 - DNA, 350 bp, Zea mays
  Clone ID: LIB3062-046-Q1-K1-A2
cggacgcgtgggcggacgcgtgggtgcgggtcgtgctggtcgttcagcgcgtctggagcgctggagggtgcgcactaggtcgcaactggcaagctggaggtgctttcggagcagcagttcgtcgactgtgaccacgagtgtgattcatcggagcctgattcatgtgattcgggttgcaatggtgggctaatgacgacggcattcagttatctccagaaggccggtggccttgagagtgagaaggattacccttacactgggagtgatggcaaatgcaagtttgacaagtccaagattgttgcttcagttcagaacttcagtgttgtgtctgtggacgaggctcaaatttc

SEQ ID NO: 39106 - DNA, 391 bp, Zea mays
  unsure at all n locations
  Clone ID: LIB3062-046-Q1-K1-A4
ccagaacgcaacgcaaacacagagactagagagagagagagagagagagtcccgaagggagcgcaagaggccaccgcacagcggccaggcggcgagcgagacacctccacacgtctctcccccttcccctccccttccgttccctctgtagctgcgcccgaccgaacccccctaccccgtggaatcgtcctccgatgcggcgccgataggggctggcggaggagcggaatggcggggcacggcgagaagcggcgccgtacgggaggggcccacgagaagccggaggaggaggaggaggaccgcatctcggatctcccggacgtcctgcgcctgcacattctgagcctgctgccgctcaaatcggccatccgcaccggcgcgctctnctcgc

SEQ ID NO: 39107 - DNA, 376 bp, Zea mays
  Clone ID: LIB3062-046-Q1-K1-A6
caaccgcgcgcggagcacgcggtgacagaagagagacgacggtcgacggagagctggatggccgcaggagccgggttgtactactaccacccaggcgccgggaaggtgagcctcgaggcggtcgccccgtcctctccgtcgctggccctgaggccatcgcagagcaaggtgctgtgcgtcagcagcagccggtggtggatgaggcgaagatgggaggggaaggcgagcagcgtcagcagcagggcaagggcaagcgcaaggcctgccttgttctcccctgtggccatggactggcaggagtgcaccaccgagcttgaagttgatgttccatgctcggtggcctatcaggggtactcagaactgtagactatttctc

SEQ ID NO: 39108 - DNA, 388 bp, Zea mays
  Clone ID: LIB3062-046-Q1-K1-A7
gtcaagcctttctccgagtctgaagtccgcaactggtgttttcagatattggaggcgcttgcatacatgcaccagaggggctactttcatcgtgacctcaaacctgagaatctgttggttagcaaaggtgtcataaagctagcagactttggtcttgcaagggaagtctcatcattgccaccatatacagaatatgtctcaactcgctggtatcgggcaccagaagtcttgctccagtcatctgcttatgattctgcagttgatatgtgggcaatgggtgccataatggctgagctgttgacactccatcctctctttcctggaaccagtgaagcagatgagattcacaagatatgcaatgtcaatcgtagtccagatgagcaatctt

SEQ ID NO: 39109 - DNA, 396 bp, Zea mays
  Clone ID: LIB3062-046-Q1-K1-A8
ctcatgcctgaagacacatacaagggacatggtttccgcacagaacttatatgcatggttttggatttgaaaccacgattcttgagatttcctggaggttgttttgtagaaggtgactggctaagaaatgcattcagatggagagagtcaattggtcaatgggaagagaggcctggacacttcggggatgtttggcattactggactgatgatgggcttggatattatgagttccttcagcttgcggaggacctgggtgctgccccaatctgggtattcaacaatggaataagccacaatgatgaagttgatactgtagctattgccccttttgtaaaggatgtattggacagtctggaatttgcaagggggagtgcagattcaacatggggctct

SEQ ID NO: 39110 - DNA, 427 bp, Zea mays
  Clone ID: LIB3062-046-Q1-K1-A9
cagaggctgattacatagatgcagcaattgtcactgttttacagatacatggtaccggatcccctggcgatatcctggtgtttctcacaggtcaggaggaaattgaaacagttgatgaaatccttaaacacagaacaaggggcttaggcaccaaaatctcagaattaattatatgtcctatttatgcaaatctgcctaccgagcttcaagctaagatatttgagccaacccctgagggtgcccgtaaggtggttctggccactaatatagcagagacttcattaaccattgatggtataaaatatgttattgatcctggcttttgtaagatcaaatcatacaatccccgcacaggaatggaatctctacttattaatcccatctcaaaagcttcggcaaaccagagggctggaagatctggacgcac

SEQ ID NO: 39111 - DNA, 382 bp, Zea mays
  Clone ID: LIB3062-045-Q1-K1-H12
aaacctgacatgcttggattgattgaataggcaactccctgactcgctgcagcatactccgtctctcctgctgggagaatcccagtgatgtgctcgacagcgccaagctatgcgactgctccaacgccaataactgcaggagcaccttcagccagagtctgttctgctatcaacactctcaactacaacatgacacttatcactcacgcgacaagcattgctcatgctatagatcttgctccaataatcgcgtccctaaacttgacaacaattaattactatcgtctagaaataccctcaacattcctgagcacacttgttcagtcaataacatagcatcagacagtcatatactctaaaaatgattctctctacgctgaat

SEQ ID NO: 39112 - DNA, 309 bp, Zea mays
  Clone ID: LIB3062-058-Q1-K1-C1
acgccactctccaactccaacatatgggtcgtccacaccgatctaccaccctccggctaggcatttgtttgataagaagcccttgctagatcacttccataaggaccatgactatcaccacttcttagaccacttccacaagaaacccgtgccacaaaagccaaagccagaacccaagccagaacccaagccacagcctaagcccgagtaccacccttcgacacccacatatgtttctccaactcccatctatcacccgtccgctgagacagaaatgaagtatgacaagaagcacttctttgatcactt

SEQ ID NO: 39113 - DNA, 410 bp, Zea mays
  unsure at all n locations
  Clone ID: LIB3062-058-Q1-K1-C10
gaagggcaggagatcatggacctggccgacctgtccacgcccctcccggagtggttcaccgaggaggacctggacgcctacgccaagctctacgagaagtccggcttcgggtacccgctcaagatgccgtacagatctatgcacaagctcccgaaccggctggacgccaagttccaggtgccggtgttcatggtgatgggggagaaggactacgcgttcaagttcccggngttcgagaccgccatgcgcggcggcgtcatggacaacttcatgccggacctcaagatcacctacatccctgaggggagccacttcgtgcaggagcagctcccagagcaggtcaacgacctgctcctcggcttcctcagggaccatccctccgccgcataagcagtgggtgagaccgtcag

SEQ ID NO: 39114 - DNA, 403 bp, Zea mays
  Clone ID: LIB3062-058-Q1-K1-C11
ggaagggtgacttcatatacaatgtcaatacagggaagaaaatcaaagttcctcgcttggtaaggatgcactctaatgagatggaggatattcaagaagcatatgctggccaaattgttgctgtttttggtgttgattgtgcatcaggcgatacatttactgatggaacagtgaaatatactatgacttcaatgaatgtccctgaacctgtgatgtccttggcagcttcacctatatctaaagactctggaggacagttttcaaaagctctgaatcgcttccaaaaggaggatcctactttccgtgtgggtttggatgctgagagtggccagactattatttccgggatgggtgagctgcatctggatatatacgttgaacgtattaagagagagttcaaggt

SEQ ID NO: 39115 - DNA, 410 bp, Zea mays
  Clone ID: LIB3062-058-Q1-K1-C12
cccacaccgcgggcgaccctgtgatgcacgactaccggagggcccggtaccttgccttcttctacagcaactccacctccttcgtggcgtccgtggtggtcgtcgtgcttctgctgccagagtcgctgcacaagaagtggtggtggctcggggtcatgaacgcgacgatcgtgctggacctgctgggcctcttgatcgcctatgccgccgggtccagcaggacgtggaagacttctgtggttgtttccgctctcgttctcgctgtgctcgcctatttcgtcatacatgtgctgctgtcaagctgcgtcaggagagggaagaagacagcccccgactctcggccccatgaccaggagaacagagaggaaaacgaagcggcaacgaaagaggtcgagctccagggtccagct

SEQ ID NO: 39116 - DNA, 245 bp, Zea mays
  Clone ID: LIB3062-058-Q1-K1-C2
cgactgtctacaccaatggccatagtcctgcggagtcctcgctcgcccgcctggctggggtagccactctccctgcgagccgcaccagcacatacagccgtggggctgactgcgaccaatgtgaccatcatgggacgtacggccggcgtcaggcccaagctgggcaagcaaggcacctacaacgtgaagctgatcacgccagagggagagctacagctgcaactgcccgacgacatggacatact

SEQ ID NO: 39117 - DNA, 305 bp, Zea mays
  unsure at all n locations
  Clone ID: LIB3062-058-Q1-K1-C3
ctgtgtacgaagccgactagcagccgactctaaagcttggtccggtgagcttcagagaaggggcgggtacgtcaagatgcagatcttcgtgaagaccctgacgggaaagaccatcaccctcgaggtcgagagcagcgatacaatcgacaatgtcaaggccaagatccaggacaaggaaggtatcccgccggaccagcagcgactaatctttgcggngaagcagctcgaagacggccgcaccttggccgactacaacatccagaaggagtccacccttcaccttgttcttcgccttcgcggtggca

SEQ ID NO: 39118 - DNA, 330 bp, Zea mays
  unsure at all n locations
  Clone ID: LIB3062-058-Q1-K1-C4
cttccgcgaaaggcggacgaggctccaagcagagcggcggcggagtggagggtgagtcgagcaatgccacagaaaggcgaagagatgaagcaactgagaatgccctcgccgtgaaagggaatacccctgggaacaatggcgatgacaccggggcagcttagcgcacgccaaaataggcagaacaggatcatgcaaaccctagctctgatcccttcatcaagatctccgtttggcaagaatgaagaggttgcagccagccgtcaaaaactctaattcacttatgagcgccctaagaaacagtccgtgagcccncctagcgttttgcagtcc

SEQ ID NO: 39119 - DNA, 410 bp, Zea mays
  Clone ID: LIB3062-058-Q1-K1-C6
tcggtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaggcactttggcaaggctcctggagtgccgcacagtcacaccaagccgtatgtgcgctccaagggaaggaagttcgagaaggctcgtggcaggaggaacagccgtggattcaaggtttaaaacaaa

SEQ ID NO: 39120 - DNA, 219 bp, Zea mays
  Clone ID: LIB3062-058-Q1-K1-C8
tttgacttgcttgaaacaacttttatagtttaaatactgtaaatgaatactactattgtttggatttataaaaggacttttagttgaagttacaagggtaggcctgttgcattggtgggagctgcattatgtttctgatttggtcgcggctgcactgctgtgtatgggcacttgcagggccaaggctttcattggttgacgccagtgcctcacatttta

SEQ ID NO: 39121 - DNA, 187 bp, Zea mays
  Clone ID: LIB3062-058-Q1-K1-C9
cttactctagtccttttctagcactttacggacattgaatatcaatgggaagggtcaatcataagcgtaaagtaactcagatataaacgaatctgttactcataacaatcacggtcccaagagtgttccctatgcaatcgtcaacagacacacttccttaacatgaatgggtaaccttaattccata

SEQ ID NO: 39122 - DNA, 343 bp, Zea mays
  Clone ID: LIB3062-058-Q1-K1-D1
accgcttccacatggccgagcccatacacgcgcgtctcctcccgctcgccttgcacccgaacccaaggcccaatctccacgcgagcggcacacgacgggtgccctggcccccgcgccaccgccgccgctgcttcgcgacgccgccgtcgcggaacgggagctcctcctcgccggagatcgactggtgcccggtgccgccggaccagcttcccgtgaacgagtacgaagcgcttgcgggctacctgcccttctcctgggccgcggggggcctccgcgtctactgcgtccgtctcgtgctcacgggcgccggcgtcgagctctttgtcgggctcccggtcgccga

SEQ ID NO: 39123 - DNA, 386 bp, Zea mays
  Clone ID: LIB3062-058-Q1-K1-D10
gcttcccttctcggcacttatttcaagtggtgttacacaaaggccagtgtcagtgaccgcttccttggagcacaaaaccagcgatgctagaaggaagttcctaaaacttgcgcttgggaatatcggagttggactgcccaccttgttgggtgttaagaaagctctcgctgatgagcaaggaatctcgtcctcgaggatgtcttattcaaggttccttgagtatcttgacaagggtagagtgaagaaggttgatttatttgagaatgggacaattgctatcgtggaggccatttctcctgagcttggcaaccgcgtgcagagagtccgtgtgcagcttcctggtctaagccaggagcttcttcagaagttgagggaaaagaacatcg

SEQ ID NO: 39124 - DNA, 408 bp, Zea mays
  Clone ID: LIB3062-058-Q1-K1-D11
ctggacacaggaggaaagagagatgctaagacataaggtaccgttgactggtctgaagacaccatttcgcgatggatatgttagagatttagccgaggaagttctaaaactggccaagaatggattggaaagaagaggatacaaggaggtcggtttccttagagaggttgacgaagtggtgaggacaggagtgacacctgccgagagacttctgcatctgtacgagacgaagtggcaacgcaacgtcgaccatgttttcgagcacttgctatactgacgttgtagatgtaccctagtacaaaaatctcatctttgattcattcaacgccttgagtgggagggcacaggaacacatcttttggttaagttgctgaccgggggaacagctacccggtgctgcgtgcggtg

SEQ ID NO: 39125 - DNA, 410 bp, Zea mays
  Clone ID: LIB3062-058-Q1-K1-D12
gttctgctgttggtcgaattccatccatttcttccgttgcatcggcccctcccttccttctctagttcccttcccttatagtattaactacgacgatggtggtggatgctggtgttggtgttggcggcggcggcggcgccgggacatgtgccgtcggaggattcgcagtctgggacgtgctgctgtggcgccggggccgcgccgacgtgagcgcctgcctgctggcgggcaccgtctcctcctggctgctcttgtacggcggctacaccttggtgtccctcgcctccaacgtgctgctcctgctcctcaccgtgctcttcctgtgggccaaagcggcgcgcctcctgaacaggccgcagcctcccgtcccggagctgcgcgttccgcagcaggccgtggacgaggcggcc

SEQ ID NO: 39126 - DNA, 392 bp, Zea mays
  unsure at all n locations
  Clone ID: LIB3062-058-Q1-K1-D2
cggacgcgtgggttcttttctagcactttgcggtacattgaatttcagaagcagaaaggtgggagcataggcgaaaaatatgaacagattaagacgagttcatgagtcagaactagcgcggcgccacgactggtttcgattttggtgagaattgggtcgtttggttggcatggttcaatgaaatagaaaccataagttttagctcgctccatgtaaaagatgtttatacgagctgttaattctcaaatctcacggtctgagcgggtctggtcgcccattggcaacactttcaagtttagtcaggtggcaataagctgtgtcctttggggagcacaggtctgtacaggattactngtgttcgtgatcagntctactgctacctgaatttcatc

SEQ ID NO: 39127 - DNA, 173 bp, Zea mays
  Clone ID: LIB3062-058-Q1-K1-D3
aatccctctcgcctcatccccaccagcgcaaagccgtcctatcgtcctgtcgtgagaagcaatggcgggccgtggcaaggcgattggcgctggtgccgcgaagaaggcgacgtcaaggagctccaaggctgggctgcagtttcccgtcggcaggatcgctcggttcctcaagg

SEQ ID NO: 39128 - DNA, 345 bp, Zea mays
  Clone ID: LIB3062-058-Q1-K1-B9
actcgttcgaatctacttatccccctaattttaatctttatacctgctttgtcttttgaagtgccggggctaattcatcatggatttaatcataccattgcacaaataggtgttacacagtatgtcagcgacctattacttgacctactgctataccatctgtataaccagattgctacaaacaccttgaatcgactggatcctatgacacatgctgtcggtaatgtgttgatacgtgccttcatcatcggttaatcaatcattgcttatggcaacaaaacctgcactcatactgcaattgacacgtatcattgacatatctggtgttgctatgcactcttacat

SEQ ID NO: 39129 - DNA, 351 bp, Zea mays
  Clone ID: LIB3062-058-Q1-K1-D4
ctcgctcgacactgtcactagctagttgctctactagagggcgggtatagagctgcctgcaatccgccgcttagaagggaggatcggaagcgacgatgaggtcgtttgctcctgtctttctgtcggcggtcgtggcctggcttgagcttgcgggcaccgctcaaggcggcaacttctaccaggacacctagatgacctggggccattgccgccgcaaggtaatggaccgccggcgccggcttgacctgacgcttgaccgcacgttcggcttcgggttccagtccaagagcgagtacctgttcggcaagatcgacatgcagatcaagcttgtgccaggcaacttcgtggcac

SEQ ID NO: 39130 - DNA, 242 bp, Zea mays
  Clone ID: LIB3062-058-Q1-K1-D5
acgaatccctctcggcttatccccaccagctcaaagtcgccctatcgtcctgtcgtgagaagcaatggctgtccgtggcaaggcgattggcgctggtgccgccaagaaagcgacctcaaggagctccaaggctgggctgcagtttaccgtctgcaggatcgctcagttgctcaaggacggctagtacgccgagcgcgtgggcgcccgcgcccctgtctacctcgccgctgttctcgagtacc

SEQ ID NO: 39131 - DNA, 334 bp, Zea mays
  Clone ID: LIB3062-057-Q1-K1-H8
gcgtccggtccggattccggtcgacccagctacgggcagggcgacgtgatcgagagcggcgctggctgcggcgagttcgctggcaaggactacacggacccttccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgctgcgtgcggcggcgtgggggtgctgggcatcggctgtgccttcagcggcatgatcttcgggctcgtctact

SEQ ID NO: 39132 - DNA, 404 bp, Zea mays
  Clone ID: LIB3062-057-Q1-K1-H9
ccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaagg

SEQ ID NO: 39133 - DNA, 393 bp, Zea mays
  Clone ID: LIB3062-058-Q1-K1-A10
agttgttataatttatggaatctaagtaactagcaaactaattactaaccagtataggaaaatgttgcttgctatcacattggagccagcaattgtattaacactttgggtaggatatgaatattagactgtcatttgtcagaacatcagtaaggcgtgaagaatcagaagaatattcagtcgaagctggtgatgaattaacatgccatattgccatgctacttgaaacactggtcagcgctcgtgcatgtctcaccaactgcgctgcaggtacctgtgtccatgaccaactacaagaaagacacgaacggatgccagttcatcatcaccaccgtggaaggaagcaggtgctaagtgcacatttccgggcttacatacaagcattggagaaac

SEQ ID NO: 39134 - DNA, 397 bp, Zea mays
  unsure at all n locations
  Clone ID: LIB3062-058-Q1-K1-A11
catgagtggagtcacctgctgcctaaggttccctggtcagctgaactccgacctcaggaagctggcagtgaacctgatccccttcccccgtctccacttcttcatggtcggcttcgcgccgctgacgtcccgtggctcccagcagtaccgggccctcacagtccccgagctcacgcagcagatgtgggatgccaagaacatgatgtgtgccgctgaccctcgccatgggcgttacctcaccgnctcggccatgttccgcgggaagatgagcaccaaggaagttgacgagcagatgatcaacgtccagaacaagaactcgtcctacttcgtggagtggatccgcaacaacgtcaagtccagcgtgtgcgacatcccgcccaggggcctgtccatggcg

SEQ ID NO: 39135 - DNA, 406 bp, Zea mays
  Clone ID: LIB3062-058-Q1-K1-A12
gagccaagcacccaaggggctactaccgctgcacgcacaagagctctcagggatgtgcggcgacgaagcaagtgcagcgcaccgacgaggacccggccttcttcgacgtcgtctacctcggcgaccacacctgcgttcagagccagagggcggcagcgacggcgggtcgtcaggctgccgcggacgcgcaggcgccggtgtacgacgccaacctcatggtgaagaccgaggggccggccttggagccagagcagcagcggcggggctgggacgacgcgcccacgccctttctcttctcctccacgccggcgtgccttgtgcaggagcgcagccccttctccgcgccgtccacgtccgagaactggggcgtgtccccggcgacctcggactccaaccacgtcgtctc

SEQ ID NO: 39136 - DNA, 390 bp, Zea mays
  Clone ID: LIB3062-058-Q1-K1-A3
gaatttcgagcgtcgcgtacgcacgcgctcgatctcaaaggtgacaaccatctgatcaaggctttatcgcggaaggaaagggcgggacgagcgcaaatgttgcaacgctcactctgaggacgtatcagctgttactgctgtaaagttctgtgctgaacatccatatggcaaagccgttaccttgctagacactgaagctcagcttatcatggtgaacgaggattggctcctacttgcatggatctccatatcagtcctgtttatggacggagatggcggtatgaaacttggcggccgtgccatggttcagaaaggtacagtgtgtggatccgacactagcatggtgctagacacacagaccgtctgatcagggagcgtggcaaccaatct

SEQ ID NO: 39137 - DNA, 311 bp, Zea mays
  Clone ID: LIB3062-058-Q1-K1-A5
tttccggctcgacccactcgttcgcttgatcctaaaggtgacgagcttcttatcaagctttatccatgaaggaaagggtagggccaacgcaaatgttgcagcgctcactctgatgacgtatcaactgttactgttgtacagatctgtgctgaacatccatatggcaaagccgatgccttgctagacactgaagctcagcttatcatggtgaacgaagattggctcctacttccatggatctgcatatcactactgtttatggacggcgattgcagactgaaacttactcgccgagccatagttcaaaaagg

SEQ ID NO: 39138 - DNA, 267 bp, Zea mays
  Clone ID: LIB3062-058-Q1-K1-A7
ctcgatctcaaaggtgacaaccatctgatcaagctttatcggggaaggaaactggaatacgagcgcaaatgttgcagcgctcactctgaggacgtatcagctgttactgctgtaaagttctgtgctgaacatccatatggcaaagccgttgccttgctagacactgaagctcagcttatcatggtgaacgaggattggctcctacttccatggatctccatatcagtcctgtttatggacggcgatggcggtatgaaacttgcggcg

SEQ ID NO: 39139 - DNA, 300 bp, Zea mays
  Clone ID: LIB3062-058-Q1-K1-A8
gatgcgttttagcagacagtttacaggttaatgctatactggcgaacctccagccttgtcgggatgactttgcgacttgacgcgtccagatgaataagcaaatgactctaactgaattgtctgctgctatacatgtggattaccgtgcaagggcaagtaacaatccatcctaccgactcgcagctcatgttgctgagaaccgcggtcattcgaaatttcacaagacgaagaggaactgtccatagaagaatttgaacctacctaatttcaaacagactaataataatgaggaccctatct

SEQ ID NO: 39140 - DNA, 381 bp, Zea mays
  Clone ID: LIB3062-058-Q1-K1-A9
gtcggtcatgattgtgaaagctcttggaatagccttgaaactgaccttttctggcatgaatcatctaatttatccacaaacatggttgttcaccattgttgttgttgcatgtattagtaacacagatgaactacctgaacaaggctcttgatactttcaacacagcagttgtatcaccgatatactatacaatgttcacgtcactaacaattttggctagcgtgataatgttcaaggactgggatcgtcaaaatccaactcaaattgtaacagagatgtgtggttttgttaccattctttcggggacgtttcttctccacaagacaaaagacatggttgatggccttccgccaactctacctgtccggattcctaaacatg

SEQ ID NO: 39141 - DNA, 410 bp, Zea mays
  Clone ID: LIB3062-058-Q1-K1-B11
ctctccccctccctggaattgccattccacctccgctcgaattgccattccccctctctctcggcttctcttggatcgaattgttagtttattagagtgaagttgtcgggggagggaggctaggcgttaggtgggcgcctgcgtgctacgcctcgggagaaggtcaaaagaaaccgccccaccaccaacccaggcgactcccccccaacccaacccaacccgccattgctcttctttccctccccgtcgccagctgggcagagccgtcccgtccggagcccaaaggcgccgcctttcctgaacccggtccgcggcagattgatcgattggttgttcggttccttggtcgggaatcagaggaggcagcaagagaagagatgtgcccgctgcgggtgatcctcatcttcctc

SEQ ID NO: 39142 - DNA, 375 bp, Zea mays
  unsure at all n locations
  Clone ID: LIB3062-058-Q1-K1-B2
tggcccacctgccattgttagaggcggtagcccacaggcggacccgaatccagaattcctgaatcctgtcactgctcgaaaatcgaaatcgatccgatctccgcttgcgctgaagcctgatctccaccgggttcgcagcatgggcgcatgacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaaggaaaccaactacctnctcgtcgacaacaagacgacagttaaacaaatcgaggatgcgttca

SEQ ID NO: 39143 - DNA, 392 bp, Zea mays
  Clone ID: LIB3062-058-Q1-K1-B4
ggaccctccacaacaatggccaccgtcctgggcagcccccgcgcgccggccttcttcttttcgtcgtcctccctccgcgccgcgccggcgcctaccgccgtggcgctgcctgcggccaaggtgggcatcatgggccgtagcgccagcagcaggcgcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcgtgcgccggcaaggtcgtctccggctccgtggaccagtccgaccagagctacctcgacgacggccagatcgccgacggctgggt

SEQ ID NO: 39144 - DNA, 352 bp, Zea mays
  Clone ID: LIB3062-058-Q1-K1-B5
cgtgaagctcaacaagcacatctggagcagtggtatccgcagtgtgccgaggcgtgtccgtgtcagaattgcccgcaaccggaacgatgaggaagacgcgaaggaggaactctactccctggtcacagttgctgagatcccaccggagggtctcaaaggtttgggaactaaggttgttgaggatgaggattaagccctgtataccatgagagaaatttgagaatgttacttcagcttattgttatctactgccaatgactcatgtaatagaaggttcgagacttgtctcctttcaagtgcttcgccaagtccaaatatccacatggcatttcattgtcctacgcattttctg

SEQ ID NO: 39145 - DNA, 326 bp, Zea mays
  Clone ID: LIB3062-057-Q1-K1-H6
ggcaaggacgacgtgatcgagagcggtgctgtctgctgcgagttcgctgccaagggctacacggacccttccccggcgccgctgatcgacgcggatgagctggggtcctggtcgctgtaccgtgccgtgatcgccgagttcatcggcacgctgctgttcctgtacataacggtggccaccgtgatcggttccaagcaccagacggacgcgttggcgtcgggtgccgacgcggtttgcggcggcttgggggtgctgggcatcgccggggccttcggcggcatgatcttaggcctggtttactgcaccgccggtatctcggggggcca

SEQ ID NO: 39146 - DNA, 317 bp, Zea mays
  Clone ID: LIB3062-057-Q1-K1-F4
tcgagaagaacccggagaagttcttcgtgcgctccatcaccgaccaattgcaggccgtcgtcggcatctcgctgctggagatcctgtccagccactccttcgacgaggtgtacctcggccagcgcgacacctaggagtggacgtcggacgccaaggcgcaggatgcgttcaagcggttcggcgcgcggctgaccgagatcgagaaacgcgtggaggccatgaacaaggacccgcgcttcatgaaccgatacagcgcggtccagttcccctacaccctgctcttccccaacacctccgacaagggcgataacaccggc

SEQ ID NO: 39147 - DNA, 385 bp, Zea mays
  Clone ID: LIB3062-057-Q1-K1-F5
cgaaggttgtgaacgccgtgaataaggaagggggcagcttaggatacttcgacatcttatctgaccaggaagtggggcggggttagaagacgtactacaactggtccaccttaccacagctatgctccagatgggggctaagagggggatgcgatattgcactcgagatggacaaaagcggacagctgaagtcgaccctgtcagagtagacacctagctagcagtctcgcttcgctggcgcatgtatcacatagtctgcatagaatcagtatactatggcatgcatgccattatattgatagatccacgattgtactagactgaagagccacattggttgaattgtgacacatgtgccgaaggaataactcacgcttgttcacac

SEQ ID NO: 39148 - DNA, 290 bp, Zea mays
  Clone ID: LIB3062-057-Q1-K1-F6
agtgcagatcactgacctcggcatggccaagtgcctgatgaacgacggcgtgaccagctgctcgagctccccggcgcggatgctgggcacgttcggctacttcgcaccggagtacgccatcgtgggcaaggcgtcgctcaagtccgacgtcttcagcttcggcgtcgttgtgctggagctcatcaccggccggcagcccatccacaagtcgtcgtcgacgagggccgacgagagcctcgtactctgggcgacgtcgcggctgcgggacagccggctggtggtcacggagc

SEQ ID NO: 39149 - DNA, 253 bp, Zea mays
  Clone ID: LIB3062-057-Q1-K1-F8
cattgggaaagcttttgccagaacagacctgaatgaagtgcatgaaatattgctgcatgatgggtataatgaagaccacgaggctaatgcttaactatcttttcagtcatggaatggtgatatatctgaaaactttggtggtaaaaagcgtgcaaaccatgcctttaagtctaaagaatacacgactgcaatcgagtgttactcaaaggtccttgactcaggtgcaatggtggcttcaaccatgcttggaccg

SEQ ID NO: 39150 - DNA, 150 bp, Zea mays
  Clone ID: LIB3062-057-Q1-K1-F9
attcccgacctgaacgacccgaacaatccaatcatactctacatatctctactctacctcgtaatcaactcgcctgatctgacgtctctacccaggggggacaatcccttaaaccttctacacaacctatctactcatctaaccaaccat

SEQ ID NO: 39151 - DNA, 347 bp, Zea mays
  Clone ID: LIB3062-057-Q1-K1-G1
atcttatattacccctgcagacaatttcctcaccatttcaatgtacatagccgccagaggagattcacatcgagcaggaaaacagtatctagacgatcattacttacatatatactgaagaccaattaatacacgaattcgcaccctttaaacacgcactacttgtccacattcctgctcattcaccaacacatatgtacgaacaatataccccaattcatatttgcatgtgctagtaaacacctaaacacatacacaatcacaacactcatgctaatatagcaggtgatattattaatgcttcatcttactctgatcatttgacactacatgctcttgaaactact

SEQ ID NO: 39152 - DNA, 391 bp, Zea mays
  Clone ID: LIB3062-057-Q1-K1-G10
gcggcaccgcaccgggtactattttgacctcggtcgctcaaaatctctgtctgtcggccctgcagaccccagacctagaccctccaaaaacaactcaacaacaatgctgctcctcctgctgctgctcgtcgcctactgctccctgtcccaagagggcgtgctcggcgacgtgccgacgtacaacaagctggtcttcatcctggcggggcagtccaacatggccggccgcggcggggtggtggcgaaccgctgggacggcgtggtgcccggcgactgggcgccgttccccgcggtgctgcgtctctcgaccgacctgcgctgggaagaagcgccggagccggttgacgccggcatcgacgccgtcaaccacgccgtcggggtgggccccggg

SEQ ID NO: 39153 - DNA, 206 bp, Zea mays
  Clone ID: LIB3062-057-Q1-K1-G11
ggacaagcgccacctgctatgataccccctcagccaggatttggtttccagcaacaacttgtttcaggcatgagggctgggggtcctgatatgccaaattattttgctccagttgttcaacaccaacagggccaacagggttcacgcccaagtattaagcgtggaacttggacccaaggtcagcaacctgtgccaccatttcagca

SEQ ID NO: 39154 - DNA, 242 bp, Zea mays
  Clone ID: LIB3062-057-Q1-K1-G2
ccgacgcaagccacgcatacgcgcagctattgccagagcacactctgttttaagtgcatgacatatcgctgcaggacgggtataatgaagacgacgaggctaatgctgagctatctctgcaggcatggaatggtgacatatctgatagctttgatgttaacaggcgaacaaacaatgcctttatgtctaacgaatacactgactgcgagacgatgttactcaacgttcctctactcacgtgc

SEQ ID NO: 39155 - DNA, 397 bp, Zea mays
  unsure at all n locations
  Clone ID: LIB3062-057-Q1-K1-G3
gcagaccaggcgtttctccaacttctgttaagttcgagtaatggggacaatagtgaggttctgaagcagtctgctgttgattacttgaatggatctgattatgcatctcaggttcttttgccaagagaacatctagagaaacaatgttcttatgatgctgcacgacctctgcccttctctagtaatttcagagatgccactgtcagaagtgttattcctgacccatatgtttttcaaagcttcggtagttcatcggaggtgtcctcaataataccaaatagagatgacatggttgctactttacttcaacaaacatcacttggactgcctnctcaatggatacgaccgtctccaccaagacttgaaatttttgaaagggagttacagtggctgaaca

SEQ ID NO: 39156 - DNA, 258 bp, Zea mays
  Clone ID: LIB3062-057-Q1-K1-G4
tcggcagcgaagatggagcttgcacgggccaacgcacacacaacacagctcgtggagatggcgcgggggctagggtgctggcgctggacgcgcactgcatcgcgtggcgtccgggcggcggctactgaacgcgaaagacggatgcgctgaccactgggggcctgcgccgagctgcatacgtgcggggcagcccgcgcgccgacgccgactgctgggccgatgcgccagagctgggaagaccccaagtgctgtgcgtgc

SEQ ID NO: 39157 - DNA, 422 bp, Zea mays
  unsure at all n locations
  Clone ID: LIB3062-057-Q1-K1-G6
ctgtctcacgtcttccgcacccgcttctcgctccggattccggattccctctgctctttccctaacgaaggtagccatggcggngagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgctgaggttcttgagctggccggcaatgcggcacgtgacaacaagaagacccgcatcgtaccgagccacatccagctcgccgtccgcaacgacgaagagctctcccgcttgctgagcacggtgaccatcgctagcggtggtgtaatgcccaacatccataacc

SEQ ID NO: 39158 - DNA, 55 bp, Zea mays
  Clone ID: LIB3062-057-Q1-K1-G8
tgtgggtctagatccactgctacccgtgctcactgatgatccgcgaacaggttga

SEQ ID NO: 39159 - DNA, 350 bp, Zea mays
  Clone ID: LIB3062-057-Q1-K1-G9
caacatctcaaatcaagctagttgaggggtcctattttgagaagttctataagcaaacggctgatatggatccagctcagcgtgctgcctttctcgaggaagatgatgagatggaagatgcacattctgttgctgcatctgctggtgacactgatgtgaactttatgagcttgatggacgaaaatcacaacccacattccatggcccttcatcacctgaaaccttgttgcaggatgctgcaaaagtcatcaaagctagaattgcagagaaccctaactctatgaacttcaacgtcatggctctttcaaagaagtgaagtgtactgtgatggattttctttggcagaatac

SEQ ID NO: 39160 - DNA, 399 bp, Zea mays
  Clone ID: LIB3062-057-Q1-K1-H1
gatatgaattaagtgaatcagatgaatctggtacagaagatgaggagacaacagtcaggaaaaatagggatgaatcattgaagtctggtggccaaagatcaagaagaacctcagcacttgaattggatgatgctagtctcacaccttataagttaaagtttaagaggggtaaaattgtagaactcccactagacagcatgggcccaaggaggctgaaatttacaagaaagtctgcacatgaagcttcaaatcgtgaaagccaaccagctagaaggatttatagaaggaacagcaccagtactgctgttcctactgatgtggaatctcctggcgtgaaactgagacatcaagatgcacaagagaagaaagatgcacaaggattgttcaataatggaattg

SEQ ID NO: 39161 - DNA, 338 bp, Zea mays
  Clone ID: LIB3062-057-Q1-K1-H11
atatatcatcactatctagcaatgctgatggctcttattagccttacatgggagataaagggacagcctgattgttctagcaagcagaggggggtgcaacttttcttgcgctgggcaatcatgcaaggcattgcaatgcatctacagaatagataccagcggcaaagattgcgtactcgaatagctctaggaaaggctaaaagaatggatgtcgttgctggcgaaacagctggtgtggaggggcagctcttgctgctatatcctgtccttttcatattacaggtatgttgcgtgtgcaattcgaatcatggcagatccgggtggtttgtcgaactgag

SEQ ID NO: 39162 - DNA, 163 bp, Zea mays
  Clone ID: LIB3062-057-Q1-K1-H12
acgtagccttcttagacaatcgtacttaaccgtcgttcgtgatacgtaccgggtcttgcgtatggaacattcaagcggagggtataccatctgctgtcgtactggccttatctacgaggcatggacaatgatgtacgttgtagacactacaggaatggataac

SEQ ID NO: 39163 - DNA, 431 bp, Zea mays
  Clone ID: LIB3062-057-Q1-K1-H3
gaagccgccgccgctgcagtgtccatagccaccgcaggagactgagatggggggttgtgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtg

SEQ ID NO: 39164 - DNA, 397 bp, Zea mays
  unsure at all n locations
  Clone ID: LIB3062-057-Q1-K1-F3
atcttttcttggacgcttcgatgtttgtactaaacatatatctaaatttgcaggtggtgcggcttcaggtggagcaagaaagttgtatgttggcaatcttcactcaaatattactgaagaccaattaagacaggtatttgaaccatttgggcaagtggagcttgtacagcttcctctagatgcaatgactggactgtgcaaaggttatggctttattcagtttgcccggcttgaagatgcaaaagctgcacagagtttgaatgggcagcttgatattgccggcagagttattaaggtttcagctgttactgatcatgtgggagtgcaagctagtggagctactactggagatctagatgatgatgaangtggaagcttggcgcttaatgcaagcttc

SEQ ID NO: 39165 - DNA, 228 bp, Zea mays
  Clone ID: LIB3062-057-Q1-K1-H4
acggttgaccgcgccgacagtcgccgtatgtccctcgtattcgcaccgcgcgctgttgtccatccttgtgcagcaaaaatgactgctggctacattgctggctcactggtcggatcctttggcattgcatacctgtgtgacacatttatctctgacaagaaagcatttggaggtagcacccccaagactgtttctgagaaggagtggtggcaaggcacagacaccaag

SEQ ID NO: 39166 - DNA, 404 bp, Zea mays
  Clone ID: LIB3062-057-Q1-K1-H5
accataccctaactccaaattcccaattgtcaatctctactcagagttcgagtgaccgtgtacgcgcgcggaaagggcgggaaggcgctaggcaagggcggcgcgaagcgtcaccgtaaggttctccgtgacaacatccagggcattacgaatccggcgatccgtacgctggcgagaaggggcggactgaagcgcatctcggggctcatatacgaggagacccgcagcgtgctcaagatcttcctagagaatgtcattcgcgacgctgtcacctacacggagcacgcccggcgtaagaccgtcaccgccatggacgtcgtctacgcgctcaagcggcagggccgcaccctctacggatttagcggctgaagggtcacgggtgtccgacaactgctgctggtcgt

SEQ ID NO: 39167 - DNA, 382 bp, Zea mays
  Clone ID: LIB3062-047-Q1-K1-G11
cgatgaatgcatcaaggactgtgataaggctgtggagaggggaagagaacttcgtgctgagttcaagatgatctcaagggcactgacaagaaaaggaacagctctagtcaagcttgctaagacctctaaggattttgatattgccatcgagacctaccagaaggctctaactgagcatcggaacccagacactcttaaaaagttgaatgaggctgagagagcgaaaaaagagttggagcaacaagagtactatgatccaaaattagcagatgaggagagagagaaaggcaacgagttcttcaaggagcaaaaatacccagaagcaattaaacactacacggaagctctcaagagaaacccaaaggatcctaaggtttacagc

SEQ ID NO: 39168 - DNA, 299 bp, Zea mays
  unsure at all n locations
  Clone ID: LIB3062-047-Q1-K1-G12
ccagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgncggcctgacccacaccttcgggtccatcggcaagcaagtgtggtacgacagggaggtgacggcgttcgtggagccggggcggatgcacg

SEQ ID NO: 39169 - DNA, 282 bp, Zea mays
  Clone ID: LIB3062-047-Q1-K1-G2
gcaccagagaaaagggcaagccaaaaggcataccgcgcgacacatggcagctgctcaagccgggcaccctgatgcagcggcagatcggggcggcgccctttgctcgtgcgtccgccgtcgcgaactcgctgcaggcgttcggcgtcacccggcccgcaggatcaggctcctgcagactgcagcaggcgtgacccggaagctcgcggttgcgctgcactggcgctctcgttggcgcagcgcgaggacgccaaagctgcctacacagatcaagcaaacgtacat

SEQ ID NO: 39170 - DNA, 389 bp, Zea mays
  Clone ID: LIB3062-047-Q1-K1-G4
gatgaacaatcctgaactcatacgcagtataataatgaacaatcctcaaatgcgcgagctcattgacgcgcaatccggatcttgctcatgtcctcaatgatccaagcattatgcgccagacttttgaagcagttcggaatcctgaactcatgagggagatgatgcggaacacagacagagccatgagcaacatcgagtcttctccagaaggattcaacatgctccgtcgcatgtatgaaactgtccaagagccttttctgaatgcaacaacaatgggtagcgagggtgatcgaaattcgaatccattctctgctcttctaggaaatcaggggtctaaccaagcaagagactcagctgcaaatggaacaactagagcttcagaccccaca

SEQ ID NO: 39171 - DNA, 313 bp, Zea mays
  Clone ID: LIB3062-047-Q1-K1-G5
atcccgcacccctgactgtcagccgcgatccgctcttttttgcgtgcagcggcggagcagtgtagatggcgtcggaggccaaggacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtcccttctgaaaaactataacattgacccaaagtgcattggacgtttggaagt

SEQ ID NO: 39172 - DNA, 414 bp, Zea mays
  unsure at all n locations
  Clone ID: LIB3062-047-Q1-K1-G6
cgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgncaaggtcaccgaccaccacatctacctcgtcgtcaacgccggatg

SEQ ID NO: 39173 - DNA, 400 bp, Zea mays
  Clone ID: LIB3062-047-Q1-K1-G7
cagctagctagcatacagacgaataatctcttcttcacctcactaacaccagctagcaacggtttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacggcccgcttcggcggcggcgtcagcatggccaacgccgccaacatcc

SEQ ID NO: 39174 - DNA, 238 bp, Zea mays
  Clone ID: LIB3062-047-Q1-K1-G8
ctcagctgcgggcgctggcagcggcgaaacaactgaaacagtgaaggaggatgatcataagcttgatggcaagaagaagaagaaaaacaagaagcagggaaaggatgatgatgtcgaagctaggctggaaaaggcagaattagcaatacttaacaagtttgaggcagcagaaaagctcaatggaagagaggtagaaccaaaaagtcagaatgacagtgctgatgactgcagtggtgct

SEQ ID NO: 39175 - DNA, 310 bp, Zea mays
  Clone ID: LIB3062-047-Q1-K1-G9
gcggtgcggtctccttcgaccgatgccttcgtgccctacatcttcggctgtgacgccggcgaggccgagaccgacaatcggatccggcgacaaggcgagagggaagagattgggctcacgttcaccaagctggtcaggctggtgctcgccaagaaggggatgcggatcctgatggtgggactcgacgccgacggagagactaccatcctctacaagctgaagctcggcgagatcgtcaccatcatcttgaccatcggattcaatgttgaaactgtggagtacaagaacattatcttcactgtctgggatg

SEQ ID NO: 39176 - DNA, 367 bp, Zea mays
  Clone ID: LIB3062-047-Q1-K1-H10
atttccgggcacaacacgaaagggagcatgcccttaggtccttcaagagcggagcaactcccatccttgtggcgactgatgttgcggctcgtggtcttgacataccacatgttgcccatgtgattaattttgacctccctaatgatatagatgactatgttcatcggattggaaggactggacgtgctgggaaatctggtcttgcgactgcattcttcaacgagagcaacactacgcttgcaaggccgttgagtgatctcatgaaagaggccaaccaggaggttcctaagtggcttgagggatacgctgcccgatcagcctacggaagtggaggtggtagaaaccgcagacaaggtagcagtgccag

SEQ ID NO: 39177 - DNA, 170 bp, Zea mays
  Clone ID: LIB3062-047-Q1-K1-H11
gcggtggcctctcgatgctcgggcagtaggggcctgcagggcgatcacgttgctgaacagaagtggggtggcagtggctatggaggtggcggtgggtacggaagctaccgcggctgtggacgaagaggtggtggatggtatagcggttacaactattgcctgggggaaat

SEQ ID NO: 39178 - DNA, 389 bp, Zea mays
  Clone ID: LIB3062-047-Q1-K1-H12
cgtccggcgagcacagctgccgcagcgggccagctcacctgagaagacagtacgcacacgcggcatcgtctgcatctccggtggccatccatcctcctcccttctctcgtcgttccctccactcctaggcggaagcggccggcgcagagtggagatcgacccggactttgaaattgcctcttccttttgatgggtaccatgaagaggttggtttcgaccgccctcgccgcgagagggctcctgagatctcacggactgccgaccacaacttctgttatgtaccaaccagcattccagcaatttatgaactattcatcaccacatggtggtgatcccaatgcaaacacgaactcaactacaacacgaatagctgctgatcctgatacaca

SEQ ID NO: 39179 - DNA, 419 bp, Zea mays
  unsure at all n locations
  Clone ID: LIB3062-047-Q1-K1-H2
tttaggttgctccatattgtgcttcaaagtgggcgattgagggcttgacacgctcgttggctaaagagctgcctcctggaagtgcagccattgctcttacccctggngtcgtgaatactgacatgctaacttaatccttggaaagtccaccagcgttatatcaaacaactgaaacatgggcacccaaggcagctacaatgatactaagcctttcactggacgataacggtgcctccttgactgtatgaagtggtgaaattttgtgctcgactgattactgatggggggtctgtatatttttgcgagattatggtgatgtaaaatagtagttataatgtgtgtgcactctgatgtccctagctgctgcctgaacgttattgtttagccttacctctatggcctatgcacatgctcttctt

SEQ ID NO: 39180 - DNA, 397 bp, Zea mays
  Clone ID: LIB3062-047-Q1-K1-H3
ggatcatcacagtccgggaatgtgctcggtcacagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatgcactcctgaatgtatatgttagagaagtgtcgattgctgattggttaccctgattcaggtaacggttatatctaaaaacttgaggaaatctagtgtactctagttgtcatg

SEQ ID NO: 39181 - DNA, 297 bp, Zea mays
  Clone ID: LIB3062-047-Q1-K1-H5
ccagtttcaagcatgaaaaatcgtcagtcagctctcaataacttgtcacttgtgtgcataagtatgggcgcaactgatttgtggtcatcagggttggacagttttaaattaccacacaccttgttgaacagtgtatactgtatagcggtttccctctcaagcagccatttcaaaacttgaataaggataaggtactcgtcgtaactgtatcgctatctttatctttataagagatacttggatatgcaccaaaatgcatgtacataacataccacatatgacagtaaataatgcatg

SEQ ID NO: 39182 - DNA, 335 bp, Zea mays
  unsure at all n locations
  Clone ID: LIB3062-047-Q1-K1-H6
caccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctnctctatcgacagcatcgtgaacggcagcgacgccgtcatggagccggttggtgctggcagcaacacggtagtagc

SEQ ID NO: 39183 - DNA, 363 bp, Zea mays
  unsure at all n locations
  Clone ID: LIB3062-047-Q1-K1-H8
gtttggagatgccaacactgacagcacgccaaagacggcaaggaagataaccggcaagaaggtcaacgacctcaccggcaacgacatcttcaagggagacgctccgccagcttctgcagagaagcatctgagcaccgcgaagctgaaggagatcactggaagcaacatttttgcagatgggaaggaaccaatccgcgagcgtgtgggcggaaaccgcaagcctactggcggtgagagcagcatcgcgctgatttagcataatccgggactcagtgtcgacccctagaggaggatttccaccagtaccaggcagcaggctggtggatcgtcagtttggngtctggttcctgatcaaggtgcggc

SEQ ID NO: 39184 - DNA, 304 bp, Zea mays
  Clone ID: LIB3062-048-Q1-K1-A12
cgccagccagccatcgtcacactggtgagctctgcagtctgcactctgcttagctgcgagggtcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtc

SEQ ID NO: 39185 - DNA, 471 bp, Zea mays
  Clone ID: LIB3062-047-Q1-K1-G10
aattctcggtcgaggacgcgtcacgcgtacgcagacgcgtgggtgaaaaacgacctctttttgatgtcaagacatgccaaattgcgggcagacgtccaaagcaaacagatcactgtacctggttatattcctttgaggaacaccctttgaccagtgaagtgggaatatcttctccagctttatatgatggattggttgagatcaaacaaccaaatgacattcctgcaattaatggtgccacaacctgcagtggtagttcagtgatcccttgcggtaatcatgatcaatcaattttagtggcaagcttagacatacctgattgggcgacttccttgcctggatattttgaagactgtgggccagttgttacatatagccatgttgatgacattggttcgcctagaaagggtgtgccaattggacctgagcaccatgctgacattccagaattgaggcccctaaactctatga

SEQ ID NO: 39186 - DNA, 354 bp, Zea mays
  Clone ID: LIB3062-047-Q1-K1-E3
caccttccgcgaggtcgtcgtgccggcgcaggctaccttcggtgagttgaagaggatccttgttcagactactggcttggagcctgagaggcagaggctcttcttccgtgggaaggagaagagtgacagagagttcctccacgcggcaggtgttaaggatggcgcgaagttgcttctgcttgagaagcctgcccctgccaacatagagcagaaggttgagcctgtgattatggatgagagcgtgatgaaggcatgtgaggctgttgctcgtgttagagctgaaggttgataggctgtctgctaaggtgtgtgacttggagaagaatgtgcttgcagggagaaaagttgatgata

SEQ ID NO: 39187 - DNA, 383 bp, Zea mays
  Clone ID: LIB3062-047-Q1-K1-E4
caagaatttggctgaagaagttacaaagctatctgtgctaaatgcacagcatgctaatgagtgattagttgctcaagagatggcacattcaagggttcatggtacaaagggtcgtacagctagtaggggtagggatgaggttgggacatggagcctcgatttggaggacatgaaaatggagctacaggccacaagacagagggaggctgctttggaagctgctttggcagataacgagctcctcgaagaagagtacgagaaacagtttgacgaggcggctaaataggaactatctctggagaatgatctagcatgcatgtgggttcttgttgctaagctgaatagaggagctttaggcatatctgatttgaatgttgacgacc

SEQ ID NO: 39188 - DNA, 301 bp, Zea mays
  unsure at all n locations
  Clone ID: LIB3062-047-Q1-K1-E5
ctgatggtggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccggcaccggcaggctctcgcagttcgcgagcttcagtgtgaatgacnatcgtgacaag

SEQ ID NO: 39189 - DNA, 458 bp, Zea mays
  Clone ID: LIB3062-047-Q1-K1-E6
cccacgcgtccggcctcctcgtctcctcggtctcccctccctgtcttccagagacgcagagcagggcgctcttcggtcggaggagaagcgcgaccacgaccatgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctatggtgtatgacttctacaaccatgaaatggagtcaacactgtttgtcgatcttttt

SEQ ID NO: 39190 - DNA, 462 bp, Zea mays
  unsure at all n locations
  Clone ID: LIB3062-047-Q1-K1-E8
caaaagcagaggggaaagtgccgtcggctctgactcttgggcacttggctgacgacccgtgctctctctgcaactgcaactgcaacgcaccaagaaactgccggcgatcgatcggggaaggagataaacatggtgcacgggaagctggaggtcctcctcgtctccgccaagggactcgaggacaccgatttcctcaataacatggaccccttcgtgatccttacctgccgcacccaagagcagaaaagcagcgtcgcaaatggagcangaagcgagcccgagtggaacgagaccttcgtcttcaccgtctccgacgacaccccgcagctccacctcaagatcatggacagcgacctcaccaacgacgatttcgtcggcgaagcaaccatccccctggaggccgtgtttcaagaaggcagccttcccccgcggttcacccggtcgtcaggaggagaagtactg

SEQ ID NO: 39191 - DNA, 235 bp, Zea mays
  unsure at all n locations
  Clone ID: LIB3062-047-Q1-K1-E9
gngacacagagttgcaatggttggtgatggaataaacgatgccccgtctttagcagccgcggatgttggaatagccatgcgaactcattcaaaagagaacgctgcctctgatgcagcttcagttgttctactaggcaacagactttctcaggtggtagatgcgctatccctgtcgaaggcaacgatggcaaaagttcaccaaaatttggcctgggcagtggcatataacatagta

SEQ ID NO: 39192 - DNA, 345 bp, Zea mays
  Clone ID: LIB3062-047-Q1-K1-F1
cgacggcggcggtggcagccgtgtcgtcagctgagtctagctacgtcgagccacgccggtgccagccgccggcgccggacatcgcggtggccgtgttcccctacgacgtcgacccgatgcagttcgcgctgaacctggagtacaccgaggccgagttcttcctgcacggcgcgtacggcgtggggctcgaccacgtcgcgccgagtctggcgctgggcggcccgcctccggtgggcgcccggaaggccagcctcgacgaggtgacgaggcgcatcgtcgcggagtttggcctgcaggaagttggccacatcagggctatccagcgcacggtcggtgggattcctc

SEQ ID NO: 39193 - DNA, 365 bp, Zea mays
  Clone ID: LIB3062-047-Q1-K1-F10
cggtgagcccctgactgtccagaggccaggaacacagactaggagtttctgctatgttgccgatatggttgatggtcttattaagctgatgaatggaaacaagactggaccgattaacttggggaacccaggtgaattcaccatgctggaacttgctgagaatgtgaaggagttgatcaacccagatgtgacagtgacaatgaccgagaacactcctgatgacccccgtcagaggaagccggatatcacaaaggcgaaggaagttctgggatgggagcccaagatcgtcctgcgggacggcttggtgctcatggaggatgatttccgggagcgcctgaccgtgcccaagaaaaccaaggcctgaa

SEQ ID NO: 39194 - DNA, 321 bp, Zea mays
  Clone ID: LIB3062-047-Q1-K1-F11
cactggagaaatatggtttggtgcagatgtaatggacacagttgctgtttggacgaaaagggtgtgtaacattattgaaggcaagattccatctggtcaagacaacatcaaaagtgaagtcaatgaaaatttattctccaactaccctgttcttgatgttggaactggaaatggtcttcttttgcaagcattggctaagcaagggtttacagacttaactggaacagattacagtaaaggagctgttgaacttgcaagaaacctagctgctcgtgatggcttctcttcaataaactttttggttgatgatgtacttgagac

SEQ ID NO: 39195 - DNA, 470 bp, Zea mays
  Clone ID: LIB3062-047-Q1-K1-F12
attcgacggacgacgtcacgcgtggccctactcgtgggtgaaacacgacttctctttgatgtcaagacatgccaaattgcgtgcaagcgtccaaagcaaacagatcactgtacctggttatattcctttgaggaacaccctttgaccagtgaagtgggaatatcttctccagctttatatgatggattggttgagatcaaacaaccaaatgacattcctgcaattaatggtgccacaacctgcagtggtagttcagtgatcccttgcggtaatcatgatcaatcaattttagtggcaagcttacacatacctgattgggcgacttccttccctggttattttcaagactgtgggccagttgttacatatagccatgttgatgacattggttcgcctagaaagggtgtgccaattggacctgagcaccatgctgacattccaaaattgatgcccctaaactctatgattgt

SEQ ID NO: 39196 - DNA, 410 bp, Zea mays
  Clone ID: LIB3062-047-Q1-K1-F2
gcggaatcgaagtcttggtgcttatgaatgcttagagaatgcttagagaatgcttggtgtactcctccatgcgcctaggggttccttttatagccccaaggcagctaggagccgttgagtgcattccaggaaggcaattcttgccttctgtcgcctggcgcaccggacagtccggtgcaccatcggacactgtccggtgcggatttctttccttatttggcgaagccgaccgttggcgctttggagccgttggcgcaccggacagtccggtgcccccttccgaccgttggctcggccacgtgtctcgcgcggatcgtgcggccgaccgttggctcaccggacagtccggtgcacaccggacagtccggtgaattatagtcgtacggcggtaattacttcccgagagcagc

SEQ ID NO: 39197 - DNA, 462 bp, Zea mays
  unsure at all n locations
  Clone ID: LIB3062-047-Q1-K1-F5
cgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgngcgtcgtcggcggcggaccggcaggccacctgcaactgcctaagaagcatgacggcccggctcggcggcggcgtcggcatgggccaacgccgncaaacatccccggcaagtgccgcgtctccgtcggcgtgcccatcagccccaccgtcgactgcaccaagatcaactgatcgatggaacc

SEQ ID NO: 39198 - DNA, 328 bp, Zea mays
  Clone ID: LIB3062-047-Q1-K1-F6
caacgttaactgcaacacgattaattaaatgaggcgtcctgtgcgcgtccgggcgaggaatgcatgcatggcggagagtaataaattcgtaaacggtgtatcgtggatgcatgttgccgcgagcagagtacgtaggcatgaaccgatgtgtgcgcttctgtctgtgtactctctctatgtagtaatgtgtggccagtgggtgctttgatccagatgtattcgctcgtgagtggtgagtcatggaagttgatcgtttcagtatcattaccgtgtattctctcttttacatgcgattctgaaaagggacctgcacgaagttccagtatac

SEQ ID NO: 39199 - DNA, 364 bp, Zea mays
  Clone ID: LIB3062-047-Q1-K1-F8
gtgacggccgccttttttttttttttttttttttttgagataaattactatttgtattctgctctcagcttcatatcagctagctatttgagatagcaattgcggacagcctaagcagaagaactagaatagcttgttttctgcatgcatgttgccggtcccacaaatgcgcggccggggcgcattctttcgcagtcttcactagctagttcatcgatcatccattcatccttgcttgcactgcacgtcgatcttgctattcctttgtcagcctgacttcttgttggctatctcgatggcttccgctagctcgtcgatcttggcgccggtgacctccttcacgaccttcccgcccttgaggatc

SEQ ID NO: 39200 - DNA, 271 bp, Zea mays
  Clone ID: LIB3062-047-Q1-K1-F9
ctctcgaagcaaaacgcgcaccacgccgtcgccggccggccacttcgcacgtacgtaggacgcgcacgcaccggtgcatggatggggctcctgaaccagctgtgggacgacacggtggccgggccgtgcccggactccggcctcggcaagctccgcaagtacgcctccttctccccctcgtcgtcgtcgtcggcggcggtggcggcggctgcggcggcgggctccgcgccgacttcgggcgccgtgacgcggagcttgaccatgctgcggc

SEQ ID NO: 39201 - DNA, 385 bp, Zea mays
  Clone ID: LIB3062-047-Q1-K1-E12
cattgcggcaactctgtctagcttaaacctatctggaaataagatgtcaattgtggaaaatcaagcgcagaatcatgtttaccagaactttggtgaccagacagatgtgctctttaatgtaccaaaggaacacatgcaattttcaccacaaattttaagtcaaaataccgatgatggctcgtttaatgcccctgaatatgtagtttttccaaatggggggagcaacttcagtaattcacatgctagtaagctggcatctcatagcaatatcaagttttctatgcagccaccacatggtaatttaaacaagaaaggatctttgatgagctcacctggatcagattctcactaccataacttgaatggtgatagccatggcattgat

SEQ ID NO: 39202 - DNA, 358 bp, Zea mays
  Clone ID: LIB3062-047-Q1-K1-C4
caccacttcttcaaccaccacaagaaggactaggagcagcccgccggcgagtacgggtactgcgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgaagagaagc

SEQ ID NO: 39203 - DNA, 429 bp, Zea mays
  unsure at all n locations
  Clone ID: LIB3062-047-Q1-K1-C5
agcatcttagacgatctctctggcgatgcccatagcctgtattggaaatccgaagacgatgtaggcgttgctggtctgggaggcgaaaccgaggcgcacccttacgtctccttcaccataaattttgtctgagaccaagtatggttcctagaccgtctgtggcctagggccctaggcaatataatacttggaagcagctattggaacgcaagcgcggaacgagcatgtatattactctgttgatttatcggttcatgtggtcctgtagttcatatcacagagagatcagccgacggatgctgtaatttctgaggaacctatggaattcctgtagttcacgtggtcctgtaatttctgaggactacctacctatntccctgcagcactgcacctttgtaaaagacttaacccgtgtctgtagcaacttgc

SEQ ID NO: 39204 - DNA, 285 bp, Zea mays
  Clone ID: LIB3062-047-Q1-K1-C6
gtggacgccggaggaggacctcgtcctcgtctcctacatccaggaccacggccccggcaactggcgcgccgtccccaccagaaccgggctgatgcggtgcagcaagagctgccggcttcggtggaccaactacctccggccgggcatcaggcgcggcaacttcacggagcaggaggagaagctcatcgtccaccttcaggccctcctcggcaacaggtgggcggccatcgcgtcgtacctgccggagcggacggacaatgacgtcaagaactactgggacacgca

SEQ ID NO: 39205 - DNA, 199 bp, Zea mays
  unsure at all n locations
  Clone ID: LIB3062-047-Q1-K1-C9
gcggccttatactctgcatttctggctatgcatatagcggccggtgttcctagtgtgctgtcagcacttgctatggcattcaacacatatctgttcagtgcaatcactcattatagtaatgcgcatgctgcagtatacttcggagccgggtatatggagncttcagatgttttcaggctgggttttataacagccttgg

SEQ ID NO: 39206 - DNA, 408 bp, Zea mays
  Clone ID: LIB3062-047-Q1-K1-D1
cgacggactcattaacacacacacggacacacaacttctccatacacgccgtagccatgggttccgctgcgcagaagaagatggcaattgtttgcttgatgctgctggccgtcgtcggccaaatcgtcgctgatgctgatgttaccgtagaacatcccagccgcatctgcaccgaaacggtgattgatcctcgtgttcccaacaacgagtgcatctgctccaagaactgcgcctgtgccggcaagtgcatccttgagtcgcctgatgctgtccagacctgctttgtcgactgcgtcctcaagaacgactgcatctgcagcagcaagatcatcctcggcgctgacgacccaaaggctaatgccaagtgaagtagtactgctatcatcatccccaataatggcgtacgta

SEQ ID NO: 39207 - DNA, 254 bp, Zea mays
  Clone ID: LIB3062-047-Q1-K1-D11
ggaaaaagaaagccccaatggtagtgccaaggttttttcgagaaagaagaaacccacagcagaaaaggagatcaaagagaaaaagtcgtcaggaaaaaaggtgacaaaaggtaaaggagaatcagctgaagcagttcttcccagcaaggacgatctgaggaagaccattactgaaatcctcaagaaagttgacttcaacacggcaactttcagtgacattcttaagaagctcgacaatcactacaaaatggatc

SEQ ID NO: 39208 - DNA, 394 bp, Zea mays
  unsure at all n locations
  Clone ID: LIB3062-047-Q1-K1-D12
ctagggtttttgattttagccgccgccgctgctcatctcacatccctcgagaagacgcctgctcctcgccgatcgatgcgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagctgangatgatgatgaccttgatctttttggtgatgaaac

SEQ ID NO: 39209 - DNA, 390 bp, Zea mays
  Clone ID: LIB3062-047-Q1-K1-D2
aaatgagataccaaagtcccgcatgttctggcctcgagagatatggagtaaatatgcagatgaacttgaggacttcaaatatgaggagaactccaaaaaagcagtacaatgcttgaacaatatggtgactgatgcactgattcatgctgaagagtgccttcagtacatgtcagccttgaaggatcctgccattttccgtttttgtgcaataccccagataatggcaattggaacatgtgctctttgctacaataacgtgcatgtctttagaggagttgtgaagatgagacgtggtctcacggcacgaataattgacgagacaaactcaatgacagatgtctatactgctttctatgagttttcttcatggatagagtcaaagattgatga

SEQ ID NO: 39210 - DNA, 333 bp, Zea mays
  Clone ID: LIB3062-047-Q1-K1-D3
gctctactgactttgtatgagctacgctcccgcgggtgttcctgctgaatccgaccgtgccgtgagcggctcgtcactgttcgggatgttcgctttgaaggaacgcccgaagtggatgaacatcacctcgcttgacgagctcgagacaaaagtggggcacgtcatcgtgatgattctacttgtgaagatgttcgagaagagcaagatggtgacgatagccacggggctggaccttctcagctactcgatctgcatcttcttgtcgtcagcttctctctatatcctgcacaatctttacaagggcgaccatgaggagtgacaagagtgcaatgc

SEQ ID NO: 39211 - DNA, 375 bp, Zea mays
  Clone ID: LIB3062-047-Q1-K1-D4
gctcagcagcagaacagcatccagttgattcagtaaaagtacataacaatgcatctgttgtgctgaccaaaaaaatgtctgatttatctcttgagtggcgatcagatttatcgaaaactgatgtctggtatgccagttttggatcaaacatgtggagaccaagatttctatgttatattcaaggagggaaggctgagggtatgaatataccatgctgcggatcacgtgacacaagctcaccaaaaggaaccgtgtggaagactgtacctcacaggttgcttttcggtagatcgtctaccccttgttggggaactggtggtgtggcttttctcaaccctgagataaactacaatgagaagtcgtatgtcttgcatg

SEQ ID NO: 39212 - DNA, 400 bp, Zea mays
  Clone ID: LIB3062-047-Q1-K1-D5
gatgaaacttcaaaacttgttggaactgatctaggactgcaattgtcaccttctggtgatgccatggtagatatatctaataagccacccagctgccaagacgtaaaggaggccccgagcagtgacattttgggaaatgatgaaaattcagacaccgagaagactcctgctgccttgcatggacggctgaacaccgaacttgctcctagtggcagaaatacagaatttagtgaagctgacactggaaaacaagagacacccgtgtctgctgaggctatggtagaatcatcgagcgagcctcgcagccatgaaggcaaagaagctcaacccctgaccttgtctgggatgatgaaaaagcgaagtcgcaaggctgctggtgtgcggaactttttgagatgca

SEQ ID NO: 39213 - DNA, 451 bp, Zea mays
  unsure at all n locations
  Clone ID: LIB3062-047-Q1-K1-D6
cattaagcatggcagagacagtgatgcaagctcctctgagaatttccattgggcctgagtgatcgaccgaggctcagaagattgaagaaagaaccttgaagcagcttactctaagacctattacacctccagcaagcaaatcttctgctcttagttctttgaaaataaaaggtacaaggcttggagatcatcctactggtcctagtaagacctcacaactattaaaaatacagtcagccaacacttcttctagagctccagttaaagcagatgtttcaaagctctctcagccaggaagcttccaagttctcagtcgagagcaaaacggtactgcacacaccgncaaagactgtcctgtgaaacctgtgagtccttcaactcctttggcgtcgctggaaacacagaaaaaaacagtggcgagccaaaagttgaagtttggcaccaatgaaag

SEQ ID NO: 39214 - DNA, 451 bp, Zea mays
  unsure at all n locations
  Clone ID: LIB3062-047-Q1-K1-D7
ttcgagggatgcagtaaccatgaatcagcttgatagcagtaacaaatttgcttgacttctgacgagtaagaaattggcagcaagttgagcaggggccagactaataaatcagcttgatagcatccttgcagcggtgccttggactttggcggttagaagaggtttataattttatatgatgaaattatgtgcatcttcagttgtttttgcctcactgctctgtaaggacatataaaattggtatttgtactttctaaggttctccttggaatggtagagttttacagggaaccttccatcatcagttgctgacatagctcgaactcgacgtttcttcttcgccagttgcggctctggataaactcgaagctgacctatccaagttcgacgacgggcccttctttctaggccaattcagcttggcngatgtagcgtacattacgatttctgg

SEQ ID NO: 39215 - DNA, 390 bp, Zea mays
  Clone ID: LIB3062-047-Q1-K1-D8
cgggccgcgtcgtcgggacctacgggtacatggcgcccgagttcgcgttggacggcgtctgctcggtgaagtcggacgtgttcagcttcggggtcctcctgctggagatcttgagcgggcaacggaacggcgctttgtacctcgaggaacaccagcagtccctcatccaagacgcatggaagctgttggagtgaagaccgcgcggccgagttcatggaccagtcgctggggcggtcctactccaaggacgaggcgtggcggtgctaccacgtcggcctgctctgcgtgcaggacgaccccgacgtccggcctaccatgtccaacgtcctgctcatgctcatcagcgaccacaccaagttacccgagccagccattgccgccttgttcgcg

SEQ ID NO: 39216 - DNA, 216 bp, Zea mays
  Clone ID: LIB3062-047-Q1-K1-D9
tcgagaggctgcagtggaggcaactgtcgaattcctgaacaaggcggtgaagccagaccttggggccggccccaaactgcgtgtggcaaaggcacgaaaggcatttgacgatatggtagatgccagtggctatgcctatgccgtgatgccatcggccaagggtcttgtgccagagactcaccctcacttcatcggcacctactggtgcgcagtcag

SEQ ID NO: 39217 - DNA, 450 bp, Zea mays
  Clone ID: LIB3062-047-Q1-K1-E10
cacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgtcggcgccttcgcactctacgagaagcacgaagcgaagaaggaccccgagcacgcgcacaggcacaagatcacggaagaggtcgctgccgcggcggacgtcggcgccggcggctacgtattccacgagcaccacgagaagaagaaggaccacaaagacgcccaggaggcccacggcgagaag

SEQ ID NO: 39218 - DNA, 285 bp, Zea mays
  unsure at all n locations
  Clone ID: LIB3062-047-Q1-K1-E11
agaaagttgtggatgagaaccttgagaagctgaagaaggtgctagaggtgtacgaggcacgcctgagcaagtgcaagtaccttgctggagacttcctcagcctcgccgacctgaaccatgtgtctgtcactctctgcctgttcgctaccatggctccgatgaagctgtacggngcggtgatgtcgtggaacgtgacgaggtgcgcaacggcgctggaggaggctggctccgactacgagatcgtgcccatcaacttcggcaccggcgagcacaagagccccgagc

SEQ ID NO: 39219 - DNA, 342 bp, Zea mays
  Clone ID: LIB3062-047-Q1-K1-C3
acgtacgcaccaatgactgttaggactgcgggcagcggaacccgatgatgaaccaagaaccggctaggacgacgacggcaatggtgcagcggtacgacccacagacatgctggatgcagtctcggtcgcatgaactgagcaacgggccgacaatggagcagtatagccgcggagatgcttggcagaacctcgagcgtggagtcgagccccgtgtgaccgcacgcgaggcctacgcacctgcaccaggacacgccagcagatcaagccatgccgtagtcggctgcatacgacaaaccggtggctcaactcgacgcgaactctgtgcgagcgaaactggagctc

SEQ ID NO: 39220 - DNA, 289 bp, Zea mays
  Clone ID: LIB3062-039-Q1-K1-F2
caataacatgcaccatccattatatttatttattaaattgactctatcggatctgctatagtggggtttataactggggagggtgacaattaagttcatcgtactatgcttgaacttataaaccaccttgataatttttaatcatcacacaatattaaagaatttatgacaacgaacagtatagacattatccatcaatccctactgagtcctctccctataaacagtaatattgaattccctaatcctatcgaagattcaaaattcgatatatcaaatatccaatcaa

SEQ ID NO: 39221 - DNA, 427 bp, Zea mays
  Clone ID: LIB3062-039-Q1-K1-F3
ggcctccctagtggacacggtgaaggtaattgacggccaccagcttgtatgcaagcttggctgagacgggaagaaggagaagcaggggcaatcacagcaacctggacctggcaatcaccaccagcagcagatactgccgggtggtccgcaggacattcagggagggcttgggcttgggtcacaaatgggagcacagtatggtgtccctgggactggtatgccttcatttggttttggtggtgttggcggcgggtttgggggtccaaatccttatggtaacatgccatcttccatgggtggaggtggcgcaggtggtttagggtcgatgggaagccaggtgcccagtggtttggctagtgctggggctggtgcatttgggcctggcggattgggtggtggttcatatggtgtatcatctcagttcggt

SEQ ID NO: 39222 - DNA, 445 bp, Zea mays
  Clone ID: LIB3062-039-Q1-K1-F4
ggcacaccccccgagctcagcttacctccactccagctccaatcacagtcgtgaccagagcgagagctagctggagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgggggctcctgtactgggtggcgcagctgctggggtccaccgtggcgtgcttcct

SEQ ID NO: 39223 - DNA, 426 bp, Zea mays
  Clone ID: LIB3062-039-Q1-K1-F5
cgacgaatctcgcggggcggaggtggtggcgcgactgaggcggtgtcgactccgacgaggtcgcagccaccgggggatacgcagcagcagcaccggcgtactccatcgacgttcatatttaaggacttggtttggataattctactcgtcaacaaaagtgattaaaaatggtggttcttgcagcttcaatcgtttcaaagtcgggaaaagcacttgtttcaagacagtttgttgacatgtctcgcataagaattgaaggattacttgctgcgttcccgaaactggttggaactgggaaacagcacacttatgttgaaactgaaaatgtgcgttatgtttatcaacctattgaaggattatatcttctacttatcacaaacaagcagagcaatattcttgaagatctggacacattgaggctcctct

SEQ ID NO: 39224 - DNA, 425 bp, Zea mays
  Clone ID: LIB3062-039-Q1-K1-F6
aaatctatacaagagaattaaataaaaaaaagcctataaaagcgttccatataccgggggcaatcttagacacgcgcgcttaccaactcctagctcttcatatatactcacctaaattacaatacactcatcattatcaccacaacgatttgactggaaaaactcatcacttcacccaacttaatctccttgcagaacatcccactactgccatctacataaatctctacaaggcccccacccttcaaccttcacatcagccacccagcctaaatcctgactgacactctccttaccacgcaccatatactcccgtgcaaacgttctctactcgcattataacccatacaattgccacaagtttatctcccgtttctttccctttcttcccatcctatctcatcacgttatcattctcttcccct

SEQ ID NO: 39225 - DNA, 427 bp, Zea mays
  Clone ID: LIB3062-039-Q1-K1-F7
agcaaccggaggtttcttcaatagatgacctggaaggcttttccatgggcaaacctcagatgcctgcttatggcaacactgtttttgatgaggactatgaaagaagctcatcagatactgaagagaaagacaggcaagaaagattggagaaagaaagagaaatgaagctgagggaggagatggagagggagcagagaaggcttgaaaaggagagggagttggaacaacagagagaaagagagagagaacgacaggcagtggagagggctacaaaggaggcacgtgagagagcatctgctgaagctcgtgcaaaagctgaaagagaggcccgccagcgttcacagcgtgctgctgtgcaaagggctcaacaggaagcccgtgagagggctgcagttgaggccaaagaaagagcaactagggtagctgc

SEQ ID NO: 39226 - DNA, 426 bp, Zea mays
  Clone ID: LIB3062-039-Q1-K1-F8
ctcaactggctatatacggatgtaactcagaaactggaagccaaggacttctcgagcgtgcaggaagctcatgcatgcactgctggtttgaaagctgtgacaacatcagtaacagctgatgcaattgaagaatgccgaaagctctgtggtggacatggttacttgaacagcagtgggcttcctgagttgtttgcggtctatgttcccgcttgcacttacgaaggagacaacgtcgttttgcttttgcaggttgcaaggattctaatgaaaaccgtttctcagttggcatccgggaaacagcctgttggcacaatggcctacatgggcaaagtgcagtatttgatgcaatgcaaatctgctgtcagttcagctgaagattggcttaaccctgatgccatacaagaggcatttgaagcaagagcgctc

SEQ ID NO: 39227 - DNA, 458 bp, Zea mays
  unsure at all n locations
  Clone ID: LIB3062-039-Q1-K1-F9
tggcccgttctcaagagaacctgtcggaggacaagtcgcggctggggtcgacgccgccgatctgccgcaaccggttgagcggctgcaacccctgcatgcccgtgcaggtgacgaccgcgcccgcggggctcgggcgcgcggcccgcgtcaccgacgccgacgcggtggccggcttctcccgctactccgactacaagccgctggggtggaaatgcggctgcgacggccgtctgtacgacccctagccgagcgtgcaacgccagtgcactctgctccggtccggtagggtgggggagactggaggccatccaggttcttggagtcatctgttcttggtttttgcatgcccatgggccatggcggcttgcttcacaagcttattatntctctctctattctctactagttcgagcttgcagcttgtaccagccgtagccggagccatttttttttttggc

SEQ ID NO: 39228 - DNA, 386 bp, Zea mays
  Clone ID: LIB3062-039-Q1-K1-G1
cccaatccttgcgtcgtaggaaccaccattcacggtgacggctgtggttacacggcaaggaggcaccgcataggcacccacgatagaggctcactgcctagtgcccatggccaagttggacgagcatagtcgatctaccgccaagccgtcatatggtggtcgacctcgcccagccgccgatctaccgcgccggaggaccaccgccgattaacaggcacaccacatgcgcccacggcgaaggtccacctatagttgtcgcccaagtcgatggaccgaaaaggacgccggggttccaccatggtggcctcctggattcgatcgtcgcctctgcgtctcctcctcttcctctgctggttgttctgttccagggttcaaaggccaggtga

SEQ ID NO: 39229 - DNA, 414 bp, Zea mays
  Clone ID: LIB3062-039-Q1-K1-G10
gaaaatgatgtagatcaagaattggatgatgacaatggcgtggagcgtatacttagtgggaaattgggtgagagcagtggatatgctggcagtgacctctatgactacaagtctcgagaaccagattactgcattggagaacaagtgctcaggtgattaccaatggattggtttctgtcacaatgatcttcagaatggcaatatcatgattgatgaaaagaccaacgtgctgaccatcattaaaatggccatcggtgtccctaaaaagcggaatgacaaatgggtggctaatcagcttttaaagctacatctggagtaaaaagcttcgaaggatgctcatcttcagtttatgcgctactatttgttgactgacatggacttgcaaaagcgcacttaatacttggtagttttgga

SEQ ID NO: 39230 - DNA, 454 bp, Zea mays
  Clone ID: LIB3062-039-Q1-K1-G11
ttgaacattggtattgcactctggttggctgctggtggtgatggttgggtggatggaagtatatgtcgtatgcaagaggggtctcgctataagtacaggtcgagatctagagtccttatagtgggttctggggctgatgagcagtgtgctggttatggtagacatcggactaaatataggcttggagggtggaacgcattggatcaggagatgagactagatgtgcagagaatatggaaaaggaatatgggaagagatgataggtgcatctctgatcatggcaaggaggcccgtttcccatttcttgacgagaacgtgataaaaactttgttggaaattccgttatgggaaattgctaagcttgatgaacctgttggaaggggtgacaagaagatcttgagagaggttgcaaggctgctgggcctacaagaagctgctcttcagccaaagcgcg

SEQ ID NO: 39231 - DNA, 410 bp, Zea mays
  Clone ID: LIB3062-039-Q1-K1-G12
cctcatcccagaggccacaactgccaacaagccaatggctctcgtgcgccagcgccgccaggggccgcaccttaccctggcgctggaccacttcgccctgcgcgtgccaccgcagcctcagcccaccgccgcgccgtccacctccacgtccgacgcccgcctctccgactacgagaggctctccgttctcggccacggcaacggcggcaccgtgtacaaggcgcggcaccgccggtccgcgcagccggtcgcactcaagctattcgcggacggggacacctcggcggcgcgcgaggccgagatactgatgctcgccgcggacgcgccccacgtcgtgcgcctacacgcggtgatcccgtcggccgccggggaggctcccgcggcgctggcgctggagctcatgcccgggg

SEQ ID NO: 39232 - DNA, 434 bp, Zea mays
  Clone ID: LIB3062-039-Q1-K1-G2
cccacgcgtccgccgccctataatggggctgtagttcctcctgccggaaggacaagcgggaggttcaactccacagaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgt

SEQ ID NO: 39233 - DNA, 431 bp, Zea mays
  Clone ID: LIB3062-039-Q1-K1-G3
gaataaggaggccgagcaggaggagcagcagctaccgcacgcgcagaaggataacgtggccggcgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtgg

SEQ ID NO: 39234 - DNA, 320 bp, Zea mays
  unsure at all n locations
  Clone ID: LIB3062-039-Q1-K1-G4
ccactccttccatatcataaactacttttcttacttatccttccgaatacacaatcaggaggctccacataacagcacgctatccaaacttaccttctcacacttacaacctattacatatatcatattanttataccttcattccaccatatgttctacactaattccctcacatcatatacaccatacctgaatactcactacaaccaactcacacactacatgcacacacagagcatattctcctttaatccttacacaattcattccacacaacatgtctcttctcctacaccatccgaaccacttccatactatc

SEQ ID NO: 39235 - DNA, 443 bp, Zea mays
  Clone ID: LIB3062-039-Q1-K1-F12
cttcaccttgggtatcctaagtaacataatctcgctgatggtgttcctttcgccgctgccgacgttctaccgcgtgtgccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggccgcgtacctggtgtacgcgcccaatgccgccagggcgctcacggccaagatgctgctggggctcaacgtcggcgtctttggactcgccgcgctcgccaccatggtggtctccagcgccggcctccgcgtgcgcgtgctcggatggatctgcgtcagcgtcgcgctcagcgtattcgccgcgccgctcagcatcatgcggcaggtggtcc

SEQ ID NO: 39236 - DNA, 419 bp, Zea mays
  unsure at all n locations
  Clone ID: LIB3062-039-Q1-K1-D5
gcatttcgggctgccactgccgccaccgtcgcaggccaagggcaaggacttcaagaagggcgccaacttcgccatcaccggcgcgacggccctggagtactccttcttcaaggcgcacggcatcgaccagcgcatctggaacaccggctccatcaacacccagatcggctggctccaggacatgaagccgtccctctgtaaatcggagcaagactgcaaggattacttcagcaaatccctgttcgtcgtcggggagttcgggggcaacgactacaacgcgccgctcttctccggcgtcccattttctgatgtcaagacttacgtgccccttgttgcaaaggctatcgccaatggcgttgagaaactgatcgagcttggggcaacagacctnctggtgcctggcgttctcccaattggct

SEQ ID NO: 39237 - DNA, 326 bp, Zea mays
  Clone ID: LIB3062-039-Q1-K1-D6
cacacacagacaagtggtttccaaagcctagtgtgtgtactagcaaccagctagcgccgacggcatcaagcagccagcatgtccgacgagaatcaccaccacttctttaaccaccacaagaaggaccaggagcatcccgcccacgagtacggttactccgatacccaggtggtcaccgtccccgacgacggccatttctagaggtacactaaacaggaaacataacttaagcacaagcatgactctcgctcaggccgattccatccaccgactacaattcgcctatcttataaacaataccattttctaacaccaagacttacatc

SEQ ID NO: 39238 - DNA, 419 bp, Zea mays
  Clone ID: LIB3062-039-Q1-K1-D7
gccaaatcaagtaccaactactgaagagttgattacgaagtacatagccacatgtggagcaaagatagaaaaacttgtgaaggcatatgttgataggcacagtacatgtcatccaaccatcaaatacagcagctctgagatgggagcttgagcttaatggtgatgacagcttgaaccttctgtcctaccaatctggttaaccttcatttgtaggcccaacaagttaatattgttcatacaaacatgtatgtccatgacttcttgaggcaagtagtcagcgaagttccagatattggtgcatctgatgttattgctgatgataagcttggcaaaggacgtatatctatcctgtagttgataaggttcttacatgtcaaaataatcttctacgaagtgttaataaatgctgaattgtcatc

SEQ ID NO: 39239 - DNA, 436 bp, Zea mays
  Clone ID: LIB3062-039-Q1-K1-D9
ctggtcaccactgttgtaggtcctagaagatcagggctatgatggtgcaatggctgatctgtggtgatgtggagttatcctgtgtgttctgctagctgggtatttacctttcgaggactctaatcttatgacgctgtataagaaaatctcaaatgcagaatatacatttccaccatggacgtcgttccctgccaagaggttgttaacaagaatccttgatccaaatccgatgacggtatgcaagagcacaaaagctgctcgaaataaaatactacccaaaacaatgtaggaattttggagagtctaaaagttcctactgcacttactagcacatagccagagatagatgtatttgggggaaagattcttttagggaagtatagacaacatgcatatatcgaaatgaaactatttgtgtgaggaaagagttgcaacc

SEQ ID NO: 39240 - DNA, 365 bp, Zea mays
  Clone ID: LIB3062-039-Q1-K1-E1
ccaagatgaaggtgtgcatgcttggtgatgcccagcatgttgaggaggccgagaagatgggagttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttgacgatggaggagaagcagatccagcagaac

SEQ ID NO: 39241 - DNA, 436 bp, Zea mays
  Clone ID: LIB3062-039-Q1-K1-E10
cctagcagcccgtcggtgctccctctctgcagatctcccttcgcagccgccgaggaaccccttcacagcgcggaagatggctgaacaggatgcccgagtcgtggttgaggcaccaaccccagttcttggggagcctatggacttgatgactgctctgcagctcgtgatgaagaagtcaagtgctcatgacggacttgtgaagggtctacgtgaggctgccaaggccatcgagaagcacgccgctcagctttgcgtgcttgctgaagactgtgaccagccagattacgtcaagctggcgaaggcactctgcgctgagcacaatgttcacctggtcactgttcctgccgcgaagactcttggcgagtgggccgggctttgcaagattgactctgagggcaaggcaaggaacgttgtacgctgctcctgtgtcgtcgtc

SEQ ID NO: 39242 - DNA, 448 bp, Zea mays
  Clone ID: LIB3062-039-Q1-K1-E11
atttgttttccaaatacgggaatgtcacggatttgcaaattttgagaggttcacaacaaacgggcggagctggctgtgccttcattaaatatcaaacaaaagatcaagcattggcagctattgaagctctaaacgggaagcacaaaatagagggttctagcgtgccgttggttgtcaaatgggctgatacagaaaaggaaaggcaggctcggaaagcacaaaaagctcagtcacagctatctcatatacccaatgcaagtccaatgcagcagcactcttcagtatttggtgctttacagatgggatatatgcctcaatacaatggatttggttatcagccaacagggacatacggacttatgcagtaccctctatctcctatgcaaaatcaaggccccttccagaatatggttcaacctcttactcaagggaactcgataagaggagt

SEQ ID NO: 39243 - DNA, 447 bp, Zea mays
  Clone ID: LIB3062-039-Q1-K1-E2
agttgaggacacaactattagagcctccaaagggttccagcggaggtggagatggttttgaagtcacaaaggttgggcatggtcgtgttgcacttattggatttcccagtgttggaaagtcaactcttttaacgatgttgactgggacacattctgaagctgcatcatatgagttcacaacgcttacttgcattcctggaattgttcattacaatgataccaaaatccagcttcttgatcttcctggtatcattgaaggagcttctgaaggcaaggggcgtggtaggcaggttattgctgttgcaaagtcatcagatcttgtgctgatggttctggatgcctcaaagagtgaaggacatcgtcaaatattaactagagaactggaagctgttggactccgtcttaacaaaaggccttcccagatatacttcaagaggaagaagacgg

SEQ ID NO: 39244 - DNA, 433 bp, Zea mays
  Clone ID: LIB3062-039-Q1-K1-E4
atcaagaagaacaatattgagtcacctaatttgtctgatcaaccactacaacgtgaccgtagtggtggcgccggtgaaacgaaggctagttgatgaatttaaatcttgtgacttgtctcaccgacagaagagaaaagttaagttgcagggaaactcactgcaaactcagacaccaagaagatcaccacgattggtaaacgtgaacaatacttgtaataagaacaaaaaagtgtcgaaaggaagagccaaagtgctgaaaacaccaccagatgcaacagatcaggtgaaggatagagcacataaatcatgtttgcttgatgagaaactagataatgccttgaaagctgttcatgaagaagcgacaggttccttatctcaggatctcaagaaactggattccccacggtgtgaggttggcttaagtaaagagcat

SEQ ID NO: 39245 - DNA, 416 bp, Zea mays
  unsure at all n locations
  Clone ID: LIB3062-039-Q1-K1-E6
gcagactttacttaggccgtccacaaggagaccctcctcagctagtaccagtagtgggggcatttgcaggcagatgtgagttagccggcggatccgatccgtgcgcctgctgtgtgtgtgtcggtggagatggccacagcttacgctcccatggcgagccaggtgatgaagagcagcctcgtcgtgcactcgaggccgaggggcctgtcaggcgctgctgcgctcacgaggcggccccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaacctcccggcctaccgcaccgncgtgagcccgctgctgcggggcgt

SEQ ID NO: 39246 - DNA, 371 bp, Zea mays
  Clone ID: LIB3062-039-Q1-K1-E7
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgg

SEQ ID NO: 39247 - DNA, 434 bp, Zea mays
  Clone ID: LIB3062-039-Q1-K1-E8
cccgctgctgcaaatcccggggccgcccggggcgccgccgccagcagcgccagcggtgagacatgacgccgccggcgaccgggcaagggggaggaggccataaaaatagaaccagactggtgttggccattgcattgcctttagctgctgcaactgcaatattagctctcgcagtagcatgtttgtattaccggagtagaagaagaacaacagcgcaaagggactcatcaggaaagccatgttctcctagtccagatgacattgataagagcatcgattcgctcctttttgacctaccggcattacgggcagcaaccaataacttcgctgaaagcaataagcttggcgaaggagggttcggtgcagtttataagggaatcctttctgaaggccaacaagtagcagtgaagaggctctcacttggctctacacaa

SEQ ID NO: 39248 - DNA, 432 bp, Zea mays
  Clone ID: LIB3062-039-Q1-K1-E9
caacctaccagtgttaacaatgaagtggctgtcaatagcaaggccaaagatgacggcgaggaggaggagaaggatcctggaactgagcctgcatttctgtggacagccgacaacgagaagaacgtcatggatcttgggtactccgagaccgaacggagccgtcggctggagacgctgatggtgaagagaaaatccaggaaaaacatacagtttgagctggacggcgtgggcggtctatcagacggtctatcacggttacgtccgaaagttcatcctgtttcagtttcagcgcgaaggatgaacccgtttactaccgatgactcggagatcccaggctcggctcctcctattctgcatccacgagacgaccccttcagttttctcaccgatgaacagccagctgacgacaacagtggccaccctgcgcaccat

SEQ ID NO: 39249 - DNA, 447 bp, Zea mays
  Clone ID: LIB3062-039-Q1-K1-F10
acatgccttgccttgcctttgcctacctgttgatcgagccgagcgagcagggagagacacgggaccgagtgaggccgccgcatgctcctcctctccgatccgtacgtttcctcctccctagcaatcgcaacccgttcagccaatcattgccgtctccaccaactccgttcccctattacctagttagtccagtccgcctgctgcctgcctcaacggatcgacgcgacaggagggagggaggaaggagacggtcgatcagagtctgagacggaggccgatccaccaccgcagcgacgagcgggaggagatgaagatcatcattgacacggatcccggcatcgatgacagcgtggccatcctgatggcattccagatgccgggcgtccaggtcctagggctcaccaccatcttcggaaactgcaccacagagcatgccacacgcaacgc

SEQ ID NO: 39250 - DNA, 419 bp, Zea mays
  Clone ID: LIB3062-039-Q1-K1-F11
cggacgcgtgggcggacgcgtgtgatgagagagagctagaacaaggtgttgagttggctggggagtgggagaagattaatcaagataagaagcagaactcgtccgatggtagcatgcatccaccagaccttgaaaacgctgacgaattaatggagaatggccaccatgtcaagcagagtctaccaacgacagctgaagacatgggctgtccgatggacagtaaagaacgacatcctgcagcacttcataagcaaaatgatgtttctgagcacaagtcacagcagcttgatgacacattgaaacaccaaaagagctgtgatcatcctcaacctgtaggaagccctgagcaggatggaaaagactacaagaggcctaagcttgacggataggtttatatatatgaatttgggatgggtttc

SEQ ID NO: 39251 - DNA, 423 bp, Zea mays
  Clone ID: LIB3062-039-Q1-K1-D3
gcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaac

SEQ ID NO: 39252 - DNA, 418 bp, Zea mays
  Clone ID: LIB3062-039-Q1-K1-C1
cgattgatgaccttctaaaggaaaggaatgcaattcatgcatcctataccaacaacccagctgtgcagcggagttccagtagcagcaaagggaaatcaccctctaaagggtccagaagtgaggatgaccaaactgtaaagaaggaaaagaaatccaagagccagccaatggagggatccaaaagcgatgatgagggtcccgaaaacaaaaaggaagaaacgcctaaagatcggattcgaaggaagaagtggttcaacattcatttgaaagtggacaagagaaggccctgctgataactgcgatatatcatgtgctcctcaagatctctgctccaagtacaaggaaaaattcccatttgacgtccaggaagatgcatcttgtcgatcatgatcaagcccattctatttcctgaaaagtc

SEQ ID NO: 39253 - DNA, 449 bp, Zea mays
  Clone ID: LIB3062-039-Q1-K1-C10
cagcactgaacacttgattgattcagtaggtagctagctagctgaatcacaatggatcctaccaagttccgtccgtccggtagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactg

SEQ ID NO: 39254 - DNA, 224 bp, Zea mays
  Clone ID: LIB3062-039-Q1-K1-C11
gtagtagctgcggtattagtatatatgcttagatgttcagtcactttatttaagtacaattgggcggtggacgtgtacctgattttactatgtatgcgtgacaacagatatgtgtctgctccttctattttcttgcctttgcttcaaaaaaatggatctgaacattgcgagttcgtactttgtagacaatatatatatgtgtgtgtatgtgcttggtttgcttc

SEQ ID NO: 39255 - DNA, 424 bp, Zea mays
  Clone ID: LIB3062-039-Q1-K1-C12
tcgcccacgcgttcggacagagagcacggctcccatagtcgaagtggtgactgcctcagtatagcgaaacatctggagtctgctaacacaatgttctcatttgtgtggtggataattggattttattgggtatctgctggtggagaagttcttacccgtgatgcgcctcaactttactggctttgcatcgtatttttggcgtttgatgttttctttgtcgtcttctgtgtggctttggcctgcatcattggtattgctgtttgttgctgccttccttgtatcatagcaattttatatgcagtgtcggatcaggagggagcatctgaagatgacattcgtcaaattccaaaatacaaatttcggaagatggaagagcctgaaaagcagtctgttggtgtgcctggatcttctggtggaataatga

SEQ ID NO: 39256 - DNA, 416 bp, Zea mays
  Clone ID: LIB3062-039-Q1-K1-C2
gagcgcacacacacacaaccagatctcccccaaatccacccgtgggcgcctccgcttcaagaggcggatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgatgactggcgcacgcttgctgactacaacatccataaggagagcaccctccaccttgtgctccgcctcaagggaggcatgcagatctttgtgaaaaccctgaccggcaagactatcaccctcgaggtggagtcctatgacaccattgacaacgtcaaggccaagatccaggacaaggatggcctccctccagaccagcagcggc

SEQ ID NO: 39257 - DNA, 403 bp, Zea mays
  Clone ID: LIB3062-039-Q1-K1-C3
acgcacaaccaagaaggtggaagcatttgaggagctcacatgggattatggtattgattttggtggggataagcatcctgtggaatcatttgaatgcctgtgcggaagcagatactgccgtggtagaaagcattcgaggacgcgaggcaaagctgcttcgaagtgaagtgttgactgaaagcagcggtgcatggttggtttgggaaagcgaacggactaatcagttttagaatgctttgttaacctaggtagctatgcattcataaagtgcccgctgtgcttgactgcagaacgtgaaattcaattagacagactgaaatgcaatgtacgtacgctactcctaaaccctaagccatttggccatgatctactgatgatgaagtgaaaaaaaaaaaactaaaat

SEQ ID NO: 39258 - DNA, 432 bp, Zea mays
  Clone ID: LIB3062-039-Q1-K1-C6
gttaaaaccgagaagagaccaggccgaaggaaaacaatcctgaaaccaagccatgggtgagcaggaggaatttgaggagcatgctgagaaggcaaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctg

SEQ ID NO: 39259 - DNA, 423 bp, Zea mays
  Clone ID: LIB3062-039-Q1-K1-C7
gtgagaattcttaattcatgagttgtagggagggacttatgtcaccacaaacagaaacgaaagcaagtgttggatggaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaag

SEQ ID NO: 39260 - DNA, 351 bp, Zea mays
  Clone ID: LIB3062-039-Q1-K1-C8
attccctggccgacccactcatacgcttacaacccttaatacatcaatcctttttaacaccttactttaccccaaccatggccgacctttttcaatctgtggaacgctcttataaaccattaacctttcacttactacccaccaatcttccaaacctaatacactactatctctacaacattcctacttacatataacctaataccaattcttccacatcttctaccacaattacattcccaatcatctactccttcattctcaattcatcctacttataaactaaccatattcttactccatctccaactatactataacactgaactaaaccatcatctcttacatcta

SEQ ID NO: 39261 - DNA, 463 bp, Zea mays
  Clone ID: LIB3062-039-Q1-K1-C9
gcagtgccatttctcgcctcggcatgacaaggcatgtattgcttcaccggtgaggaacattggggcagctaacaatggtccggctcgtactacatgtacagatcatgactggtggtgttctctggtcggcaaatgcagcaaaccaaccatgtctttgctgtgtggtgtggctgctgcatgtaacaggaaaagaagcacggcggtgaaggtttcgactgtctaatgcatgatgctccgataccataaactcctcaccgggcgcataaccatgctaagatttatcacggttatgatcaatttgtgatggctgattgctgccaaatggaggtggctgttctcatctcactactctatatcccacaagtgaaagcaattgtaaaaagttctagagccactctatatcccacgaacgagagcaactgtaaaaagttctagagctggtaagataagtcctgaatactgt

SEQ ID NO: 39262 - DNA, 238 bp, Zea mays
  Clone ID: LIB3062-039-Q1-K1-D1
acttctacttactagcccacgccatcaaccaccacatattcaacaatgccttcatcatcaaccataacatctctttacttcaacattcaatcacctccactctatgacatccaatcaataccgcaatcattttctttaccttttcctactagatctacttactcaattatcactctactactatccacatgactattctatcacatcaaacccttatctaccgacccacatcaatata

SEQ ID NO: 39263 - DNA, 443 bp, Zea mays
  unsure at all n locations
  Clone ID: LIB3062-039-Q1-K1-D10
gattactacagatacctcgctgagttcaagactggagctgagagaaaggacgctgctgagaggacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctntatgtgcctagaaactagtagctagtgtttgctgctgtcgaatg

SEQ ID NO: 39264 - DNA, 442 bp, Zea mays
  Clone ID: LIB3062-039-Q1-K1-D11
ccggccttcctgcgatcctacccgtgcccgacggccttaaacgcgcgcgcgcgcgagcgagggacgtggtgaggaaacggggggaggagacgacgcgctcgcctattggccgccggctccgctcctttgcgcccagtgcgacggccacggcctgagcggcgctgccagcatggcggctagtatgagcagcatggagtcgcggtcggtccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggcggtggcggcgcggctaaaggagccgcgagtgacgagagcaacgaggattca

SEQ ID NO: 39265 - DNA, 447 bp, Zea mays
  Clone ID: LIB3062-039-Q1-K1-D12
agcgcatcgaagctgcctctgaccaacctatttgcatccatcgcccactgctagggttccaagaaatttggtgtgctgtggcgaccgggctttccctatgggttggtcatcatttcgggagcgtcgtggctacctccggtgctgcggccagcgcgactaggccagatcgacccagcgcgacgacggttgtgcacggcgtcctcggacatcgctccgccagctcaaatctccaagcgctcgagctcgaaactcctccaatcggtcgtccgctgccagcaatcgacctccatccacagagcactcaccgaaaggtggctctggatatctcctgcactaacagcaccacaaaaattgcattcaacaccaggatggtgcgtttgcggtgataataacaatcagacatcgcgagattataatagagtgtgttatgcagtgatgtaaatattt

SEQ ID NO: 39266 - DNA, 450 bp, Zea mays
  Clone ID: LIB3062-039-Q1-K1-D2
ctgccagccgtcgtctgctgcggactccgcctccagtttggtctgtttcttgcaagttgctcttgcggtagttcgcccgactgtcaccatggagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatct

SEQ ID NO: 39267 - DNA, 446 bp, Zea mays
  Clone ID: LIB3062-039-Q1-K1-B9
gcgaacgaggatcccaagttcccttcacaaactgcaggggggaggcgaacctcgtgcagcgcggcgatggggaagcagggggcgaagaagatgaaggacgagaacaagaagcgcttggacttacttctgcgcatcatcctcatatccaatgttatttacatagtggtgaggatggctataatgcattcatccttcacctggaagcattggattggccttatggtaacatcggccgcatattttcttccatataagcaactcgccagtatggcaaagccagtttactctgataacggagaactactggatggtggcttcgatttgagcactggtggggtttgcgagtatttatatgatgtgatctacatcactgtctttgtgcaattgatgtctatcatttctgaaaaattttggtggacatatttagtgattccagcttttgctgg

SEQ ID NO: 39268 - DNA, 404 bp, Zea mays
  unsure at all n locations
  Clone ID: LIB3062-043-Q1-K1-B7
ggaatatacccggttgctcccccttggatccttgtttgcttcctgctgcctggccttgtctggtccccaaaatcaatccctcgccgacaaaggagagccagccaaatcttccacctcctccatttccagccccgtccccacaccagctcgcgtaacctcctccccatggctggaggcggcggcgcaggcgcaggctcgtcgtccggcggcggcggaggggcggcagggagggcgactgggactgcggcagctgcggcaaccgcaactacgccttccgctcgctttgcaaccgctgcaagcatccgcgcctnctcgtcgaccccaacaccccgcgcgactccaagtggctaccccgcgccgggggactggatctgcaccgcagcaactacttgcaaatgcaaact

SEQ ID NO: 39269 - DNA, 174 bp, Zea mays
  Clone ID: LIB3062-043-Q1-K1-B8
tcttactgcaatatcccccgttgctcctcctatcatctttctccgcttcctacttactatcctaggtaggcttcccacaatcaatcggtggcccacatactacacccaatcaaatcatccacctactccatttccatccccttccccacactaactctcgtaacctcctaccca

SEQ ID NO: 39270 - DNA, 284 bp, Zea mays
  Clone ID: LIB3062-043-Q1-K1-C1
acggttggtagcaaacgctggggactgccgcgccgtgctgtgtcggaaagggactgcggtggaggcgtcgtaggatcacaggccgacatacgacgcagagcgtcaaagggttatcgcgtgcggtggatacatccgaagatgggtacctcatcggcgtactatctgtgacccgggctgtaaggcactgggacatgaatctggccctagagctcttagtaggacattatcgcacagccagagatccactggaccaccctgacggaagactacgagatgctcatcat

SEQ ID NO: 39271 - DNA, 417 bp, Zea mays
  Clone ID: LIB3062-043-Q1-K1-C2
cttggtggaaaggctggtgtttcttgtggacggtttcactatggcagtgcatttggtgagccaagtggtaatgctgacaaggttgcagacataagctctactctaatcaagcatggtttcagctataatggaaaagatttcttgtactcaggcattcttggtcagcctcttgaggcatacatcttcatgggaccaatctactatcagaaactaaagcacatggttcttgataagatgcatgctcgagctagtggaccgcgggtgttactgacgaggcaaccaactgaggggcgaagccgtgatggaggcttgcgtcttggtgagatggaacgtgattgtctaattgcatatggcgcgagcatgctaatatttgaacgtctactgttatcaagtgatccttatcaagtccaggtttgc

SEQ ID NO: 39272 - DNA, 287 bp, Zea mays
  Clone ID: LIB3062-043-Q1-K1-C3
taattatcctttcgacccactcttacacttagtctaaaaccctatctacatcctaaacttactcactatgccaactccttctatgagagaatgtttaaaactcacagtgagacacacctcatatctactctaatcaatcataatctcaactataatcccaaaatatctccattaatcaaacattctttaccaacctctattaacatacatctatctttaaccaatctcctatcacacactaaaccacactttcacaaatataaatccattctccatactactatcac

SEQ ID NO: 39273 - DNA, 339 bp, Zea mays
  Clone ID: LIB3062-043-Q1-K1-C5
gttattctggtgaaaggcacaaagaacaccatcgcggtctctataatacttaggggcgcaggtgactacatgcttgatgagattgaacggtccttgcatgatgccctgtgcattgtgaagagaaccctggaatcaaatatggttgttgctgggggtggtgcagttgaagctgcgctgtcagtttatctggagaaccttgcaacaaccctgggttctcgggaacaattggcaattgctgaatttgctgagtctttgttaatcataccaaaggtactatctgttaatgctgcaaaagatgcaactgagcttgtagcaaagcttaaggcatatcatcatact

SEQ ID NO: 39274 - DNA, 442 bp, Zea mays
  unsure at all n locations
  Clone ID: LIB3062-043-Q1-K1-C8
ccggagcagccgcagtcccaccgaccccgccgccggtcgccctccatctcctcgccggtgcgtctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctnccctgcctgctgcgtgctat

SEQ ID NO: 39275 - DNA, 433 bp, Zea mays
  Clone ID: LIB3062-043-Q1-K1-B6
gcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaagtgaatcaagcccagaagc

SEQ ID NO: 39276 - DNA, 449 bp, Zea mays
  Clone ID: LIB3062-043-Q1-K1-A3
cccacgcgtccgaaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatggtgagcggaggtggcggcggcggtgctgctgcatctggtggtgctgctgccgaggctcccaaggaggagaagaaggaagaggagaaggaagagagcgacgacgacatgggaattctcctgttcgactaggagt

SEQ ID NO: 39277 - DNA, 458 bp, Zea mays
  Clone ID: LIB3062-043-Q1-K1-A4
gaaaagagcaatagatgttatctcagttgatcgcagacagaagagcatctcagcttcgtacatggcatttcttgagagtgaacacatgacagccatcccatgccgctttacgctgcacccgtgcaaagttggccatctggctggtgcaagctctagtggtaaggtgtttctctggaccagagcttgaagcaggctgatcatcgactgactgggatgtcctcggcctgttgctggccctgtcctgcccaagttcctgaccacggagatcctcatctcgcggttctgtactaatgatcgttagcattatcctgcttttaatgtataagggctagtttgagaactctattttttcaagggatttctgtttttttaatagaaaatgaactaatttctattggaaaaataaaaaaatcccttaaaaaaatgaggtggctaaactagccctaatagtttgcact

SEQ ID NO: 39278 - DNA, 432 bp, Zea mays
  Clone ID: LIB3062-043-Q1-K1-A5
caatttggctttttggttctttaacatgtatacaatgctatgttatgttttaggatgtttggcattgtgagatatgcaataggaagccagggcgaggttttggtgggtataattgtcttttaaatatatcctagtagatattttatgtttccatgcgattatgcattattactattcgatgtcatcttaccttttatagaaacaacggttgaggtcttgccacggttgtgccaaatcaaatatgccagtggtacactcgaggagcttctgtatgttgatatgccgagagagtcccagaattcatctggacagattgttttggactataccaaagcaatccaggagagtgtctttgagcaactgcgtgtagtccgtgaagggcatctaagaattgtattcaaccaagacttgaagattgcatcgtgggagttc

SEQ ID NO: 39279 - DNA, 440 bp, Zea mays
  Clone ID: LIB3062-043-Q1-K1-A6
aatcacattgatgcgctcgtgaggctgagcggaattactgcagagggccaaggtgtgaagggggaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccagatggaagggctgctctggggcgcatccaagcttgtcccagtcggatatggtatcaagaagctgcaaatcatgatgaccatagtcgacgatcttgtctctgtcgacactctcat

SEQ ID NO: 39280 - DNA, 465 bp, Zea mays
  Clone ID: LIB3062-043-Q1-K1-A7
attcccgggccttaccagcacacagtggagctagctagctagtagagaggtcaatcaccaatggcgaggcagctcgttgtgcttgctgtgcttttcgtgatcgccggtgtggcgcatggcgcgggggagtgcgggagagcctccgccgacagggtggcgctaaggatggctccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgacccgtcggctacaagtgcggagattacacgctgccctagctgatgaagacgtcgtcaacgagaccgtgcgagtcaagtgcatgaacgaatgccattatgccatgcaac

SEQ ID NO: 39281 - DNA, 429 bp, Zea mays
  Clone ID: LIB3062-043-Q1-K1-A8
cacctcgcttcactagaggaataatctagcatcttctgttgcctccaaattgtccggagaaaggagttgaagcagtgtgagagggccctgatacgatggcgaacctgttcctcaagcaggcaaagcagtacgtggcgacgcggccggtctacccgccggagctcttcgacttcatcgcctccaagacccctcgccgcgacatggcctgggatgtcggcaccggcaacggccaggccgcagcgtcggtcagtcgaccatgcatcctcgctctcccctacacggcacgctgcacacgcactgtccgtgcattatctttataaagtaaaggctggctgggtgaactttcattcaacttgcagctggcgaagctgtacaagcacgtggtgggcacggacacgagcgcgcatcagctcgcctacgcgacgcgcc

SEQ ID NO: 39282 - DNA, 462 bp, Zea mays
  Clone ID: LIB3062-043-Q1-K1-B1
ggtcgaccacgcgtccgcggacgcgtgggcatctggatacgtcgactctaattacaaacatcagaaatatcgagaaggcggtcagagattgcttggaccacgttaagagtacgcggcacatgatcctctattatgaggatataatcagcaacagcaatgcattatcccgggtgcaagagttcctcggggtcccggtgaggaggctgatgagccggcaggtgaaaattcacacgaggcctatttcggaccttgtcaagaactgggaggaagttagcatcaaactgaacgggacagagtttgctcacttccttgatggttcagattatgccaagtgatggacggcaggttattcgcatttggagttgtagttgcaaacatgctttagaattcttttgtacagatgagtttgtaatgagcaaggcataaagacaacagatgacgatcacaagtgcaaatggaatc

SEQ ID NO: 39283 - DNA, 416 bp, Zea mays
  Clone ID: LIB3062-043-Q1-K1-B2
cccaattctaagcgagacggggcacaggaagaggagagcctaaaaccctaaccccccgaatgggatccggccgccggagcgcggaaccccaccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaaccggccccgacagcctcaagcttcttgaagatgcggaagccaaactggaagaggcacttcaaattgatcccaacaagtccgatgcactctggtgcttgggaaatgctcagacctctcatggattcttcactccagacaatgcaatagctaatgagttctttac

SEQ ID NO: 39284 - DNA, 421 bp, Zea mays
  Clone ID: LIB3062-043-Q1-K1-B3
cacatccctcgagaagactcctgctcctcgccgatcgatacgatggccgtcttctccgacctccacaccgccgacgggctcaagtccctcgaggctcacctcgccggcaaaacctatgtgtctggtgactccattactaaggatgacattaaggtcttcgccgcggtgccgtcgaagcctgtcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgacgatgatgatgaccttgatctttttggtgatgaaactgaggaggacaagaaggcagctgatgagcgtgcctgcgctgccaaggcctcttctaaaaagaaag

SEQ ID NO: 39285 - DNA, 370 bp, Zea mays
  Clone ID: LIB3062-043-Q1-K1-B4
ctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaagcggcggtggcggatacggtggc

SEQ ID NO: 39286 - DNA, 409 bp, Zea mays
  Clone ID: LIB3062-043-Q1-K1-B5
catcaaccagaggtccatggacggtgccagggactccgagatcgccatgggcgcgtaccaggcgtaccacttggcgactaggcagcctgcccggggccagatccatggcttccggatgtctctttggtacgagcacctgggaatgctggaagacgtcttccagcggcccgagagcgtagagtgtgtgcagatggtgaacaaggtcgccgagaagtactgggacctgtactcgagcgacgacctggagcaggacctcccgggccacctcctcagctacccgatcggtgtcactgccgacggcagcgttaccgagctgcccgggatggagaacttccccgacacccgcgcccgcgtcctagggaacaagtcggattacctttccgccatcctcaccacatagagtgcacac

SEQ ID NO: 39287 - DNA, 436 bp, Zea mays
  Clone ID: LIB3062-043-Q1-K1-A2
caaacaaacagggtagagggagaggagaggagaggagaggagaggttgggtctgggacaccgtggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttggggga

SEQ ID NO: 39288 - DNA, 145 bp, Zea mays
  Clone ID: LIB3062-042-Q1-K1-G3
aatgaaaacatcaaagcgcctgtcaataacactcatgacccatgtcgccttcaaggcgctgaccatcaaccccttcggcgagctcttcagcgaccgcttcaccgacatcgatctgatcaccatcatcgaccgcaaggccatgttc

SEQ ID NO: 39289 - DNA, 467 bp, Zea mays
  unsure at all n locations
  Clone ID: LIB3062-042-Q1-K1-G4
ggcctctgcgttcgagatcgatctgagctggcaccgtcccacttcgccatggcggaggaccggagccccaagcccatccactgcaaagcggcggtgtgcagagccgtcggcgagccactcaccatcgaggagatcgtcgtcgacccgccgaaagcgtacgagatccgcatccgggtcgtctgcacctcactctgccacaccgatatcaccttctggaaagctaaggtggcaccggtgtttccaagaatactagggcatgaggcgtacggngtagtggagagcgtgggggagcacgtggagggcttcgcggcgggggacaccgtggtgccgacgttcctggggcagtgcgagcgctgcgccagctgcgcgtcggagcacagcaacgtgtgcgacgcggtgccgttcgtcatcggccccgggatgcggcgcgacggcaccacccggttccgggacgcgccggggagccc

SEQ ID NO: 39290 - DNA, 336 bp, Zea mays
  Clone ID: LIB3062-042-Q1-K1-G6
tcgacccactcgtgctatcctttgcgttcaatatccatcttagctttcaccgtcccacttctccattccgagcgtcgggagcccgattcccatgcactgcaaagcgtctacgtgcatatccgccggcgatccactcaccatctatgagatcgtcttcgaccctaccaaagcgtactatatccacatacgattcgtctgcacctcactctgccactccgatatcaccttctggaaagctataatggcaccagtgtttccaagaatactatggcatgaggctttcaggatattggatatcgtgctagagcacttagaaggcttcgcggctaggtacac

SEQ ID NO: 39291 - DNA, 416 bp, Zea mays
  Clone ID: LIB3062-042-Q1-K1-G7
aattcccgggctgggcctcgtctcggccaggaagaccgccgaggcgatcgacatcctgaagctcatgtcgtccacctacatcgtggcgctgtgccaggccgtggacctgcgccacctcgaggagaacatcaaggcgtcggtgaagaacaccgtgacccaggtggccaagaaggtgctgaccatgaacccctcgggcgagctctccagcgcccgcttcagcgagaaggagctgatcagcgccatcgaccgcgaggccgtgttcacgtacgcggaggacgcggtcagcgccagcctgccgctgatgcagaagctgcgcgccgtgctggtggaccacgccctcagcagcggcgacgcggagcgggagccctccgtgttctccaagatcaccaggttcgaggaggagctccgtgcggtgc

SEQ ID NO: 39292 - DNA, 393 bp, Zea mays
  Clone ID: LIB3062-042-Q1-K1-G8
ctcgtatctgccaggacgacagtataggccatcgacatatttaagctcatgtcatccacctacatcttggcgcataggggagccttttacctgcgccacctctttgagaacatcaaggagtcgttgaagaacactgagacccaagtagacaataaggtactgaccatgaacctcctagacgagctctccagcgcccgcttcatcaataaggagctgatcatcaccatctaccgcgatgacgtgttcacgtactctgaagacgcgctcagcgccaacctgtccctgatacagaagatgctcgccgagctcgtggaccactccctcatcagcgacaacacggagcgctagcccttcgtgttctgcaagatcatcagcttctaggaggatctacac

SEQ ID NO: 39293 - DNA, 262 bp, Zea mays
  Clone ID: LIB3062-042-Q1-K1-H1
gcaccacagtcaacaccatggccatgtctacccttagtcacgccgaccaatagcagcaggacgggcggtcttagaccatgagcaacgtctacgacaacatctaggcgccctactacaacaccgtcaactacgtcagcaacaaggtcctgatcatgaaccccctgctcgaccgtctcacgctccgcctgaccctcaacgacctcatgcgctacctgctccgccacagcctgctcacctactctgatgacgcacacagcaacag

SEQ ID NO: 39294 - DNA, 444 bp, Zea mays
  Clone ID: LIB3062-042-Q1-K1-H2
gcgcgagagtcgacaccatggccatgtcgacgcatgggcaggccgaccagcagcagcggcacgagcggtctgagcccacgaccagggtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgcagccgccgcgccggctctgttggtggacagggcaacggcagcggcgtgctgatgccgtcggacgacccggctgagaagccctctgtggaggtggagctgcaggcgccgtcgcccgccctgctggtgtactccgccgtcgggacgacgctggcgggcgccgcggcggagtgcgccatctgcctcgccgagttcccagacggggacgccgtgcgcgtcatgc

SEQ ID NO: 39295 - DNA, 437 bp, Zea mays
  Clone ID: LIB3062-042-Q1-K1-H3
gcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactgcgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagtta

SEQ ID NO: 39296 - DNA, 438 bp, Zea mays
  unsure at all n locations
  Clone ID: LIB3062-042-Q1-K1-H4
aaaatgcagcagagaagggaatgcaagccagtgacctacttctagcaaaagcctggttccagagcactcaaccaatgactagaagtcgttcgtcagagttaaggaggaggtatgctgcgatgcaaactaatatggcaccaataacaataggaagcattgaaacacctaaccaattaaaacaagattttacaaacacaacaaacatcacaccaatgagcaacacacttgttcatacaccaaagtttgtatctccttcaagttcatcaacatcccctctggataatccacatgtggcagcacaagatactgttacctcagtggtgagcatgctcaaggacacacttgagcgcaagaagcttggtagccatgctaacaaagacacctnagcaagcaattcttttggattctatgacactcagcagtttcaacaaaacattc

SEQ ID NO: 39297 - DNA, 395 bp, Zea mays
  Clone ID: LIB3062-042-Q1-K1-H5
tccctttccaacacagcatcagcaagaggttatagtattcacaccttgacattgtcggaagacgatttgttgtcttggagaaacctgatgttattccagagcataatttgtatttccaggtttactacagattcaacaacatatccttgctcagagagccgttgatgctgattactggtttcttcctcctgtttgtggcctgtattgtttacatgcgtactgatatgtcaatatccaagagctctccttgctacttggccaagctgcaatgggatgaggtgcaagcaactgttcagaaaatccagggtatctttgagcaatgcttagcagttcatgataaactggaggcctcattgcgggatttgtctaggacaggtgacattcagtctttcaag

SEQ ID NO: 39298 - DNA, 251 bp, Zea mays
  Clone ID: LIB3062-042-Q1-K1-H7
aactgacatctccccgcatccaataagcttgtctcatctcagctcagttggttcctacattgtgagtggatgactgactgtggggctatgctgatggggttccacatgaggtactcggagacgcccaagctgctgatggaccttctcttcctcctcaaccacctgcgcaaggctctgctccttggctgctcatcctctcgtacgcctccgacgcctactccgacactgactctcactacactggtcatcct

SEQ ID NO: 39299 - DNA, 345 bp, Zea mays
  Clone ID: LIB3062-042-Q1-K1-H8
acgcaaaagcaagagagaacggaatgcaagccaattacctacttttatcaaaaacctgggttcacgtcacttattcttatgactataaggcgttcgtcacaactaaagaagaagtatgctgcgatgcaaactaatatggcaccaataacaatacgaaacattgaaacacctaaccaattaaaacaagattttacaaacacaacaaacatcacaccaatgagcaacacaacttttcatacacccaaatttggatcttcttcaaattcatcaacataccctctggataaatcacatagtgcaacacaagatactgttaccccaaaggtgaacatgctcaaagacaca

SEQ ID NO: 39300 - DNA, 433 bp, Zea mays
  Clone ID: LIB3062-043-Q1-K1-A1
gtcataatctagtgttcattggtcatccaatggaatatcataatctattattcattggtgagtcaagggggaatgcgttgtttggtggtttcttctctttgcacagttggttgctttaataaaagctgtacagttcggggcttcccttgcttaaacactattatgtttatgaattatgatataactcttgcttattcccttggctgacatctttttgtaattgctgcagtgggatactgctgggcaagatcgcttcaggacaatcactagcagctactaccgcggagctcatggaatcattgtaagttggccacctgaactagcaacttctgaaatttgtcaaccatattgatcatattacattattggctcattgctggctttcagattgtatatgacgtgacagacccagaaagcttcaataatgtgaagc

SEQ ID NO: 39301 - DNA, 390 bp, Zea mays
  Clone ID: LIB3062-042-Q1-K1-G1
gttggcttctcctccccctccggttcgggttcgggttcgtgaggttctccggggtggggttgcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtgga

SEQ ID NO: 39302 - DNA, 383 bp, Zea mays
  Clone ID: LIB3062-052-Q1-K1-A6
attaaatattatggaccggttcgcagtgtttttctgtttctgcctttcactcttgtttgcagcagttcccagttggtgtagaactagtacctagttttgatagttgctagatgatgctatgccatatcttgttatggctactaactccattggttttgaacagaaaaggagaacttgtgcctctatggctatcccgatgagacatgggaggttaccttgccagctgaggaagtgcccccagagatccctgaaccagcattaggaatcaactttgctagggatggcatgaatgagaaggactggctggcgctagttgcagtccacagtgattcctggttactatctgtcgcattctactttggtgcacggtttggatttgacag

SEQ ID NO: 39303 - DNA, 410 bp, Zea mays
  unsure at all n locations
  Clone ID: LIB3062-052-Q1-K1-A9
ccagtatgctttgcatggtggctggagggatatgactatatgagtttacctatatattatggactatccttgttggcgtattgttttattaacgattatatttagccagttataatccgttaggtgagcagattgtttgcttgggttaccagatctcggtagccagtgggtgcggttccaggtcttctgttgatgacttatcacaagatgtgcttgtgattcccgtgtatgaggaattgcgacatcgtagaggcgtaggctatgttcagtagatcgtgccttgcctcgtgtataataatacntgtttgtatcgtagacaatattggttacagagatgatgatgagtaagcttgtggacataagcagtgccttatatcacggttaggttttggcctttggttcgttgggtt

SEQ ID NO: 39304 - DNA, 415 bp, Zea mays
  Clone ID: LIB3062-052-Q1-K1-B1
gaaggatagctatctgtatttttgatgatgttgcagagcaatgccgtgaatcagctgtgaagtattatgacacataccttcctttccttttggaggcatcaaacgatgaaaattcagatgatcggcaggctgctgtctatggtgtgggtgtatgtgccgagtttggtggtcatgtttttcgccctctagtaggagaggccttatcaaaattaaacaatgttataaggcatcctgatgcacgacttcctgataatatcatggcatatgacaatgctgtttcggcgcttggaaaaatatgccaatttcatcgggatggtattgacgcagctcaggttgttccagcctggcttagctgcttgcctataaaagacgacaaggttgaaactaaagttgtacatggacagctttgctccat

SEQ ID NO: 39305 - DNA, 310 bp, Zea mays
  unsure at all n locations
  Clone ID: LIB3062-052-Q1-K1-B11
cactagtggagattgtgagaaggattgatagtaaacctcattatatcattgcaaagggaggaatcacttcatctgatattgctacaaaggcgctggaagctaaacgtgccaaagtcatgggacaagcattagctggtgtacccttgtggcagcttggtcctgagagtagatttcctggggtcccttacattgtttttcctggtaatgttggtgataacagtgctcttgctaaagtggtgaaaagttgggcttccccatctagaagttctacaaaagaaattcttcttgatgcggaaaagggcggntatgc

SEQ ID NO: 39306 - DNA, 430 bp, Zea mays
  Clone ID: LIB3062-052-Q1-K1-B12
cgcacccttgcggattacaacattcagaaggagagcaccctccacctggtgctgcgcctcaggggaggaatgcagatcttcgtgaagacattgactggcaagaccatcaccttggaggttgagagctccgacaccattgataatgtgaaggccaagatccaggacaaggagggtatccccccggaccagcagcggctgatcttcgccggcaagcagctggaggatggtcgcaccttggctgactacaacatccagaaggagagcaccctccatctggtgctccgcctgaggggcggtatgcagatctttgtgaagaccttgactggcaagaccataaccctggaggttgagagctctgacaccatcgacaacgtgaaggctaagatccaagacaaggaggggattcccccagaccagcagcgtctgatct

SEQ ID NO: 39307 - DNA, 390 bp, Zea mays
  Clone ID: LIB3062-052-Q1-K1-B2
cgtcccgctcgtgctcccgctgcgctgccttggcgccgcacgctgcgctcccgctcgcctctctcctcgccccctcgccctctgccgcgcgccctcgatccgcgcccctctcgtgcgcagctcggccgtgcaggggccacgcggcggcgtcagcgttgcacggcgcggcagggcggaggcccccgagcgtggcggcgatgtcgtcgtcgacgccgccgccgggatccgtgcagaagtcggaagaggagtgggaggccatcctcacgccggagcaggtcaacatcctacgcctcaaaggcaccgaataccctggaacgggtgagtacgacaaggttcttgaggagggcatttattaatgtgctggatgtggaaactccctatacaaatcat

SEQ ID NO: 39308 - DNA, 405 bp, Zea mays
  unsure at all n locations
  Clone ID: LIB3062-052-Q1-K1-B3
attccactccgacattcacgtgcagctgtcgggagcaggcaatggcgccggatctaagcgaactcgccgncggcgctgcagcccgtggcgcctacctcgccggcgtcggtgtcgcggtcctcctcgctgcctccttgctcccagtagccgagtcgtcctgcgtgcgagataactcattggtgagagacataagccaaatgccgcaaagcagctatgggattgaaggattgtcacatataacagttgctggtgcgctcaatcatgggatgaaggaggtggaagtgtggcttcagacaataagtccaggtcaaaggacgccgatccacaggcattcctgtgaagaagttttcactgtcctcaaagggaagggtacgctctngatgggatcaagctcactaaagtacc

SEQ ID NO: 39309 - DNA, 361 bp, Zea mays
  Clone ID: LIB3062-052-Q1-K1-B4
cggacgcgtggccggccccgtgggttggaccactgcaattaaaataccaaagaaccagtatgtatgaccagcacccaaatgtaccaccaccaacaatttaaccatgacaccagaccatatgtatatgaaaggttcccccggtacactctttattcatccttgaacacaaaatctagacgccgcctctcaccctcgggtgtaaaaccaatgagccagacatgatctcacaatgccaactaaaaatcacaatatctgagtacagttatgatcatcatattctattagcccatatttccaagaagtcgctccactgcagcatgaacattttcagcggtagcggccaaaggctcgggatgttctc

SEQ ID NO: 39310 - DNA, 419 bp, Zea mays
  Clone ID: LIB3062-052-Q1-K1-B7
ggccaggacgtcgccgtcaaagtcatccccaaggccaagatgacaacagctatcgccattgaagatgtgagaagagaagtgagaatactgagttctctggcaggccacagtaacctagtgcagttctacgatgcttttgaggatgaagataacgtgtatatagttatggaattatgtaaaggaggtgaactgctggacaggatattagctaggggtggaaagtactctgaagaggatgcaaaggttgttatggtacaaattttgggtgtcgtatcattttgccatcttcaaggtgttgttcatcgtgatctgaagccggagaatttccttttctcttcaaaggacgaaaactctcccttgaaggtcatagattttggcctgtctgactttgtgaagccagacgaaagactaaatgatat

SEQ ID NO: 39311 - DNA, 388 bp, Zea mays
  Clone ID: LIB3062-052-Q1-K1-B8
aggaaggcaaggcgtgatgccctcaaagaatctggacaaagttttgagacgagttctgttgctgcatcaattgatagcgataaagttctctctgaaaatggagggttggagcatggtctgacttcaacaggtggcctctcttctgtccctgagaaaatcagtgcaagttctgatggtcttgaacttcaagcagatgatgaccctgaaattgttggagaacagttgcattctgaccagctatcttatggtgatgatactgatacatgcaccaaagaattggataaactagatataaaaagtgaggatgagggaggtgacgatgcacattccgtagactatgagagcagtgagcagagttgggccctgaggtctttatctgaatcaacta

SEQ ID NO: 39312 - DNA, 294 bp, Zea mays
  Clone ID: LIB3062-052-Q1-K1-B9
cgttcgtatccttctctcgtcttcctctccttctccaattcctctccgagagcttctagtctagcactccgttaacaatcgagtaatccacggcgcggcagtaatgtacttatatgtgctaccaggtagtgagcagacgaaggctcggcagctgagcgacgggcaggcccggaagcggcggctgagcgacgggcaggcgcggttcctggagctcagcttcgggaaggagcggaagctggagacgccccgcaaggtgcagctggccgccgagctgggcctcgacgccaagcaagt

SEQ ID NO: 39313 - DNA, 384 bp, Zea mays
  Clone ID: LIB3062-052-Q1-K1-C1
cgcagttccccgaccacaccgttccttcgagcccaggagcagccccgcgccaggaggaagtttgttcttttaacaatatgtcgagggaggagaatgtttacatggccaagttggctgatcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttga

SEQ ID NO: 39314 - DNA, 444 bp, Zea mays
  unsure at all n locations
  Clone ID: LIB3062-052-Q1-K1-C10
ggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagattgggcaacggcagcggctcagctcgtcaagtttgtgctgggatgccagtttatcccttctagtctattacagaaatgttgntcggagctgagtctattataaacatcttggtcttgagttattggtgagtggtgccaagttttttcaatat

SEQ ID NO: 39315 - DNA, 341 bp, Zea mays
  Clone ID: LIB3062-052-Q1-K1-C11
ggccatactatcctggtccatgctgctgctggtggtgtcggctcactcctttgtcaatgggcaaacgcccttggtgccactgtcatcgggactgtttccaatcaagaaaaagccgctcaggcagctcaggatggatgccaccatcccataatttacactagcgaggatgtcgtcgcaagagtcaaggatattacatcaggaaaaggtgtcaatgtcgtctatgattctgttggaaaggatacatacaaggcttccctggagtgcttggcgtcccgcggcttcctggtgtcgtttgggcagtcgtcaagcaaacctgacccaatcccaacgagcgacctggc

SEQ ID NO: 39316 - DNA, 429 bp, Zea mays
  Clone ID: LIB3062-052-Q1-K1-A5
ggacgccatcatcagcctccacgagcagctcggcaacaggtactttttactcacgccgctgttctttcccttcgtcctcgcattgctgtcttctcgggtgtaaaaatcagaggatcaatgattgtttgcttgttgcttcaaacgcaaattactattcgtcttcgtcttctcccctctctcctctgaattgttcctgtcagtggggcagggcatacaatacattatccccgtgggccccgcctcgaggcccgcccgacgaagggagaaagaaagaaaatccaagtgtgctggccacttggtcgctagtatagttcagcttgttcgctgcggcttgctgcggctgcaatccggctgcggctgcggcttctacagtatttttctctctatggattgcagctgcagcagttcaaacagctggcacagtgtcgg

SEQ ID NO: 39317 - DNA, 227 bp, Zea mays
  unsure at all n locations
  Clone ID: LIB3062-052-Q1-K1-C12
aggcaggcagccatcacgatggcgctggcccacctncccttcggcctcctgttggtggcgtccgtcggcggtttcggcggcggcgaccacgggcttacgcacattcacctgtacgtgcacgagacgtacaccggggcgaacgccacgggcggcggcgtgctggagtccccggttggcgccaacttgtcggtcgggagcatgggcctggtggaccaccagatacccct

SEQ ID NO: 39318 - DNA, 355 bp, Zea mays
  Clone ID: LIB3062-051-Q1-K1-G8
acggacttcgacggccgcaacatcgtcgactccgagaagctgatggagatcggcgttcatcgtctactccatcggcaagccgatcgacgcctggctcaaggacatgcccgcggtcgcctaatcgcaccccatttacccatggatcggattccgggaaggaagaggagagaagctggttgaccgctctttattacagttagtttctgcaggctacgctacgcgattatgtatagtgtcaggcatgaaaaacggttcggacggactgctagcattgcctgctgctcggtgacctcgtgtcggaggacgtctgtcgatgtacaattacttcagccccttgtgttcggctagaggaagt

SEQ ID NO: 39319 - DNA, 383 bp, Zea mays
  Clone ID: LIB3062-051-Q1-K1-G9
ggacgcgtgggtcaactttgatctattctctgccaccaaagagatggaaaaacagggatgtgatgagtttgactttgtgcgcgaagcaagagcaatggaaagaatacgagaatttctacgtgtcactaataagaaacctccggttatggtgcctcgtgtgattcctgggatggttagcagagaagttttgataatggaatttatcaaggggaccccaataatgaatcttggcaatgaaatggctaaaaggggcatagatcctggtggtaagattgcagcaatggcaaagcagaagattttgtcagatcttactcttgcatatggtcaaatgatcttgaaagatggctttttccatgcagaaccacacccaggaaacattctta

SEQ ID NO: 39320 - DNA, 401 bp, Zea mays
  unsure at all n locations
  Clone ID: LIB3062-051-Q1-K1-H1
ctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctncctcagcctctcgcttcccggcacggaccagcggttccaccacgaccgcgcccacagccagttccaggagctcccggcgtc

SEQ ID NO: 39321 - DNA, 250 bp, Zea mays
  Clone ID: LIB3062-051-Q1-K1-H10
acggcaacatggtatatggagctagggtttgcaggcgccgccactcgagctgcgacttgcgcgtgtgatgaagaatgctgtcacccagtctagcccggagcctgagcaggaaaccgtggtggagaagcgcgtggaggaggcggatccatggagcgcatctcggcggtcggtcccctggcagttggcgtgtcgagctcatccgcgcgtcctctactcgtccgcgcctgtgtcggtcgtcgttcccgttctt

SEQ ID NO: 39322 - DNA, 357 bp, Zea mays
  Clone ID: LIB3062-051-Q1-K1-H11
atcagtcagaagactttatgttcagggcaaagagatcaatggtgctggtatcaatgctagctttgctgttcaccaggatgttgatggaagggcaacagatgtagctctagggtggtcagtagctttaggttctcctttcacatttgctactactctagagcaggagtaccggagtgacatttttggcgagcgaggtattttgcttggtgctgtccatggcatggtggaggctcttttcaggagatacacagaacaaggaatggatgaggactcagcatataagaatactgtagagagcatcactggaattatatcgaaaactatttcaaagaagggtattgctggaatgtataactc

SEQ ID NO: 39323 - DNA, 420 bp, Zea mays
  unsure at all n locations
  Clone ID: LIB3062-051-Q1-K1-H2
ggaacttttcctccaagcatcaaacttccacttgctctaaatttgaggtcacaaccagtggcggttggcagcatgatatacttcatgtgcgcagaaccagatggtgttttgtcatatgatgtaagcaccgggatttggaggcaatttgccatcccactgccactgcatctgactgatcacacacttgccgagttccagggaagggttatgctggtgggtctgctgtgcaaaaatgcagcgacctgcatctgcatatgggagttgcagaagatgactctcctctggaaagaggtggacagaatgccaaatctctggtgcttagagttctacggtaagcacatgaagatgaaatgcctgggcaacagtggtttgctcatgctctccttgaaggcgaagcatatgaaccgncttgttacatac

SEQ ID NO: 39324 - DNA, 438 bp, Zea mays
  unsure at all n locations
  Clone ID: LIB3062-051-Q1-K1-H3
gccacgctcatcgcgctcgacctcgtcaacggctacttcaggacgcacgccgggcaggtggctctggtgatgacgtcggagtcgatcgcgcccaactggtacgcgggcaacaagcgcaccttcatgctgggcaactgcctgttccgctccggcggctgcgcctacttcctgaccaacgacccgcggctccggccgcacgccaagctccgtctccgccacgtggtgcgcacccacacgggcgcctncgacgaggcctacaactgcgcgctccagatggaggacgaggccggccgcccggggttccacctgggcaaggagctgccgcgcgccgcggtgcacgccttcgtgcacaaccttcgcgtgctggcgccccgcgtgctgccgctcccggagctgctccgnctcgcctgcgccaccctctcggcgcgcctggcgcgc

SEQ ID NO: 39325 - DNA, 446 bp, Zea mays
  Clone ID: LIB3062-051-Q1-K1-H4
cctccacattgttcttcatgcagcaaaagccttagagtatctccatgacacctgtgaacctcctgtagtacaccagaattttgaaccagccaacgtgctcctcgacaatagatgctcagtgcgtgttgctgaatgtgggctggcacaattgatggcgtctggttctgttacacagctatcaggccgtatgagagctctactcaattatgaagcacctgaaatccatgaatctgagccttttactcgtcaaagcgacgtatatagtttgggtgtggtgatgctagaacttcttactggtcgtaagccatatgacagttctcgtccacgtgatgaacaacatcttgttcgatgggctaattctcagcttcatgacatggagtccctgtcaaagatggttgatccttctatccgaggagagtgttctgtgatactggtgtcacgttttg

SEQ ID NO: 39326 - DNA, 93 bp, Zea mays
  Clone ID: LIB3062-051-Q1-K1-H5
acgtgattcaatgctgcatgtgcatctaccagtggtacttgtgtatatgattttttgtttatactacggttgtcagcgtgctcggggaaggct

SEQ ID NO: 39327 - DNA, 266 bp, Zea mays
  Clone ID: LIB3062-051-Q1-K1-H6
ccgacgcgtacgagtactatttctccaagcatcaaactttcactttctctaaatttgaggtcacaaccggcgggggttaacaccatgatagactgcatgtgctcacaaccagatggagtattgacatataatgtaagcacctgaatttggactcaatttgccatcccactgtcactgcatctcactgatcacacacttgccgagatccatagaaaggttatacatatgtgtctgctgtgcatatatgcatttacctgcatatacat

SEQ ID NO: 39328 - DNA, 387 bp, Zea mays
  Clone ID: LIB3062-051-Q1-K1-H7
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggctgcggcggcggcgggtacggtggtggccgt

SEQ ID NO: 39329 - DNA, 400 bp, Zea mays
  Clone ID: LIB3062-051-Q1-K1-H8
ggaatacccaccgacgcctacgcgtccacattgttcttcatgcaccaattgccttagagcatctgcatgacacctctgaggctagggtagttcaccagaatggtgaaccagccaacgtgctcctcgacaatagatgctcagcgcgtgttgctgaatgtgcgctggcacaattgatggcgtctggctctgttacacagctatcacgccgtatgagagctctactcaattatgaagcacctgaaatccatgaatctgagccttttacttgtcaaagcgacgtatataagtttgcgtgtcgtgatgcttgaacttcttactgagtcgaagccatatgacaagttctgttcacgtgatgaacaacatctctgttcatgggctaattctcagcttcatgacatgg

SEQ ID NO: 39330 - DNA, 381 bp, Zea mays
  Clone ID: LIB3062-051-Q1-K1-H9
gcaggaaagggctatccagatactacgacggcaagtcccagtcgttcgcgtgcatgtccgaagtgaggtgcctggaagatctgcgcaagaaagagacgccctacaagaagatcaagacatcaaggagtagcgtcgcgttagacgaagagcaggactgtcatacgccggccggtcgtaccaacaggaaaacggcccggaagtggtggcccaaacttgtgggttcggaccaacggcaaaaacatgctgtacagacttcccccagtccctgtaacacaaaagtggataccgtcagtaggctttaggacatgactggatgatatctatccagggtttcacctttgggtttttttccttctccatttttgagggattttgttgaca

SEQ ID NO: 39331 - DNA, 329 bp, Zea mays
  Clone ID: LIB3062-052-Q1-K1-A10
cgacccacacgtccgacagtatgctatcgcatggagttacggtttgacatcactcatatcgagtgtaagggatgggtggacttggagtcgacgattgtcaagtaccgagtataatgaccagatatatccgaaggtgaacgccttgttggctaggcataccacatctcttatgacagtgggccctgttgcaagtgctctgctacatactacatccaagatgggctacataggcccaagtttcaggtgctgatatcttaaacaaaatcaatgctatggtcgagtgaaactctctaatctattccatcatgaaactgtgttggataatatac

SEQ ID NO: 39332 - DNA, 272 bp, Zea mays
  Clone ID: LIB3062-052-Q1-K1-A11
gcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatggccgcccagccgtgct

SEQ ID NO: 39333 - DNA, 244 bp, Zea mays
  Clone ID: LIB3062-052-Q1-K1-A12
cccacgcatccgatcaaacacattcaatatacccgatattaccgtaccactacaacagccagttctaacgcgatggctcacaactcggactcgaacccatctgcatatacaccgacaaacgatgaaaaagcccctaacactactgaaggtcatatacccaaatccgaaactctcctgcacgactgtaagtcctcctgcaaggacgcctgctagtataacagcaagaataacgcccataagctca

SEQ ID NO: 39334 - DNA, 223 bp, Zea mays
  Clone ID: LIB3062-052-Q1-K1-A2
gatgcgtcaaagaagaaagtgcttgattaagcacagagctttatgtggaacattggcctaacccagcagggttgaatatatggctggaggagccacccagaactttatcagggttgcccaagggatgcttaaaagtagtggtgcaacaagttacatgggatgcattgggaaggacaagtttggtgaggagatgaagaaaaatgctcaagctggacgagttact

SEQ ID NO: 39335 - DNA, 320 bp, Zea mays
  unsure at all n locations
  Clone ID: LIB3062-052-Q1-K1-A3
cgacctacgcgtacgacttccaagagttctgtgcagcagcagttagtgtgcatcagcttgaagcattggatagatgggagcaacatgcgcgatctgcttatgaatattttgagaaggaaggcaaccgatctatggttatagatgattnagcttctgaattgggcctcagtccttcagtgccactgcatgtcgttctgcaagattggatcaggcatacggatgggaaattaagttttcttggatttgtcaagttgttgcatggcatgtccagcaggtccctgtcaaagatgagatagcttgcgataatctctaacgacagc

SEQ ID NO: 39336 - DNA, 444 bp, Zea mays
  unsure at all n locations
  Clone ID: LIB3062-051-Q1-K1-G7
gagtggtcttatagatcatattggaatcgaacctttgatgatggaagctcttgagaagattgagaaggatattaagaaaccactcttaaggagtgactagaagaacatggccacccttatggcagagtttgacaagattaacacaaagcttggcattcggaaggaggatcttcctaagatcgagaaagaacttgaattggagattgccaaaagtgagctgactgaacttaagaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattntttttcttttggttntggtttcaagttgatcggtgctgtaagctacacctatga

SEQ ID NO: 39337 - DNA, 460 bp, Zea mays
  Clone ID: LIB3062-051-Q1-K1-F2
aactgacgactaccttgatgtcactgatgtgatgcgaaggcttctcatcgcacagcatcgagaagctcctgcgctcttcaagcatgaaggcacctactatatggtaacgtctggctgcacaggctgggctccaaacactgcgctggctcacgcagcaacatcagtgatgggaccttgggagacgctggggaatccttgtgtgggagggaacgaggtcttcagatcaacaacgttcttctcccagagcacatttgtcttgccggttccagggctgccgggctcattcatcttcatggctgatcggtggaacccatccgatcttagagattcgcggtatgtctggctgcctctgacgatagggggagtccctgatgaagccgcagactatagcttcatgttccctctctggtcccgggtgtccatctactggcacaaacggtggcgtctccctgaggagtgg

SEQ ID NO: 39338 - DNA, 324 bp, Zea mays
  Clone ID: LIB3062-051-Q1-K1-F3
ctcactgctgtgacacgaaagcttctcttaccacatcatttacaagctcctgcgctcgtgaaacatgaatgcaccgactatatattaacatctgcctgcacacgctagcctccaaacactgcgctacctcacgcatcaacatcattcatgggaccttgatatactctcctcaatccttgtctggaacggaactaggtcttcatatcaacaacgctcttatcccacagcacatttgtcttaccatttccagcgctaccgctctcattcatcttcatcgctcaccatctgaacccatcctaacttaaagactcccggcatgtctta

SEQ ID NO: 39339 - DNA, 443 bp, Zea mays
  Clone ID: LIB3062-051-Q1-K1-F4
agcaaaagctgctggtgcttctcgagttattggcattgacatcgacaataaaaagtgtgatgttgcaaagaactttggagttacagaatttgttaacccaaaagagcatgacaaaccgatacagcaggtcctggtcgatcttacagatggcggcgtggattacagctttgagtgcattggaaatgtttcggttatgagggctgcactggaatgctgccacaagggctggggaacctccgtcatcgtcggcgtcgccgcctctggccaggagatcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacatcaacgacg

SEQ ID NO: 39340 - DNA, 436 bp, Zea mays
  Clone ID: LIB3062-051-Q1-K1-F5
ggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgacgtgagga

SEQ ID NO: 39341 - DNA, 441 bp, Zea mays
  Clone ID: LIB3062-051-Q1-K1-F6
cgtcaggacccggaccaaaccaatcaggcggctcgggcgcggcggcgacacagggcgaggaggccggacgttggggggaccggggctcgacgccagccgtggatcgcgtgcggagggggacaagcgtctgcctcatgtcccgcgacggcggggaatagggcgacggcgtcggcggcggggatcggttgcggcggcgtgacgaggcggctgcggcggcggctcgggagggaggcggcaccatgtctgcggtagtctgtggcaagaggtcctcctccatcttcgccgacgagctcctcccgccgtctccttcctcccctcactcctcccaccagccggcggccaagaggtcccgccgctccccctcgcaccgcggcggctccgacggactccgaccggaggcgctcgtcgactatctacttgccctcttccccgacatggatc

SEQ ID NO: 39342 - DNA, 439 bp, Zea mays
  Clone ID: LIB3062-051-Q1-K1-F7
gaaaaactggatcaaggcaatggccatgacagcatcacttttcccatttatgtgctgtggaattggcctggtgcttaacactattgctattttctatggatcgttagctgccataccatttggtacgatggtggttgttttcatcctgtgggccttcatctctttccctcttgcacttttgggaactgttgttggtagaaattggagtggtgctccaaacaatccctgtagggtgaagactattcctcgccctattcctgagaagaaatggtacctcacaccatctgtcattgcgcttatgggaggactgcttccttttggtagtatctttattgagatgtactttgtcttcacatcgttctggaactataaggtctactatgtttacgggttcatgttgctggtctttctgatactcatcattgtcaccatatgtgta

SEQ ID NO: 39343 - DNA, 444 bp, Zea mays
  Clone ID: LIB3062-051-Q1-K1-F8
cctagatggtgttgtcgaagtaatagatgaaatacctgatgaagtgagtgctaagaagccagcagttatcagagtaccaaaccgtgtgactgaaagcttcatcatggacaccatccagcccatctttaaaaaaaacaagtacttaagacttgcggtcattttctcttcagtaagtttaaggccaaaggagacgagtaacaaggacttggatgcgactgcttgccttgcaatgttcagtggcctcgaactgaagcatgaatattctgaagtcgccagaaaaatgttggataggcttcaagaattaagcaagaaatcagatgggaaggtcttggcaatcgatttgcggaccgacttgctggaaaagaagagttgcaagacaaccagtggcgctcgaagaaaaggctgctataaccctaatgaggtcctggctttcctgaggagtgt

SEQ ID NO: 39344 - DNA, 358 bp, Zea mays
  Clone ID: LIB3062-051-Q1-K1-F9
gacatgcccatcagggacttccgcaacctggagagcaagggggtggcgttccccaagagccagccgatgcggctctactccagcctgtggaacgcggacgactgggcgacgcagggcgggcgcgtcaagacggactggtcccacgcccccttctccgcctcctaccgcgggttcaaggccgacgcttgcgtcgccgtcgcgggcggccggacccgctgcggcgccaccgtcggcaccgagggcaccggcgcccccgcctccgccgccggcgccggggactggtacaaccaggagctggacctcaccctgcagcagcggatgcgctgggtgcagcgcaagtacatgatctacaactact

SEQ ID NO: 39345 - DNA, 399 bp, Zea mays
  Clone ID: LIB3062-051-Q1-K1-G1
caaatttagtaatgtatatgtgaagaatctgtcagatactgttactgatgatgagttgaaggagatgtttggaaaatatggaaccataactagtgctgttgttatgcgggatagcgatggaaaatccaggtgttttggatttgtcaattttgaaaatgcagatgctgctgctcaggctgttcaagagttgaatggcaagatattcaatgataaggaactgtatgttggaagagcacagaagaagtctgaaagagagatggagttgaaggagaaatttgaaaagaatgttcaagaggtagctgagaagttccaaaacacaaacttgtatttgaagaacttagaggagaacattgatgatgagaaattgcgtgaactctttgctgagtatggcaatattac

SEQ ID NO: 39346 - DNA, 198 bp, Zea mays
  Clone ID: LIB3062-051-Q1-K1-G10
agaaaacggcatacagccatatgtaacaatctttcactgggatgtacctcaagcacgagaagggaagtactgcggctttctagataagagtcataagagcattgtagaagattacacatactatgctaaggtgtgctttgataacttctgcgacaaggtgaagaattggttgacctttaatgagccccagacatttac

SEQ ID NO: 39347 - DNA, 373 bp, Zea mays
  Clone ID: LIB3062-051-Q1-K1-G11
agcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaagttctcatttccgcagaatatgaaa

SEQ ID NO: 39348 - DNA, 285 bp, Zea mays
  Clone ID: LIB3062-051-Q1-K1-G2
cgaaaggggagagagagagagagaagagagagataagagagagagagagagaggagtgggagacccgcgagaggctgacgtgtaaggaccgtagactcagcgactgcgaaggacggattaggggatggccgggatcggaccgatcactgcaggactgggagcctgtcgttgtgcggaagaaggcacccaccggcgacgacaagaaggatgataaggccgacaacgtcgcgcgccgtgcccatgcggatatcgataccatgatgaagtacaacgctggtacaaaca

SEQ ID NO: 39349 - DNA, 444 bp, Zea mays
  unsure at all n locations
  Clone ID: LIB3062-051-Q1-K1-G3
gacccggactccgtggaggcggcggagatggcgcagacgctgcacgactgcgaggcgcccgcggccaggggcgagaggaaggcgtgcgccacgtcgctggaatccatggtggactttgccaccgccagcctcgggaccagccacgtgagggccgcgtcgacggtcgtggggagggagggctcgccgaggcaggagtacaccgtgacaggcgtgaagcgggcgggcggcgggcgcctggtggcctgccacgcggagccgtacgcgtacgccgtgttcgcgtgccacttgacgcagcagacgcgggcgtactcggtgtcgatgctgggcaaggacggcacggccgtggacgctgtcgcggtgtgccacgccgacacgtncggctggaaccccaagcacgtcgtctggacccgcggcggctgagagtggtcgccgtttgcatgcact

SEQ ID NO: 39350 - DNA, 433 bp, Zea mays
  unsure at all n locations
  Clone ID: LIB3062-051-Q1-K1-G4
ggaggatactcatcaatatctggtccacgcgtgattgaaaaaactttcagtgacatgagcatcagtggttctggattaggtggactgagcactgacatggactcatttgctagcaagcccaaaggccgtccatctacagcagctactgcacctggtaaaggttttggtatgaaattaggcaagacacagaagacaaatcaattccttgaatctttgaaagctgaaggagaagtcattttggaggatgtacaaccaagtgcagtttctacaaggtcatctgctcttccaccaagtgaccctgtcacagtaactatagaagagaagctcaatgttgntgttaaaagagatggtggtattaataactttgatgttcaaggaacacttgctcttcaggttctcaatgatactgatgggttcatccaattgcagattg

SEQ ID NO: 39351 - DNA, 458 bp, Zea mays
  unsure at all n locations
  Clone ID: LIB3062-051-Q1-K1-G5
gtccccgcacatcagcagagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgcctccagatctgccaggaggaggacgactggaagcgcatcgaggaccgaatcggatgcgggcaagtcgaggagctcatcgaagaggccgaggacgagctcaagctcatcgccaaaatgatngaatgggatcccgtgggtgtccctgatgactacgaatgtgaggtgattgaagacgacaccccaat

SEQ ID NO: 39352 - DNA, 404 bp, Zea mays
  Clone ID: LIB3062-051-Q1-K1-G6
gaggatactcatcaatatctggtcttcgcgtgattgaaaaaactatcagtgacatgagcggcactgattctgggttgggtggactgagcactgacatggactcatttgctaacaagcccaaaggccgtccatctacagcatctactgcacctggtaaaggttttggtatgaaattatgcaagacacagaatacaaaacaattccttgaatctttgaaagctgaatgagaagtcattttggaggatgtacaaccaattgcaatttctacaaagtcatctgctcttacaccaaatgacccttgcacaataactattgaagaaaaactcaatggtgctgttaaaagaaatcgtggaattaataactttgatgttcaaagaacacttgctcttcacgttctcaaatat

SEQ ID NO: 39353 - DNA, 268 bp, Zea mays
  Clone ID: LIB3062-051-Q1-K1-F12
ggcaagactgaggagcaggtgacggctctaggaattccctatcgtgtgggcaagtggccacttttggctaacagtcgtgcgaaggccattgatgatgctgaaggggtagttaaggtgatcgcggagaaggaaaccgataagattctaggtgtgcacataatggcacccaatgctggtgaaatcatccatgaagctgtcatcgccttgcagtatggagcatccagtgaggatgttgctcgaacatgccacgcacaccctaccgtgagcg

SEQ ID NO: 39354 - DNA, 360 bp, Zea mays
  Clone ID: LIB3062-056-Q1-K1-C10
atcttcttttgcgtcgccagtcgagcttcatcggtcagacaccatttgcaagcttaatgtcggagacaacggatttggtcgcattgggcgcctggtcaccatggctgctcttaactctggtaaaatgcatattgttgccatcaattacccgttaattgacctcaactgcatagtatacatgttgcaatatgatctcacgcatggcaaattctatttcaccatcgacgctcagaacttaaagcctgtcattaatggatatctaatcaccatcttacaagagctagatccctgcaagatcaaatcctgctatgctgatgctgagtacaaaatgcagtccactggcatatttaccaccatgga

SEQ ID NO: 39355 - DNA, 328 bp, Zea mays
  Clone ID: LIB3062-056-Q1-K1-C11
gtcagacagtgacctccacccccgcatccctcttaaaaggccagtacctcttgggggtaggggggagggttcagaaagcatctgctcatctgcctttctatcacccatcctccacaactcttttaatatatatacccttggcctctattacttcttcattgacctcaactacatagtttacatcatccaatatacatccacctataatacattacattccaccttcaagtcttaaaaccgtaacctagctattaatgtaaatcccatcaccatcctccaacatcgatatccctacataatcaagctttttccattctaactctcaata

SEQ ID NO: 39356 - DNA, 417 bp, Zea mays
  Clone ID: LIB3062-056-Q1-K1-C12
ctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccatttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactc

SEQ ID NO: 39357 - DNA, 417 bp, Zea mays
  Clone ID: LIB3062-056-Q1-K1-D11
caataatgttcatagcaactttattcataataataaccaaaaaatcagaaacaacccaatgtccattggggataaacacatggataaacaacgtatccataaatgaagtacaggtggtaaaaagaagcaaagtattgatatatgcaacaaatgaataagctcaaaaacattatgctaagcaaaagaagccatacatatcatttaatttttaaaaattgtatataacagacaaatctcatctacagtgacagaaaacagatcaatgtcaccggccgctggaactcctagggagtactcactgcaaaggagcccttctggagtgatgaagatgttctctctcgattgtggtggtcgtggcatgggtacagaacacttgtcaaaaggcatggaattactcaagatgggagcatttttact

SEQ ID NO: 39358 - DNA, 393 bp, Zea mays
  Clone ID: LIB3062-056-Q1-K1-D9
gtgtgctgggccttggaggaagggggccgagaccgggccttacttctgtagcgatactgtgaggcatcggaaggccagcctgttgtgtccgttttgaaggtcggtgggctagactggctggccttctaggggtgtggagacttcccaactctgcccttgtgctttcctggaatccccaatatgcccggaccccggtttactcctttgctgcgagcccttctctcccgtccagagttgctccgagcctatctgctcagtcctagcgattcctgtggggcttgggacgcgcggttcaagcaccccggaccatatggatgcagcacccatgggttctcgctccaatgcttctttcctccttggggcgtaactcataccctgggcacccctttccac

SEQ ID NO: 39359 - DNA, 364 bp, Zea mays
  Clone ID: LIB3062-056-Q1-K1-E11
gggagggcctgggaggcctccatggagtgggctacagtgtgggaaggggcagcgaccataagggtgccttcccagtgagccttgccaaaccgccctgtttaaaagttcaccattccacactccctatccccctctgtgcctcagtttccctgtggaacgtataccatggaacatactattaacctgtcactcaccttccttattgtttgttccccacgtggaggaatggtgtctgacgttagctcgcttgcttgtttgtttgtctgtctgtacctctgctgggccctgtgcttggagcattgcctgcctcagaggtgcatacaatgatgaatgcctgaacagctgaaggctctcgatggacgat

SEQ ID NO: 39360 - DNA, 411 bp, Zea mays
  Clone ID: LIB3062-056-Q1-K1-E12
ggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacggcggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctctctgtgagtattcggacttactgctctacaagtcacgagtgtaccaacacgtcacctgacagatgatgggtggccatgccatgcgcatcctgggctggggagcggag

SEQ ID NO: 39361 - DNA, 418 bp, Zea mays
  Clone ID: LIB3062-056-Q1-K1-E9
ccagtcccgaaggcactactggccagtcctacaaccagtattctcagagatgccatcagagaacaaacactaatgttaattgcccaattgagtgcttaatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttatccaagcatcaccctgggagtttcctgagggttttctcataaatgatggctgcacattgcctgttctgcttcgaagtattcaataccgctcagtattttaaatgaagtgattctaagattt

SEQ ID NO: 39362 - DNA, 261 bp, Zea mays
  Clone ID: LIB3062-056-Q1-K1-F10
cgctttgcttcaggtctgggctatgttcagaacctaagcaggctgtgagaggtagaggaggcagtattacatgttaggcccagaacaccatgggaaaaggtttatgtcgtgtatcttactgccctgcctagctgcctgtgggccacgctgacttctgatgttcacattagctcgtagctgaaccctgttgctgaatgccatccccgatctcgctgcaactattatatacgcgatgctatgccttgcattgcctgaggtaag

SEQ ID NO: 39363 - DNA, 415 bp, Zea mays
  Clone ID: LIB3062-056-Q1-K1-F12
cggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgt

SEQ ID NO: 39364 - DNA, 229 bp, Zea mays
  Clone ID: LIB3062-056-Q1-K1-G10
atgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagag

SEQ ID NO: 39365 - DNA, 366 bp, Zea mays
  Clone ID: LIB3062-056-Q1-K1-G11
ctcagttttgctggaggccgcaaccaggcccgcgccgccaccatgtttcgagatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcataaaaaaattctccatgttgacaaccatattggtatctcaattgcggggcttactgctgatgctagactggtatgtaattttatgcgtcaggagtgtttggattccagatttgtattcgatagaccactgcctgtgtctcgtctt

SEQ ID NO: 39366 - DNA, 378 bp, Zea mays
  Clone ID: LIB3062-056-Q1-K1-G9
ggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgattcctctgtacccacatcatctacagctttgccaatataagcaacgatcacatcgacacctgagagtggaatgatgtgacgctctacggcatgctcaacacactcaagaacaggaaccccaacctgaagactctcttgtctgtcggaggatggaactttgggtctc

SEQ ID NO: 39367 - DNA, 202 bp, Zea mays
  Clone ID: LIB3062-056-Q1-K1-H10
gcactccacgcgtctcatcaaaatactacattagatagttcgaattttcactacacgtttttagtatccataggggtagagagtgaacttaaacaggcgcaaacagcatcaactcataaattgaaaataaaaaacacacaaagccaaatcaacactcaaaaataaccttattgatgaccaggaaagctagatgccatacatg

SEQ ID NO: 39368 - DNA, 416 bp, Zea mays
  Clone ID: LIB3062-056-Q1-K1-H12
gaaacatttatggcctcaagatactatacatttaaagcaccccaatgtctctctttgtgtttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtctcatgttctctgtatttatgcagctgatttgtctgtctgtaactgaagtgtgggtccaaggactgctaactactttgcat

SEQ ID NO: 39369 - DNA, 415 bp, Zea mays
  Clone ID: LIB3062-056-Q1-K1-B9
gcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatgga

SEQ ID NO: 39370 - DNA, 411 bp, Zea mays
  Clone ID: LIB3062-056-Q1-K1-H9
gcaaaatactacattgctagttgaatattcctaacgtttttgtcccataggaaagaatgaattaaacaggccaaacagatcaactttaaattgaaaaaaaaaaaaacaaaaacaaacaaacaaaaaaaaaccttattgttgccaggaaagtagatgcataaatgccactctggtatcctggccatcttaaagggcaattcttcttgatatggaggtagtaagtataacatattcaaattatctaaacgataggaatcataatattttatgctttttctagcagaattattggtaaaacaagaatacttctaaacataccttcattccacgtgttagaaagcaatattcgggccaggcacggtggctcacacctgtaatcccagcactttggaaagctgaggcgggtggatc

SEQ ID NO: 39371 - DNA, 310 bp, Zea mays
  Clone ID: LIB3062-053-Q1-K1-H10
cgtacgcgtgacaaccacgctaggcctggtggttgaagaacaacgtgccagatcttcaacgagggggggctggactacctctgaaacccgaggctcatccaggggcacagtatacttgccatatgagcctaccgggcagggctaatggacgccgtcgacgactggcgcatggacatcatgccgatcggcgaggtcgtcaacgctgtctaccagagcgactgcttcgtcacaatcgtcatagtcgccgaccacaatgccttcgacattctccaggtcaaggagctcaagaacggccgacttgtcatgcttg

SEQ ID NO: 39372 - DNA, 412 bp, Zea mays
  Clone ID: LIB3062-053-Q1-K1-H12
accaccaccaccaccacggccatcgccgcgacgacgacgaagacgaccgcagaggcccgcctcccccggtctacggcggctacggccagccaccgtcacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacggccacgagggccgaccgcaccacggcggcggcggatcccagtacggccacgagacacgccc

SEQ ID NO: 39373 - DNA, 436 bp, Zea mays
  Clone ID: LIB3062-053-Q1-K1-H3
gcaacgggacctgatgggtatggtcaacagggttacccacagcagggtggccaggtaccagcttcatatggtcagagtgcaccagcagctccaggatatcctcagcaaggcacgcagcaaggtggctatgcacagtacccgcagacccaaccagcatatggtgatcaagcagctcaagccaatgcgaactatgggtaccagggagctccagcagatcccaactacggaagtgcgtacccacagcagccagggtatggtcctcctggtcaggcaactggtcaggctggttatgcatcctctgcgccagcggccagccagcctgtgtatggccaggctggatatacccagccacctacaaatcctccaagttatgatcagtctgcagcaccagcggcgactcagagcggttatgcttcgccccctgcaaattcacaac

SEQ ID NO: 39374 - DNA, 356 bp, Zea mays
  Clone ID: LIB3062-053-Q1-K1-H5
gctcatccttggggatagcagtcttggcctttaccttgatcccgttcaggtcgtgagagctgtgccgcatcaccttccgcactgcttgctgcgaatcaaaggtgacgaaaccgaaccccctcgaccggctcgtctcgctgtcataaatcaccacgacgtccgttaccgagccaaacgtctcaaagtaagcccggaactacttctcggagatattatcccgcaaaccggcaatgaatacctcatatgaatcatagctcacactgtcgtcactgtcagcagtaccattaccagcgggcgactgattgtcttggataccctgaccccgggcttgctcagcctgctgaggctgcgagtgc

SEQ ID NO: 39375 - DNA, 400 bp, Zea mays
  Clone ID: LIB3062-053-Q1-K1-H7
gctgagtatttccgtgatatgggctacaacgtcagtatgatggctgactccacctccgggtgggctgaggcattgcgtgagatctcagggcgtttggctgaaatgcctgctgatagtggttacccagcttacttggctgcacgtttggcatccttttatgaacgtgctggtaaggtaaaatgtctgggaagtccagacaggaatggcagtgtcacaattgttggagccgtctctcctcctggtggtgatttttcagaccctgttaccttcgcaaccctcagtattgttcatgtcttctggggtttagataaaaagctcgctcaaaggaagcatttcccatctgtgaattggctcattttctattctaaatactgcaaagcgccttgagtctctttacgag

SEQ ID NO: 39376 - DNA, 324 bp, Zea mays
  Clone ID: LIB3062-053-Q1-K1-H8
tgaaacacaccaagggccagctgtccttggaattgctcttattgctatggctgaggagtgaggagctgaaatggctgtgcgttcacttgagcgtcttctgcagtatggcgagcagaatataagacgagcagtgcctcttgctcttggtatactctgcatatctaatcccaaggtgaatgttatggacacactgtttagattgagtcatgatgccgatgcctatgtgtcaatggctgcaattatctcattgggtatgattggtgctggcacatacaatgccagaatagctgccatgcttcgcaatctttcaagttattactacta

SEQ ID NO: 39377 - DNA, 421 bp, Zea mays
  Clone ID: LIB3062-053-Q1-K1-H9
acgtatgacaaccacaatggaactggtcctcgtgaagaatgggtgccattgagacaagagggggataagccgcctcagatacgtcttgcacaccctgctaccctctccaaattcaaaactaggaaacggcgcagggaaacagcaggcagctgtttatgggtcattggagatcatgtagacgcatgggtcaataattgctgttggcgagagggagttatttctcagaattatgagactgacgagacgaaatatgttgtacatttttcagttggaggtggtggtgaatccttagtagttgatgcttggagtcttcgtccatcacgtgtttggaaagatgttcaatggatagagtggtcccgtgcaagagaaaggaaatccaagtctaataagggcgattcacctcttgagaaacgccaaaaga

SEQ ID NO: 39378 - DNA, 285 bp, Zea mays
  unsure at all n locations
  Clone ID: LIB3062-056-Q1-K1
cgaaacgccatgtacccagttgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggngatcgtgctcaccttcaacggcgtcgaccacgcgcacggcggcgcgcccaccagggggggattctccgacgtcctggtcgcgagcgagcactacgtggtccgcgtncccgac

SEQ ID NO: 39379 - DNA, 395 bp, Zea mays
  Clone ID: LIB3062-056-Q1-K1-A10
gacgcgcagaagggaacagagaacggcctcttcagcaggagctactaccgagccatgacctggtgccattaacgaagcacatgtatcacaagccgattacacacgggacggccacggaacactgttgatcgatgctgcattctcactgaaatacgtagtggatcttggatgagtaagaaagtcatgtgacgctcagaatgaggattacacggaccttgctaccggagataccaacgacatcgtgtgcctgtgcttcacatgcctgcacagcgaagcaatgataggcatcaacagggcccatgctgtatgacagaaccaacaggtgacagtacttgagctggtaagtagggactgcatgcacaagcacatgggctgtcaagcacatcgatgtactc

SEQ ID NO: 39380 - DNA, 252 bp, Zea mays
  Clone ID: LIB3062-056-Q1-K1-A11
gcgtttgaatccctgatgcacctcccaggtgcccagctaatacaaggtgaacttcatgatccactacttccttaaaatcattcacctttttgatgaatattccaaatgtttacttgatggagcacacaatgtgggctctaaaccaattcaacaaatccgcatattccttttcgagaaagctttagcacttattggcaataaaacccttattcgccaaggccttcatgggcacctttgaaacaacccatcttt

SEQ ID NO: 39381 - DNA, 420 bp, Zea mays
  Clone ID: LIB3062-056-Q1-K1-A9
ccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggc

SEQ ID NO: 39382 - DNA, 374 bp, Zea mays
  Clone ID: LIB3062-056-Q1-K1-B10
cacgctcaatgctgatgaatttgaagacatggtggctgaaaagcggctgatcccagatggatgaggggtcaagtacatccccagacgcggccctctggacaagtggcgggcactgcactcctgagggcttccaaagtgctgtccacatgataatactcaccaatgaattctactacctgtccactgtaccattataaatgaagaacagataagaagatgagttagataaccaaatgagagaaaggtggagatattgaagattaccgggggggcgatttataggacccaacgctacttacacatacttgctacgctagagaacatataccagggtaccgaactaaagactactggccgggggttacaacgagaag

SEQ ID NO: 39383 - DNA, 419 bp, Zea mays
  Clone ID: LIB3062-056-Q1-K1-B12
gatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctg

SEQ ID NO: 39384 - DNA, 344 bp, Zea mays
  Clone ID: LIB3062-053-Q1-K1-G9
gtcgaccacgcgtacgccaacacgtaccaatcgagcactgaatatcgctccattgatatggttctcatgatacattctgtggcgtcagacgacgctggtgcatatgacgacaacgcggaggagccggtaactcgtaacgtggatcccgatctacatgacaactatcagtagctgatcgccaaggaccactagctgatctacgtgcaacggctcggcaaggttctacaatgacgactacaagcacgcttaccagatttccgtgcttaaagtcaatctgcacctcgcgcgccagctccatatgatagacccatgatccgatcacggtataactaagctcttcgacc

SEQ ID NO: 39385 - DNA, 425 bp, Zea mays
  Clone ID: LIB3062-053-Q1-K1-F4
gcgtgatcttgctcagtctagactgcaagatttgctcaaggttgttggagataaccgcggttcgaagcaccccctggcttcttctggaagaaattttacttttgatgttcctcagccatgtgaggatgagcaatcgacgacatcagaagctatcagcagcggccaaaattttaggcttcaaggacgcctgacaacacaaagagattataggtcacagcaatctgaaaatgacgtgcagtttgctacctctcttagctattcaatcagcagtcccccattcagtgggatgcctccaactaatggcagaaatgataactctcatatatctgatgaagattcagaggatctttgcaaagaagtacggtgcatagagaccaatgaaacatatgaatatgaatgcttagagtcgtcagctgggggaagcc

SEQ ID NO: 39386 - DNA, 380 bp, Zea mays
  unsure at all n locations
  Clone ID: LIB3062-053-Q1-K1-F5
cagctagctagcatacagacgaataatctcttcttcacctcactaacaccagctagcagctctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggngtgcgctcgctcaacagccgcgcgtcgtcggcggcggaccggcaggccacctgcaactgcctcaagagcatgacgggcccgcttcggcggggcgtcagcat

SEQ ID NO: 39387 - DNA, 390 bp, Zea mays
  Clone ID: LIB3062-053-Q1-K1-F6
aaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctaaccgcggagcaaggagcgcatgatc

SEQ ID NO: 39388 - DNA, 124 bp, Zea mays
  Clone ID: LIB3062-053-Q1-K1-F7
agatgacccttttctatatcacggacatgatcacccactccgggacggacatgtcgaacgtgggcgcccgattcaccgacctgttcttttcgcacaaactcttcaacgaccccaccatgagcgt

SEQ ID NO: 39389 - DNA, 404 bp, Zea mays
  Clone ID: LIB3062-053-Q1-K1-F9
acggggccatttaagtacgcatatttgatttgagagctggaggagacaagatcacgcatgctttgagatgtatatgctggaggagcaaggacatccaagtagaggctggtaatcaagcactaccggagatagctgagatcctagctaaaatcaagctgacactgcatccatggacgttgagcttaagaggtggtcatcaagaacgcatacgatatggacacttgcccagttaaaaaagctgaagattacagaaatagtctgcatcaagaagcacatgcaaaagctcaagcattacactttgaacatgaattaccttgaagaagaatgcctatcatgcttcacaaaggcgataagatgctgaacttgtgaagatacaagaggcatcttcccagaggaaagaatct

SEQ ID NO: 39390 - DNA, 153 bp, Zea mays
  Clone ID: LIB3062-053-Q1-K1-G1
aaaaaaaaataagataaaaaaaaatacatatatgaaagaagagaaaactcaatctgggagggacaagtagatcgaaggttggctgtgacgatgacgtgttttagtgcgctggatctgattcttgagccctgcatgagcgtgaccatcgtgtag

SEQ ID NO: 39391 - DNA, 386 bp, Zea mays
  Clone ID: LIB3062-053-Q1-K1-G10
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtg

SEQ ID NO: 39392 - DNA, 411 bp, Zea mays
  Clone ID: LIB3062-053-Q1-K1-G11
cgaggattatccctttcgtatttaacatctggttcgtgcgccagctcggcgcggacgatggcgctgtgtcgggcattgcactgcagcttcctctatttatgaactgcatcttatttttaagccgggaggggtttcgacgtgcatgtttgcgtaatgattcccagagtgatgtgttgacttctgaagcgatactaatggtcgcttggatggtaattccagtgtccatcttaattacttctgttggcagcatacttgtgttgagtttaaagagagtgaagctatctgacccctatgcgaaagctgtattgatcatcggatttgcttgtattctggaattactggcggaaccattatacattatttcccagaaaaagaaatactataatataagagtgtacgttgaaccgacag

SEQ ID NO: 39393 - DNA, 418 bp, Zea mays
  Clone ID: LIB3062-053-Q1-K1-G2
agggcatatcgaggaggtttttagggtggtggtggtgttgtgaggagctgctgccggtgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaacctcggcctcaagatcgtcgcctactgatctcacatggggcgcggcgcgccggggtcggggggtgggacgcac

SEQ ID NO: 39394 - DNA, 414 bp, Zea mays
  unsure at all n locations
  Clone ID: LIB3062-053-Q1-K1-G3
cgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgccca

SEQ ID NO: 39395 - DNA, 434 bp, Zea mays
  Clone ID: LIB3062-053-Q1-K1-G4
atcaatttcatcgtccaacccttcgacggtcaagactggttcgactcggtcgacatggactgtagcctcatacaaagatagtcgagagcttcctactcctaggacagaaggggaaatcttgtcatcaccaaatttgaaggcattctcgtttggtgatctcagaactgcgtcgaggaacttcagatcagacagtcttcttggggaaggaggatttggctatgtgttcaaaggctggattgatgagcaaactcttgccccttcaaagccaggaagcggtatggttgttgccatcaagaagctaaaaccagaaggttttcagggccacaaggagtggctgacagagggtgactaccttgggccaacttcaccaccagaatcttgtcaaactcattggttattgcacagatggtgatcaccgacttctggtgtatgag

SEQ ID NO: 39396 - DNA, 394 bp, Zea mays
  Clone ID: LIB3062-053-Q1-K1-G5
ccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggg

SEQ ID NO: 39397 - DNA, 319 bp, Zea mays
  Clone ID: LIB3062-053-Q1-K1-G6
ctggttcgactcggtcgaggtggactgtatcctcatacaaagatcgtcgagagcttcctactcctaggacagaaggggaaatcttgtcatcaccaaatttgaaggcattctcgtttggtgatctcagaactgcgtcgaggaacttcagatcagacagtcttcttggggaaggaggatttggctatgtgttcaaaggctggattgatgagcaaactcttgccccttcaaagccaggaagcggtatggttgttgccatcaagaagctaaaaccagaagggtttcatggccacaaggagtggttgacagatgatgactacct

SEQ ID NO: 39398 - DNA, 406 bp, Zea mays
  Clone ID: LIB3062-053-Q1-K1-G7
cttctgatgatgcaccgcgtgcaacagatgaacaaatcaagaaagcttcgaatatattgaaacgtattgatctgataaatttctctgcatgccaatttgctaacccagctttgcaaagacactatgggatcttggaggccttagctttaggcgaagatgagatgcctgatataaaggacgagaccctgcctgacgaagaaggcttgtctaagccaggggtagccaatgctattgaggaattcaagacttcagtctatggtgaaaattatgaccaagaggaggcagaagcggcagcagggaaaagcttccgtggtaatgcttcaaaaaagcggaaggaggtcactgatgcagctgcgcagataagtgctgcttatgactgggcagaaactgcagacaatggaaaact

SEQ ID NO: 39399 - DNA, 377 bp, Zea mays
  unsure at all n locations
  Clone ID: LIB3062-053-Q1-K1-F3
gagacgcgtacgcggcattctccttgggtgcgggggttcctctcgagtctcgggagcgacgaaaacgaaaataccgagtcgagtcagcgatgaatcccttcgccaaaaaaccaacaccgcgagaggtgatgcggagcagcaagcgggacctgacgaatgctacgcgagggatcgagagggacattgcgtcattacagcaggaggagaagaaactcgttgctgaaattaaaaggacagcaaaaactggcaatgaggcagcaacgaaaattctagcccgtcagctgatcaggttaaggcagcagatttctaanttgcaaggtagccgagctcagattcgggggattgcgacacatactcaggcaatgcatgccaacact

SEQ ID NO: 39400 - DNA, 375 bp, Zea mays
  Clone ID: LIB3062-053-Q1-K1-G8
ggaatacgcggcgcgagccacgcgtgcgcggcattcaccgcgtgcaacatttgtttgcgtcaagaaagcttcgtatatatggcaagcgccttgatctgatacactgatctgcatgcgcatctgctaacccagcttcacggagacactatgggatctcgaatgccttagctttacgctatgatgatatgcctgatgtataggacgacaccctatctgacaaacaaagcttggctaaacgagtggtctccaatgctatagacgagtttgatacttcaagctatggcgataattatgcccaaaaggaggcagatgctgccatcaagaaagcattcccagctagtgcttaaggccaaccgaaagaggtgactgatgcag

SEQ ID NO: 39401 - DNA, 373 bp, Zea mays
  Clone ID: LIB3062-037-Q1-K1-B2
tactagttctagatcgctagctcctcactatttttattattattccccaattaattcatacagtttatcatatattgaatagggagagtcctattatttttacactgcaactagtttggaccgtatgctatcgatatagtatatattatctttccgattcctctgatgctagcataccatatcatagtatgtcacgacacgtgatgaacaagagcagactaaatgagcaaaatgatattttgcctgtatcaatatatattgcacgagataaaaataatacaaggttacaaccatgatttatatcttgagccttactccgaccctacgcttctaaataaatatttacctttgaatgaatttcacgaaaacccat

SEQ ID NO: 39402 - DNA, 353 bp, Zea mays
  Clone ID: LIB3062-037-Q1-K1-B3
gtcccagttatactatagtcctaattattgttcatgacaagatcattgcgtacatgggaacgtggatcgaccacgcaggagaacagtgctaccacaagggtggtatgggacgcccttggctgactaattaggaaagctagtggaagacaaccttacccgaaaggagcacttgcagtacaggaacatgcgtatatagaggttctcgggtcaatcatgtaacgctggctttatggagagttttctcatttccaaagacatgtttcccataatgaatatatttgctcataaaagatcaaatgcaaacaacactaggtaaatcaagagcattcacatatggacctatacattgatag

SEQ ID NO: 39403 - DNA, 431 bp, Zea mays
  unsure at all n locations
  Clone ID: LIB3062-037-Q1-K1-B4
cttcgagatcggtccccaggtgctcaggaactcgacggtcggcgtgctgctgccccccaaggagagaggacgcgacgtcgccgcgtgcccggctggatcatcgagtcgctcaaggcggtgcgattcatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgcttgtggaggcgttcgcgggcaacgtcacgcagaaggtgccgttcgattccgccgggaaaggtgggttcaagacggcggcgttcaggttcgtggcccgcggcgttcggacccgnctcaccttctacagctcctactaccacac

SEQ ID NO: 39404 - DNA, 411 bp, Zea mays
  Clone ID: LIB3062-037-Q1-K1-B5
gccttctagcttatttacaccccaattctattactagagtcagcagcggctacaatgcgtgcttacacgatcaagagcgacgatcagcactctcttctcatcctacttctgcaggccctccagctctattcatctcttcccaaacgaccttcatcccctaacaaccactgctgctgccgacaatgccccacctgctacagcgtctgtacctgctactacctcctcaccatgtgcaccgccccctgcactaactgcgtccctgtctccacgtacaaaggcgctaccaagtacacatatccaaacttccttacccaactctagccctgccccatccactccagactcatcctatcaaccatgtccacattctatcgacccttcttccatatgcatgctctcctaacttcatcc

SEQ ID NO: 39405 - DNA, 415 bp, Zea mays
  Clone ID: LIB3062-037-Q1-K1-B6
atcgctccgtctatatggcgactctaaccatgcagccgatcggtcccacccctgctccgggggcgcagcaagacccgagcaagggagagaatcctcctaccgtggatggtagcgatctgggtgacatcgactcgggctgggttatcctcaagaactcggatgtcgtttccgcggatttggcagccgccgccgtctgtggcggtcagcgtctaggctcttctacgattcctagctgggcacggtgggttctcggaggtgtggtttacacgctcgtgccgttctacaacagagttaggcatctcgaagacgagacggtgggattcgtggagaatgctgtggaggttgtggagcatttagctgaagtaacagagaagctagctgtgaatgtggctaagcaacttcctgaagatgggtc

SEQ ID NO: 39406 - DNA, 379 bp, Zea mays
  Clone ID: LIB3062-037-Q1-K1-B7
acaccccataactgattctagcatcagcatcggctacaaggggtcgttaaacgatcaagagcgggagcagcactatcacaatgatcctatgtctccacgcccttctactatctacgactgctaccaaaagacctccttacccgaaaaagcaacgctcattcgacgagcacaccaactgagaggtcgtgtggacctgctacgaccttctcaccaagtacaccgccacctgcatgaactacatgcccgtctacacggacaaaggcgccaccaagtacacatgccgcgacttccttccctaaaactacagctgcaagatccactacatactcatgcaatcaaccatggtcacaaccgatggacccttcttccataagcatgc

SEQ ID NO: 39407 - DNA, 393 bp, Zea mays
  Clone ID: LIB3062-037-Q1-K1-B8
attggtgacgctgacgccccagtaccatcgatccccatggtcggcccgatggtattggtgaggctgacgccccagtacttccatatcggtgcgctgccattgggatcgaggctctcaagtacatcagctacccggctcaggtgttggcaaaatcttctaagatgattcctgtaatgttgatgggaactcttctctatggtgtgaagtacacacttccagagtatttatgcacctttcttgttgccggcggtgtgtcctcctttgcgttgttgaagacaagctccaagacaattaagaagcttgccaaccctaatgcacctcttggttacacattgtgcttcctcaacttagcttttgatggatatactaactcgacccaagatttaataaagt

SEQ ID NO: 39408 - DNA, 285 bp, Zea mays
  Clone ID: LIB3062-037-Q1-K1-B9
ttaatactcatcaagtgtgcccattatataacatttacttttatttccacaaatatagccactacttcctagtcaccctcatgttattttctctcttacttctattgactgctaccactccaatgtattttcttctgccaaacatctccatcttttactgctttctatactttcatgtatcacatgtcaattatcactattattaccttcaccttagactttatttttattcttccctacacattatattaattttcatattataaaatcttatattaaattttc

SEQ ID NO: 39409 - DNA, 346 bp, Zea mays
  Clone ID: LIB3062-037-Q1-K1-C1
cctcacggtgtcacctgattctatccagttagtcgctgagcatgctgcggtaaattacatggtgtttctgatgaacctctctgatgccttcatctgctagtttttctgtgatgcccaagacaaggtgctcccgtatgctgacttcatattcggcaatgaaaccgactgctgaatcttcgccaaagttcgaggatgcgagacagacaatgtcgaggagattgctttgaagatctctcatctacctttggcttcaggcaagcataagaggactgctgtgattactcatggcgctgatccagtggctgttgctgaggatgggaaggcgaaaacgttacctgtgatccta

SEQ ID NO: 39410 - DNA, 405 bp, Zea mays
  Clone ID: LIB3062-037-Q1-K1-C10
acgcggacgcgtggggtcacacacatcgaaaactaccagtgtatttttctctggttacaaggttgggcagccaattgagggagatgaaatggatcttgattctgaggatgaagaggaggagctaaacattccagtaatcaaggaaaatggtgatgggaaggaggagcagaaaaatcaagagaaggcagtagctgctacagcttcaaaatcaagtcttggccttgaaaagaaaagcaaggatgactctgatgattctgatgaggatgagtctgatgattctgatgaagatgattctgatgattctgatgaaggcgaaggattatctcctgaccaaagcgatgatgattcaagtgatgaagatgataccagtgatgaatgacaagaagaaaccccaacttctaaaaa

SEQ ID NO: 39411 - DNA, 404 bp, Zea mays
  unsure at all n locations
  Clone ID: LIB3062-037-Q1-K1-C11
gctgacaaagccattgagatgttcaaccgctatgatattagcgggaggcttctgaatgtagggagggcatcttctaggggcactcgcatggaaagacctcagagacaatttgcaccagctttcagagcttatgttggcaacttgccatggcaagttgatgactctaggctggtgcagttgttcagcgagcatggagaagttgttgatgctaaggttgtctacgacagagaaactgggcgctcacgaggattcggttttgtatcaatggtgtcaaaggaggaactcaatgatgctatttcggccctagatggacaggaattggacggccgncctcttcgagtgaatgttgcagcagagcggccacagaagggcttttgatgcggttgtatgagagagatgactgc

SEQ ID NO: 39412 - DNA, 415 bp, Zea mays
  Clone ID: LIB3062-037-Q1-K1-C12
acgcagaagtggtggcagaggtgtctcagcacgtggagctgatgtcggctaccagagggttgaccgtgctggatatgctggtggtcgtggtggccgcacagtagccgctggtgcacctgcaaaatgagggacaacatagctgttgcacgtctcctgtgtcgttcggtggccctcagattgttttgaagttggcatagagatccatcaattggtcgagtgcggggttaccagaaaaggctggatacaaatttttggagttcctgttcatcactatttttgcaggcaacaaaagctaaaaaagtgattactaattgagtaattgtagaatagacacctattcagatgtagttttagttttggtcgtcagttggtgagcctgtcatttttgcaatgttatgttactgctagtattttt

SEQ ID NO: 39413 - DNA, 336 bp, Zea mays
  Clone ID: LIB3062-037-Q1-K1-C2
cgtacgccccagaccggcaaccctagcgccggattccttcttctcggatccgcccgccgcctcgctggggtggttgtcacaggtgagcgagggggatagatacagcttgcgtggtctcattactgagagaggcatgggatgatgtccacacggtctttgaacccgatccgacatgttgcctacggtggtctgcccacagtctgagtcctgttccaccccaagtcacgctcacctcccgtgcttactattgccctactcctcctgggtgtcattcttctcgtcgactacttcatcagcggctcatgtgtaactggtacacgctgatagtctgttacc

SEQ ID NO: 39414 - DNA, 465 bp, Zea mays
  Clone ID: LIB3062-037-Q1-K1-C3
ccaccatcatcggtaagataggacttatctttgcagtggtcacattcgcagtgctcgcccggatcctgttccggggcaggatcattgatggtacgtacttgagctggactggagatgacgcattggagctgcttgagttcttcgccattgctgtcaccatcgtcgttgtggcagtacctgaagggctaccgctggccgtgacactgagccttgcatttgcaatgaagaagatgatgaacgacaaggcactcgtccggcaccttgcagcctgcgagaccatgggctcagcgacctccatttgcagtgacaagacaggcactctcacaacgaaccacatgaccgttgtcaaagcctgcatctgtggtaagatcaaagaattggatggtgtttcggatatcaagaacctgttcttttgactcccagactctgtcatggcgattctttccagttcatattcaacaacac

SEQ ID NO: 39415 - DNA, 391 bp, Zea mays
  Clone ID: LIB3062-037-Q1-K1-C4
cccgcaagggatactggcagttcgacatgggggaccttctcatcgacggccactccaccgggttcggcgccaaggggtgcgctgccatcgtcgactccgggacttccttgctcgctggcccaacggccataattgcccaggtgaacgaagcgatcggggctgacgggatcatcagcacggagtgcaaggaagttgtgagccagtacggagagatgatcctcgacatgctcatcgcacagacggatccacagagggtgtgcagccaggttggtctgtgcgtgttcgatggcgctcgatctgtcaggtgagaggctctgttttgcttgacacagcaagcatgttcttgttcttctcatgctagtggtaaactatcatcagatcacgcgaaaac

SEQ ID NO: 39416 - DNA, 454 bp, Zea mays
  unsure at all n locations
  Clone ID: LIB3062-037-Q1-K1-C5
ccccaaccggcaaccctagcgccgggttcctcctcctcggatccgcccgccgccgcgcggagtccattgccagaggtgagcgagggggagagatagagcttgggtggtcggattagggagagagggaggggaggatgtccagacggtcgttgaacccgagccggcgggtggcggacgggggtctgccgacagtcggaggcctgttccaccccaagtcacgctcgcctcccgtgcttactattgccctagtcgtcctgggtgtcattcttctcgtcgcctacttcaacagcggctcaggtgtaactgttacaagcagagagtctgtgaccaggtctgaaggttcttgcacatcagaagttatgcgggtgcttccatatcttaaaaaggcatatggaaatgccatgcaaaaggttcttcatgtangccctgatagttgtacagtagtttctaattt

SEQ ID NO: 39417 - DNA, 141 bp, Zea mays
  Clone ID: LIB3062-037-Q1-K1-B12
gaccacactagcgcagcgcgcacaggagcaaatgggggcatcctctatcgcgcgcgcgccatggccacgaggccgggccctttgactgaatggccatggcaaaagcttggaaacttcaagtacttggtgatggcttccgtg

SEQ ID NO: 39418 - DNA, 458 bp, Zea mays
  Clone ID: LIB3062-036-Q1-K1-H8
caccaagccacgggccgcttctccaacgggctcaacatccccgacatcatcagcgagcaccggggggccgaacctgcgctgccgtacctgagccccgagctccgaggggagaagctgctcgtcggcgccaacttcgcgtcggccggcgtcgggatcctcaacgacacaggaatacaatttgtgaacatcatcaggatcggcgaccagctgcagtacttccgggagtaccagcggaagctgcgagccctcgtcggcgagccgcaggcgacgcagctcgtgaaccaggccctcgtgctcatcacgctaggcggcaacgacttcgtgaacaactactacctggtgcccatgtccgtgcggtcgcgccagtacgcgctcccggactacgtccgcttcatcgtctccgagtacaggaagatcctctcgaggctgtatgagctgggcgcgcggcgcgtgatcgt

SEQ ID NO: 39419 - DNA, 443 bp, Zea mays
  Clone ID: LIB3062-036-Q1-K1-H9
gtcatggagaagctacagacggaggtgaggacgacgatgcgctcgccggacggcaagaggcgggacatgctagcgggggaggacctcggcagcatgccctacctcaaggcgaccatcaaggagacgctgcgcctgcacccgccggcgccgttcctcctcccgcactactccaccgtcgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcaggttcatcccgttcggctccggccggaggatctgccccgggatgaacttcggattcgcgaccatggagatcatgctggccaatctcatgtaccattt

SEQ ID NO: 39420 - DNA, 119 bp, Zea mays
  Clone ID: LIB3062-037-Q1-K1-A1
tcgattaagtgcggctatggaagtcttcacagaatgcttaacactctaccttggcgtgcggtatcgatgatcaaatgtcatgtatacacggtggactcatctcccgatctagcacactt

SEQ ID NO: 39421 - DNA, 418 bp, Zea mays
  Clone ID: LIB3062-037-Q1-K1-A11
gaaaagaccgatgtttttggatatgggatcatgcttctagagcttattactggacagagggcatttgatctagctcgtcttgcaaatgatgatgatgttatgcttcttgactgggtgaaaggactgctgaaggagaaaaaggtggagatgttggtggacccagatctacagaatgcctacgaggagatcgaggtggagaaccttatccaggtggcactcctctgcacgcagggctccccgttggagcgtccaaagatgtcggaggtggtgaggatgctggaaggtgacggcctggcagagcgttgggacgaatggcagaaagtagaggtggtgaggcaggaggctgagtcggcaccgctccgcaatgactggatcgtcgattccacgtacaaccttcgtgccgtggagctgtccggtc

SEQ ID NO: 39422 - DNA, 356 bp, Zea mays
  Clone ID: LIB3062-037-Q1-K1-A12
acgcaacgaaccatctttacattgggacatagacacagtaaagatcttcttgaccggaataactctggagagatacttacgatgtgggggaaccaaacgcatattctgcaacacgaggatgccttatgatgaccgctttcttgaatgcctgtttggtctgatcaagaagaactttactgagtctatgacccaactaaccatgtttacattggccatatcttcatggcgaattcaaaagatgtcataaggccaaaacttttcccgcgtgaaggcatacaaatccgtgggtctcgaggtatgtcaatgccccagattatgttaaccctcgacccggaaatgatccttggctacagaac

SEQ ID NO: 39423 - DNA, 295 bp, Zea mays
  Clone ID: LIB3062-037-Q1-K1-A2
gcaacgggggccgtggcaaggtggggaaggcggcgcacctggaggaggcggtggtgtcgctgaagtccacggcggacggggagaccgtgtaccgggtgagcttcgagtgggacgagtcgcagggcatcccgggcgccgtcctggtcaggaacctgcagcacgccgagttcttcctcaagacgctcaccctcgagggcgtccccggcaagggcaccgtcgtcttcgtcgccaactcgtgggtctacccgcacaagctctactcccaggaacgcatcttcttcgccaacgacaccta

SEQ ID NO: 39424 - DNA, 410 bp, Zea mays
  Clone ID: LIB3062-037-Q1-K1-A3
agtgctctcgttctctctactcctctctctctcactctaggcagtgcatccttaagccagggcatctttgaggcgccgccgtcgtgaggagctccgcccatccgtcgtcatccgtcaaatcagttgatacgaagacattacaggatataatcggcccttcaacttcaatgaagtctcatacacatccagtgaagcctcgctttcaagtcagcaatcggcctaaatgcaatttgctaaataaaagttctattgattctgagcaaactatccaatcttctatagcctccaagataacaactttgattgacccgcggcaccggtatgaccacaaccttcactgctactacgactgctggcttcactccgaaagcaagcagccttttttctactggccgcacttgaagaaatct

SEQ ID NO: 39425 - DNA, 471 bp, Zea mays
  Clone ID: LIB3062-037-Q1-K1-A4
acgccgaccgccggcgagcccctcctcctccacgacacgcgcttccccggctatcatggattcggatcgatcatcacagaacgcaacagatatgactgcatttgtccagaacctccttggacagatgcaaacaaggttcgagtccatgtcgcagaacattgtgtcaaagatagatgaaatgggaaccaagattgatgagctcgagcagagcattaacgatctcaaagctgagatgggcactgagacgccggtcaagaagcctgatgagccaaagcctgctgactctgcctaacttgggtgtaacccagagattgttgtgtgaagatttgatgatggtacgtgatcgtatctgttttcatgagtcctggcagttatgtagacacgaacccatcgtatgaaagatgaatccatgtttgggctctccagacatcaacgcatgttcttagcttttctgtcatctttcggcaacta

SEQ ID NO: 39426 - DNA, 429 bp, Zea mays
  Clone ID: LIB3062-037-Q1-K1-A5
cgtcgatttaatgtgcggctatggaaggtcttcacagaatgttttaacactctacctgtgggtgctcttatcgatgataaaatattatgtatgcacggtggactctctcccgatctagcacacttggatgagataaagaacttgcaacgtcccaccgatgtaccagatcaaggtctactgtgtgacttactttggtcagatccaggaaaagatgttcaagggtggggcatgaatgatagaggggtctcatatacctttggtgccgacaaggtttcagaattcctgcaaaagcatgatcttgatcttatttgtcgtgctcatcaggttgtcgaggatgggtatgaattctttgctgacagacagcttgtcaccatattctcggctcccaattatcgtggtgaaattgattatgctggcgcaatgatgagt

SEQ ID NO: 39427 - DNA, 377 bp, Zea mays
  Clone ID: LIB3062-037-Q1-K1-A6
cccacgcgtccgctctcttgatctgtccaggaacaagattgccagcgtcgagggcctgcgggagctcacaaagctacgcgtgctcaacctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcctttctccgagcc

SEQ ID NO: 39428 - DNA, 439 bp, Zea mays
  Clone ID: LIB3062-037-Q1-K1-A7
catcggcatctcctccaaggccatgtccatcatgaactccttcatcaacgacatcttcgaggggctggccggcgaggcgggcaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaagttgatctgagcagtgcaatatataattctggcatactattctcgcaatcgttttggggttcaaaatgggactgacatcacagtaatatgtggcataccttctgatcctctgtactcgagagggattttgtgtggataagccacttgc

SEQ ID NO: 39429 - DNA, 361 bp, Zea mays
  Clone ID: LIB3062-037-Q1-K1-A8
gccgattcgtcatcagatctctcaaacaatcatcttacttcagaaactccgttcaatatcggtttcctgcgaggggctacgctatctttgcgaggtaacacgttctctggtactataccatcagtgattggccttatgcacgctcttgcagtgctagatctcagtttcaatgagctatctactccaataccctctatactgggccacttgacatacactgagaaattatacctgcagggcaatacgctcactgcattgatactgtcagagctcgttaatatctctacactgcattacctggaactgaactacaatctgatgactgggttcatatctactgatcttggataacttacagaat

SEQ ID NO: 39430 - DNA, 412 bp, Zea mays
  Clone ID: LIB3062-037-Q1-K1-A9
ccggctcaaagggactgtgctggactctggatggagccaggctagcttcctgatgcaggcggccacgctcacgaagcgggcgttcgtcaacatgtccagggatttcgggtactactggctgaggctcatcatctatgtcgtcgtcacgatttgcatcgggactatatacttcaatgtcggcaccggctacagctctatcctggcccggggggcatgcgcttccttcatcttcggcttcgtcacgttcatgtcgatcggggggttcccgtcgttcgtggaggacatgaaggtgtttcagagggagaggctgaacgggcactacggcgtggtcgcgttcgtgatcagcaacacggtgtcggcgatgccgttccttgtcctcatcaccctggtgtcgggcacgctgtgctacttt

SEQ ID NO: 39431 - DNA, 442 bp, Zea mays
  unsure at all n locations
  Clone ID: LIB3062-037-Q1-K1-B1
ccagccgcttcgggatcgggacgcggagaggggaaaggcgagtcgtcgactcgtcgtccgggcagcttccctgcctggcctctccgcccccgctgacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgacaaccctcgccaccgtctcatggttctacggatggaactggatatacaaaactntatgcagaaccctcagctgcaggagtttgaattccagaactntccgacttcttacctncgctgtgctgctcatcgtgttgcacaaaacatatggctagagactatag

SEQ ID NO: 39432 - DNA, 416 bp, Zea mays
  Clone ID: LIB3062-037-Q1-K1-B10
atctgtgtggccctgttactacgaagccctgccctggggatcctcccttttccccaccgcctccattcaatcctccgggtcccgcaacccaatcaactggtgcttctggccctggagcaatcgctggaggtgttgctgctggtgctgcattggtttttgctgttccagcaattgcatttgcaatgtggcgccgtcgtaaacctgaagagcatttcttcgatgttcctgccgaggaggatccagaagttcatcttggtcagctcaaaaagttttcgttgcgggagcttcaagttgctactgatacttttagtaacaagcacattttaagaagaagtggttttggaaaagtgtacaagggaaagcttgctgatggctcattggtagcagtgaaaagacttaaagaagagcgcacacct

SEQ ID NO: 39433 - DNA, 415 bp, Zea mays
  Clone ID: LIB3062-037-Q1-K1-B11
atctgaagcgcgcgagagacagacgcgtatacccaggcggcggttgaggaggaggagaaggagaagaagaagatggcttcctgcgcgtacgcctcatggtccaagcggtggatccgtcccgaggtgtacccgctgttcgtgccgatggccgtggccctgggtatctgctcgtaccagcttgtgcgcaacatcacgggcaaccccgaggtgcgggtgaccaaggagaagagggcggccggcgtcctggacaaccacgacgagggcgagaggtacgccatgcacggcctcaggaagttcgtccgcgggaagaagcccgagatcatggcttccatcaactccttcttcgccgaccctcccaaggacgattaagctagattccgtcatggatggatgagtatgttttaccaatcatttt

SEQ ID NO: 39434 - DNA, 453 bp, Zea mays
  Clone ID: LIB3062-036-Q1-K1-H7
cggtatagttgggcgaacaggaagtggaaagacaactttaattggtgcactgtttcgggttggtgagccaactggagggaaaataattatagactctatagacatcaccacaataggcttacatgacctgcgttcacgtttgggtatcattccgcaagatccgacactctttcaaggaaccataagatataatctagaccctctttggcaattctctgatcaacaaatatgggaggttctaggcaaatgtcagcttcttgaagctgtccaggagaaggagcagggattggactcacttgttgtggaagatggttcgaactggagcatgggtcaaaggcagctcttttgtttgagacgtgcacttctaagaagatgccgtatcttagttcttgatgaggccacggcatctatagacaacgctactgatgctatccttcagaagacgatcaggac

SEQ ID NO: 39435 - DNA, 366 bp, Zea mays
  unsure at all n locations
  Clone ID: LIB3062-036-Q1-K1-G2
gcgccagcaagcaaaaattccccaatcctctcgtctccgcggctaagatgtcggggcgcggcaagggcgggaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcccttaagcgccaaggccgcaccctctatggcttcngcggctaagtctgcc

SEQ ID NO: 39436 - DNA, 281 bp, Zea mays
  unsure at all n locations
  Clone ID: LIB3062-036-Q1-K1-G3
gcgccaagtcacaaccctcgacctcccccctactccaactactggaagcgccgatccatcangttgtgatcgattcttctgccgcgatccgcagcggcaagcggagatgaactgcgagacctgtcagctgaaagaactggagctggaactgacggagatcagggatgttctgcgctgtattttgcacaccatattcttccatagaaccctcagcctgggttcgcccanagatgttgcctgtgatttcctcgatattacttatgtacaatgtggtctaccgg

SEQ ID NO: 39437 - DNA, 449 bp, Zea mays
  unsure at all n locations
  Clone ID: LIB3062-036-Q1-K1-G4
gctagatgcgcatcaccaaagagtagctttcgtctagaacgaagaaacaccccccactacatggccgcgctcagttcttgtgttgcttctggaggcctggcacttcaggccacccttgtggtttctcctcctcgccgccgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttcggagcggccatagctgcagcagtgcctctttacagaaggttcagagcattagaagataacgtagagaagacggcggangcggcgatcgaggtgatcgactcggtggc

SEQ ID NO: 39438 - DNA, 354 bp, Zea mays
  unsure at all n locations
  Clone ID: LIB3062-036-Q1-K1-G5
aagggatcatgcagcggttataaaaaagagatacagagaagattcattaaaagatagcgaggggactaagaggacagaaaggaggcatagagtttctagcacggagcatgctcctgtgaaaaactcgtgcagatcagctgacaatatagcatcagaacaganaattcgtggcatatgtccaactggagccaatgctggttaaccaaaggatgatttgatggatactattgtttaacaacaattacttggatggatggataaaattgtcagtaagaacgggattttaccttatgtggaactttggaatgctttcaataaccatttaaggaactcagggaattcaattggggaaaa

SEQ ID NO: 39439 - DNA, 453 bp, Zea mays
  unsure at all n locations
  Clone ID: LIB3062-036-Q1-K1-G7
atttcgagcgccagttcgtcaacatggaggtccaggccgagttcatggagggcgccatggccggctccacctccctctccacgccggagaccgaggtcaacagcctcatgcagcaggtcgcggacgactacgggctcgaggtctccgtcggtctgccgcaggcagccgcccacgccatccctgccgccaaggataaggagaaagtcgacgaggatgacctttctcgccgcctcgccgagcttaaggcccgcggctgagaggttgtttcaggctttatcagatgcgattcaggcttatgctgttgagccgcaatgacccattgtcctgtggactgctactcatgtttggtagattcgtaaatactactgttatatgcttgaaggcgtgtgttggcattgccatgtggngtttgtgtgactcgatggaaaccttgctgtcttattgtactttaaa

SEQ ID NO: 39440 - DNA, 435 bp, Zea mays
  unsure at all n locations
  Clone ID: LIB3062-036-Q1-K1-G8
gtgcttttttgcagggaagaaaatgcctaccacaggcgtgattgctggtaccagagatggcgtttcatctgagagcatctctagatttctgctgcctgcttctgaatgcgagtttgtattgaactcagttatagaagaaatacaaaaggacccttggcctgttccagctgatcagcgtgcgtctaggtgcactggagctgccttaagtgttgcagccaatctccttggggtttgtgttcctggatcaggtgctaggataatggcatttgttggtggtccatctacggagggccctggtcctattgtatccaaatccttatcagagcccattcgctcacacaaagaccttgataaagactcggcaccactctatgantaaagctgtaagtnntatgatcaaattgcanagcagcttgtgcaccaagggcatgtgct

SEQ ID NO: 39441 - DNA, 269 bp, Zea mays
  Clone ID: LIB3062-036-Q1-K1-G9
taacatcctccttttaaaaactccagcacatcatctaatactataccatcataacacaaaattactctcatatctccaactgtaacccatgctaccttatcataagattatttcatttatactataacttcacacaatttacctcaattgattgattaaactcacactatacacatgcatataacatatcctaaactcttacatcctatacatcatcattttatacactcaactaaatcaaatacattaaattctatttatcacaacta

SEQ ID NO: 39442 - DNA, 282 bp, Zea mays
  Clone ID: LIB3062-036-Q1-K1-H1
gccattccacattggtccatcggcagcgagcgaacaggctaaaaggagaggcctagaagcgctttggcgggtagagtggtgcaccgcgtagcgggacgacatggctgacacggcgtactccgaggcgctcctcgactgcgcacgcctgccggccgtcctgctgcctcggcgcagcagcgtgtgccaccaccagcttcaccttcaagacgcaccgaggctctaccttgcaccgtgccacggccgcttacgaggacacgtcggccttcgacggcgacgagctca

SEQ ID NO: 39443 - DNA, 423 bp, Zea mays
  Clone ID: LIB3062-036-Q1-K1-H10
cggacgcgtgggcggacgcgtgggcggacgcgtgggtttttgtggatgaagaaccagttgaagaaaacactccaaaagtattactgtccaagagaaagattatgtcaccgacgtctcaggagaagctttgcagtgctctgactggcattgatttgtgtgatggagttcaaagatttaagagcaaaatcattattgaagatcatgaaaacactccaaaatcattgttgcttatgagctttttgtttctgcagcagtgtgctactaatggttggaaagcggaacgaaacaatcaaacatcaggacaaagctctaaatttgtattgtcctttatggattggagataaagagatagagttttacagtcagttccacataattgtccttggtctagattcaattggtatgggaatataaattatgcgg

SEQ ID NO: 39444 - DNA, 457 bp, Zea mays
  Clone ID: LIB3062-036-Q1-K1-H11
cagctctgctggccctggccctggccgtgtcgaccgccgaggcgaggaacatcaagacgacgacggagaagaaggacggggcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagccttcccgggttcagcttgcccggcagcggcagcatgcccctcttcggcggcggctccccgggcttcagcggcttcggcggcatgcccgggtcccccaccgccggctccgtccccgagcacgccaacaagccctgaactccgtctgtccgtccgatccgtcgctggagcgaggtcgggctagccagcgtgcgtggtagtagagtgatggtactgtagtacgtcgtcgtcttcatgcatgc

SEQ ID NO: 39445 - DNA, 448 bp, Zea mays
  Clone ID: LIB3062-036-Q1-K1-H12
gaaatctaagccagccgaagcgcggaaggtcgaaccgatggctgctcccccgccgacgtcgtggcagatggctgccttcgtgccggctccggtggccaccagccctacgtcggaggggacgtccagcgcgtcgtctgatgactgcggcagcccgatcaaccacggtgcgatgccgttcagccactccagtcagcaccagcaccctcaccagcaccagcagcacatgccgtctgcctacgcgtccgggggctggtccctctcggtgcaccagcagaacaggcatgattctgacatgaagatgatgtcgaactaacaggcgccccattcgttggtgtttgcgctggagaggatagaaaggaacctgctgatggttaggttggtactgctgctatgaaacggtcctcttgcgcgtcgactgtgctctggtcagtgacgacgtgtcgatctg

SEQ ID NO: 39446 - DNA, 357 bp, Zea mays
  Clone ID: LIB3062-036-Q1-K1-H2
cctgaacggcgctgtagagcagatgtacaatgagatggcttctcgccaccgcgtgaggtcccgctggatccagatcatcaagaccgccacagtacacttcaagctgtgcaagagggacaacaccaagcagtttcacaacagtgagatcaagttcccactcgtgtaccgcaaggtcaggccgccgaccaggaagctgaagaccacgttcaaggcttcgaggcccaacctgttcatgtgatttagctgtggtcagtgtatgtgatcgtaagaatctgtgttttaagttttgacgctaagacttgggtggtttgaagattcaactcgttttgaaacgtgcatggtgaaccatttgccgac

SEQ ID NO: 39447 - DNA, 447 bp, Zea mays
  Clone ID: LIB3062-036-Q1-K1-H3
gctctgtccacctctctcgctctgggccgccgccgccgccctaagccacgtgctgaggctttggttggtctcttcgccggcgacgagcacccagcagttctgtagaaatggctgatggtgaggacatccagcctcttgtctgcgacaatggcactggaatggtcaaggctggttttgctggcgatgatgcaccaagggccggtttccctagcattgttggccgtcctcgccacactggtgtcatggtagggatgggacagaaggacgcatatgttggcgatgaggcacagtccaagagaggtattcttacgctcaagtacccgattgagcacggtattgtgagcaactgggatgacatggagaaaatctggcatcatactttctacaacgagcttcgtgttgccccagaggagcaccctgtgttgctcaccgaggctcctttgaacc

SEQ ID NO: 39448 - DNA, 312 bp, Zea mays
  Clone ID: LIB3062-036-Q1-K1-H4
gtggtttccaaagccaagtgtgtgtactagctagctccggcgcacacaaccacacacctgttgaattgtgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctccccttgtcaggctc

SEQ ID NO: 39449 - DNA, 458 bp, Zea mays
  Clone ID: LIB3062-036-Q1-K1-H5
ctcggcggccgtggcggcgccggaggactatgcgcggcctccaccgctgcccgcaccagctggtcctggtctctccaccgccgcggtccgcccccgcgtgccgccagtcggccaccgcctcatcgcggggcctcaggagctccctcgccgtcttctccgcacccggggctcgggtagcggcggcggcgcgcgagcagaagtggggccacgtggagggtgatgaagacggtggagaggagggcctaggggaggcgctccacaggacgcgggagctcgtggagtgcgccatgttcgcggccgtcgctgggctcgcctacttcctcagcaattccctcgccattgagaattatttcagttgctttttcccattgccgatagtcatttcctcattaagatggggactagaagccagcaagaaaaccgtggtggctactggtttactgctattcacattatct

SEQ ID NO: 39450 - DNA, 446 bp, Zea mays
  Clone ID: LIB3062-036-Q1-K1-G12
gcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgtcgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtggagaggctcggcgattacctgatcgaaca

SEQ ID NO: 39451 - DNA, 339 bp, Zea mays
  unsure at all n locations
  Clone ID: LIB3062-057-Q1-K1-D8
cacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaggccggcgccatcgccgncggcgccttcgcactctacgagaagcacgaggcgatagaaggacctcgagcacgcgcacaggcacaagatcacg

SEQ ID NO: 39452 - DNA, 225 bp, Zea mays
  Clone ID: LIB3062-057-Q1-K1-D9
gagccagccagccagccagccagccagccgcttgggcgccatctctctagagcgtcgtaccctcgaagagagatccggcgcggcccaataaacacccggctcactacagactcgcagatggccggcctcaggatgaagttcgtcgccgtcgccgccatggccgtcgcgctcgtggcgtccgccgcagccgccgaggctcccgtcccggctcccgcgttcgacgcc

SEQ ID NO: 39453 - DNA, 416 bp, Zea mays
  Clone ID: LIB3062-057-Q1-K1-E1
aagtaatgactagtgtgcgtgtgtctattcctttctatgggtttgtgcgtgatggctggtcatggtggtggtgggtgtgggtgtgcttcggtgcgtattgctgcctactgtgctggtgggtttattcggcaaatggatgaataggttgcagtaacaataattatgcatccagaaagaactgcaaaaagtgcggcttgcccaacgaggaagcatcaatgccaacattgcaaatggcacggatgactatgccaacttatgcaacttatattgcaagactacaaagccttgctgcttctgcttctgcctataagatgaactttgggatggctgccaattcacctttgcagcagcaactacttgcaaatgcaaactggccctatgggatggctggtagatatgggatgcaatcttctggt

SEQ ID NO: 39454 - DNA, 401 bp, Zea mays
  unsure at all n locations
  Clone ID: LIB3062-057-Q1-K1-E10
gccggtgtcaatggcagcgtcgtcactgagaaggtcctttctaacgataacttgaagtatggttacaatgctgctactggacagtacgaggacttgatggctgctggtatcattgatcctacgaaggtggtgagatgctgtttggagcatgccgcgtcggtggccaagaccttcctgacatctgatgttgtggtcgtcgatattaaggagccagagtctgcgccccttgctaacccgatggacaactctggctatggatactaatggagatgagatggccaagccgcatgggaagaaaggtgatcaccattttttttttggtaggcgagaagagtcgggtcgaggtagtttttcatcatcagattaaaaaagcgagtttgttgtacgaccattangcgaaa

SEQ ID NO: 39455 - DNA, 396 bp, Zea mays
  unsure at all n locations
  Clone ID: LIB3062-057-Q1-K1-E11
gaaataaatgactcgtgtttgttctttattcgttttgtgttgttatcggttacagttggagcctattggataacattattgaacagtgtaggattgtgtcactttatatctggaatttttttttctggtagttataaaaagtaaccatcttggtagttgatacaaccagatgccgcgttgtatacgggctgatggtcctttggttaactttcggcattacatttaactttcggngttaattgtccaggaggaaatagaggttgagggaaagttattacgtgctggaaaatcagtcggtgtcgtctccgtagatttcaggaagaaaaagacagggaaattgatggcacaggcccgtcacaccaagtatcttgtggcatcaagcaaactgtgaggcgc

SEQ ID NO: 39456 - DNA, 406 bp, Zea mays
  Clone ID: LIB3062-057-Q1-K1-E12
gcagctgttgatgcagttaaagaaccattggaagcacaactgtgttcaacaaatactgaagcagagaagctaagagatgttgtcaaagcacttgaggatcaagtagaaaaagagaaggcattgtgcgaagagcttgcagcaaaggtagagttgaaaactaaagcagcaagaactgctgaggctgttcaagaatccttggaggcacaactgtcttcagcaaatgctgaaatacagaaactggaagagatcacgaaacaactacagagtgagttagaaaaggagaagacacttcatgaagagttctcagcacagttagagatgaagattgaagcggagagaactcgttctatggaatctgctaaagaatcattagaggaacaattccagttagtgaactcagaaacag

SEQ ID NO: 39457 - DNA, 434 bp, Zea mays
  Clone ID: LIB3062-057-Q1-K1-E2
aagatttgagctctccatttgatcacacagtaatatccaatgcaaatgaaatgcagtgcaacagaaatgcagatgacaatggtttacctgaggattcaagcaagcatactaaaagaacaggtcgcaaggtgggcattttaagtcactgcccaaagcgactagttgctctcaaagtcatgtatttcggccagagattctatggtttttcttctgaaggtaacattgaaccaacagttgagtctgagatatttaaagcactggaaagagcaaaactgatggttgccaataggaaagaatcatgctactcgaggtgtggaagaactgacaaaggagtttctgctactggacaggtgatttctttatatctgcgatcgaacataaaggatgttgggggggacatgttagatgaaagatccgaaattgattatgtgaag

SEQ ID NO: 39458 - DNA, 407 bp, Zea mays
  Clone ID: LIB3062-057-Q1-K1-E3
aaacgcccatcattccagatgagatcaccagtgtctaccacaacgactctagtgaaccatgcaaaaggagcgtccaagtcgtttgacggaggctgtagatcacttgaacgctataagggccatgtaaacgggaatggtatgaacgtatctaccgattccagtgaagataaagattcaaacaactcagatgagaagtgtaacgagtttgcatctgctgagtcggaggactcggtgtcaggtgttctatatgatatgttgcaaaaggaggtcatttctctaaggaaggcgtgccacgaaaaggatcagagcctgaaagacaaggacgactcagttgagatgttggcaaagaaagtagatactttgacaaaagctatggagtcagatgccaagaaatcgaagcgcgagct

SEQ ID NO: 39459 - DNA, 223 bp, Zea mays
  Clone ID: LIB3062-057-Q1-K1-E4
gaaagagtgcaagaaaggaggacggtgctgacgatgatggcgataagccaccccatgattcgccacatcattccgtcgcctccggggcctgcgcgctagctgctagaagggcctcgccgtccgtcgtggtggtggtggtggtgtgcgcggagcgggaggggaggggaggggagtcgtcactgcgccgacacaatgccacaggaccagtgagctgccctgcggc

SEQ ID NO: 39460 - DNA, 388 bp, Zea mays
  Clone ID: LIB3062-057-Q1-K1-E5
gcaatcagatgcatgtcatccaagctctttgttggagggatttcttatcaaactgatgatcacagtctcagggacgagtttgccaaatatgggcaagtcattgaagctaggattatcattgaccgtgagtctgggaggtctagaggttttggctttgtaacttacacgtcttctgaggaggcttcagctgccattactgccttggatggaaagactctcgatggacggagcatacgggttaatcatgctaacgagaagaccggtggctttcgtggcggcggtggctatggtggcggcggctatggtggtggtggaggctatggtggtgctggtggaggcggtggatacggtggcggccactatggtggtggtggtggcagcggtggat

SEQ ID NO: 39461 - DNA, 412 bp, Zea mays
  Clone ID: LIB3062-057-Q1-K1-E6
cagaccatcaaacaagtgccagcgccctctcgcagtcgccgtattggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgatagtgct

SEQ ID NO: 39462 - DNA, 302 bp, Zea mays
  Clone ID: LIB3062-057-Q1-K1-E7
agttcatccgcagcagtggggaatatgacaagaatggcttcgtggaggacacagataagcccttcgagaagctgtccaccatcagtactggaattaatatgttggaagaggatggagaagttgatgcatatgtatcccctcataaggagatagacccacacaatgcagcacccaagcgaaagaaagccaggttcatgataccaaagagtgctcaggtggacagtgaagtgcgccgcgagctgcaagagctcatggacgctagggaggcaggcatgttcttcatcctggggcactcgtacatg

SEQ ID NO: 39463 - DNA, 348 bp, Zea mays
  Clone ID: LIB3062-057-Q1-K1-E8
cgaaggttgtgaacgccttgaagaaggaaggggtcagctttgggtccttcgacatcttatctgacgaggaagttaggcaaggtttgaagacgtactccaactggcccaccttcccccagctctactacaaatcggagctgattgggggatgtgatatcgttcttgagatggagaagagcggagagctgaagtcgaccctgtcagagtagacacctagctagcattcttgcttcgctggcgtttttatcacattgcctgcattggatcactctactctggtattcatgccattatattcatagatccacgttggtacttgtctgcagtgccacattgctagaattggga

SEQ ID NO: 39464 - DNA, 215 bp, Zea mays
  Clone ID: LIB3062-057-Q1-K1-E9
ggcgcggcggaagtgaagggcaagcgggcggtggatctcaagatgggatccatgacgcgggacaaggtgcaggacaagttcacgcagtactggtccttctttcgtcgacccaaggggacggtcaacaaggcggcgtccgccgaaaaagtgccagccttcgtctacaccttctacaaactcgtggccgacatctacgaatgggggtggtgccagtc

SEQ ID NO: 39465 - DNA, 371 bp, Zea mays
  Clone ID: LIB3062-057-Q1-K1-F1
cagtgttgaaaagataatttctgctgctgctttggttgagaaggaaaggtctagaagactcagcacctccattcttaatcaagttattagagaagctatagcattcaaatcaccaccaagaacaagaggtggcaaaagaggtcgtgtctattatacaacacaggctgccgtcggtccaccaacattcgttctatttgtaaatgatgcgaagctcttccctgacacgtaccggcgttacatggaaaagaaactccggtcagacgccggttttccaggcacccctattcagttactggggcgtagcagaaggcggccagacaaacgaggtaaatctgctgacagtagagcgcagagcccaagaacccctaacg

SEQ ID NO: 39466 - DNA, 406 bp, Zea mays
  Clone ID: LIB3062-057-Q1-K1-F10
atcagctttgacttacctttgttatgggcaacatactttatgttatattggtattaaaaatcttttaccagacaatgatgaattgctgtttgaattagggtccatttggccgcacacatctctggctctgctggcagctgtggcctgtgagcagatggaggtgcaccaagtgcatatgggcgtctagcagaggatctggagccttaggtttatgtaagcggagccactcttggtgctccgtcgcccttctggcttggtaggattgcctgcacggagcctgcccaaacacgatcttagatgtagatcatagatgacctacttggggttccacatgagtgattttacaacattttgaactagattgtgatttattgttcttgacttcaattttcaatatttatatatc

SEQ ID NO: 39467 - DNA, 161 bp, Zea mays
  Clone ID: LIB3062-057-Q1-K1-F11
gtaattcccggcccgacccactcttcctatcagctcttacttacctttgctatgaatcttacatactcaataacatatttataagacaagatttttaccatggctttcctgcataacaatattaacaataatacactcattctctttcttcatattctctt

SEQ ID NO: 39468 - DNA, 345 bp, Zea mays
  Clone ID: LIB3062-057-Q1-K1-F2
tcgagcgaggagagatcgttaggcaaatcggtgatgcactgagagcaaagctccatcaccttggcaggcttgtgtcacttgagatggggaaaattcttcctgaagggatcggtgaggttcaagaaatcatcgacatgtgtgattatgctgtggggctaagtcgccaactaaatggatccattataccatctgaacgaccaaaccatatgatgatggaggtgtggaatccccttggagttgcgggtggtataacggcatttaatttcccttgcgctgtgcttggttggaatgcttgcattgctttggtctggggaaattgggtcgtctggaaaggttctacaacaa

SEQ ID NO: 39469 - DNA, 379 bp, Zea mays
  Clone ID: LIB3062-057-Q1-K1-D7
cggacgcgtggggccgaggtcatgcgcctcgcagctggcgccgagcgcccggcggccccgggcccgccgccggcgccggcgccgcgcgacgacctgcccatcgcccggaaggcgtcgctgcagcggttcctggccaagcgcaaggaccgcctcgtggagcgcgccccctacgcccgcccgtccccatccgaggaggcggagaaggcgaagccggcctcctggctcgggctcggcggcacggacgccgagcgcctcaacatcgcgctgcgatttggatctcggttgctacccacccggatcgaccggtggcgatttgattggctgggttcctggcttcttttgggtcttgctggattggggttggtgtggagatcggaga

SEQ ID NO: 39470 - DNA, 364 bp, Zea mays
  Clone ID: LIB3062-057-Q1-K1-B8
ctagaatcacaaatggaggaattattcattcgacattcttggagtcacttatgaagcgagtgggagacatctttgcggagctgccaaacctcaaggacaacctctaccgatacttgagcacgggcacatggcctgacacacagaacgacgtggtggttctgtcgggggacctacaatggtacaatataccacctgcccatgctgtggcttctgccgttgagaacggcataccgagagtccctgccggcgtatctatgctcccactgcttcgcctgctgctggcaaccacacacgttgtgggactgatggagatcgaaaaggtacagattgtcatggaatgctaaaggatgagcgctgaaaattc

SEQ ID NO: 39471 - DNA, 408 bp, Zea mays
  unsure at all n locations
  Clone ID: LIB3062-057-Q1-K1-B9
atctcttcttaacctaactaacaccagctagcaactctttctctcctgcaataatgggcgttcgctcctcctcctccaagccgcaactggtcccggcggcggcggtcctggcagcggcgctgctgctgctggcggcgggggccgggacggcgtcngcggcggtgagctgcggcgaggtgacgtcgtcggtggcgccgtgcctcgggtacgcgatgggcagcgcggcgtcgccctccgcggcgtgctgcaggcgggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgccca

SEQ ID NO: 39472 - DNA, 358 bp, Zea mays
  Clone ID: LIB3062-057-Q1-K1-C1
gcggaagaggtagatggcgagctgcagcggcaaggctaaggcgtcgtcgtgggcggcggcgattagcgtcggcaccgtggaggcgctcaaggaccaggccggcctgtgccgctggaactacgcgttccggcaggcggcgcagcagctgcagcagcagcgcgccaggaggccagcatgcgcgagcggctcagtcggccccggcagcggcagcggtagcgcgcacgcgccgcctgcttctgctcgctcggtctgcgccgtggcggctaggaggagagccaggcatcatcatgaggaggagctccggacggtcatgtaccttaactactggggtcctaacaacttgctaccaactaccagt

SEQ ID NO: 39473 - DNA, 406 bp, Zea mays
  unsure at all n locations
  Clone ID: LIB3062-057-Q1-K1-C11
cccacgcgtccggggccttcgcggggagctcttgccctgcttctgctcctgttcgtccacggaggccagcgagcagcagaggccggcggggacgcgttcgtgagggtccagggcacccgcttcgtgcaggacggcaagccgttcttcgccaacgggttcaacgcctactggctcatgacattcggcgccgaccccgcgcggaggggcaaggtcacctcggcgctcagccaggccgtcggcgccggcctctccgtggccaggacgtgggcgttcagcgacggcggctgcggcggcggcagcgcgctgcagtactcttccggccgctacaacgagaacaccttccaggggctggatttcgtgctgtctgangcaaggaagcatgggattaagatgattctgagcctcg

SEQ ID NO: 39474 - DNA, 392 bp, Zea mays
  Clone ID: LIB3062-057-Q1-K1-C2
cttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaagcctcgaggaaatcctcaccccgtgtgaccaatgaaga

SEQ ID NO: 39475 - DNA, 421 bp, Zea mays
  unsure at all n locations
  Clone ID: LIB3062-057-Q1-K1-C3
cggcgtcgccgtgggctcggtctcgctcgccgcatacggccgcagccagacagccaacgtactcggggcggttgccgggccggggtccgcgatcgatggctgcgcggcggagcaggggctgggcgcgcggcgcggcggcgttcgcggccgtggcgctggcggtgggcgcggggcggaggtacgggtgggacggtgcctccgcggtggcggcgttccgcgaggcccagggcgcgctggggcactgggcggcgccggcctacgtggccgcgcacgcgctcacgcttgcgctctgtccgccttacgccatcttcttcgagggcggcgccgcgctcatcttcggcttcctgccaggcgtcgcatgcgtcttctccgccaagtccntcgggcctcgctctccttctggatcggcagggcaattttc

SEQ ID NO: 39476 - DNA, 415 bp, Zea mays
  unsure at all n locations
  Clone ID: LIB3062-057-Q1-K1-C5
gtcaagctctccaacaagtggcggtaacattttggtggggagtaatccgtttggagccaagctttccaacaagtggcggtaacattttggtggcgtacatccctattttgttggggcttattgcctgctctggtatcagcacgaattaactagcttttgccacaagcttggtgttagtttgtgagggtgaataggccagtgaaattgttctgctgcttagcatagttggatgccaattgatctatagggttagaatgcattttagcttttcctttgctaatcaaattgccaactgctaatcttgatccttggctgttgatgcacttttctgctcgatgcatgcaaagagattatttcatttatagcacanattaattggaagcagcagctggttgcttcttcaacatgcgcattc

SEQ ID NO: 39477 - DNA, 401 bp, Zea mays
  Clone ID: LIB3062-057-Q1-K1-C6
gtaacattataaagcattttgaagttctattgtgggttcatgtgtcaagagaatttgctgttgaaaagcttgtggagaagttgtttgaagccattgctggtgacatgtctgaccacctcccattgcagcatgtgagcagaactatctcagacaagttgcagaagcagtggattctagttatgcatacgacctaccattcttgtctaaggaagatagctggaaagtgttccaacaatgttttggaattgccatgaaagctctagaccctgaatttccaacaatgttttggaatgaaaggaattgaagaatggcagtccatatgcaatagtaatttattagatgtccaggatgacgaacatagagtatttgcatgcttgtggttgaagtttgttcatttaccg

SEQ ID NO: 39478 - DNA, 335 bp, Zea mays
  Clone ID: LIB3062-057-Q1-K1-C8
cgaataatctcttcttcacctcactaacaccagctagcaactttatctctcctgcaataatggccgctcgctgctgcggctcccagccgcagctggtcgcggcggcggcggtcctggcagcggcgctgctgctgctggcggcgggggccgggacggcgtctgctgcggtgagctgcggcgaggtgacgtcgacggtggcgccctgcctagggtacccgatgggcagcgcggcgtcggcctccgcggcgtgctgcagcggcgtgcgctcgctcaacagccgcgcgtcatcagcaacggtgcggcgggccacctggaactgactgatgagcatgacc

SEQ ID NO: 39479 - DNA, 408 bp, Zea mays
  Clone ID: LIB3062-057-Q1-K1-C9
aaatgttttgaggaacttcttccaagattggtgaaaaaaggaagtgatggtaatgctggatccagtgctctttgtgacacgacctgcttgcaggcgctctccaaaaggatccactatgggaagtttgtggcagaggctaagtttcaggagtccccggaagcttacatgccagccataatagctcaggaccgtgatcaactcatgcaccttctcacatatgaaacggtggagcgtgctatcgaacacagggtggaagccaaagccaagatcttcgggcaagaggtgaacatcggtgtggaggacaacggcagcccaccggtgtacaagatcgttccgagcttggtcgccgagctgtacagctacagaatcatgccgctaaccaaagaggttcaaatcgcgtatttgctt

SEQ ID NO: 39480 - DNA, 181 bp, Zea mays
  Clone ID: LIB3062-057-Q1-K1-D1
accaaaagagaaagaaaggtcgacagggcacttcttgcctggtgcgtatagaccaatgtgccttaaacaaaaaggtccatatgtctccgagacaactctaaccccgccgccttctatatccacacagtgcagcacctgataaaaaggtgcatgacgttcgggatgagcatgtaggagtgca

SEQ ID NO: 39481 - DNA, 345 bp, Zea mays
  Clone ID: LIB3062-057-Q1-K1-D10
gtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgatgagatgttggcaaagcaaggtgccaatgttgacaaagtcctgaactttgcaattgatgatgctgtattggaagaacggattactggtcgttggatccactcagccagtggtaggacttaccactcaaaatttgcaccttcaaagtcttcaagaattgatgatgtaact

SEQ ID NO: 39482 - DNA, 370 bp, Zea mays
  Clone ID: LIB3062-057-Q1-K1-D11
tcgcggacgcctgggctctctcgagtcgattcctaagcagcttgccaatgaattgaggttaagcttccaacatggggggaagttgttattgccctgttcctcctgctttgttaagccttctgttcctttgccaaccggccggccggcgtcaactacggttcgtggcaaagcgcccacgccacgttctacggcggcggcgacgcgtctggcacgatgggcggcgcgtgcggctacgggaacatgtacagcacggggtacggcaccaacacggcggcgctgatcacggcgctcttcaacgacggcgccgcgtgcgggtcctgctacgagctgcgctgcgacaacgacgggcagtcgtgcctgccgggcacca

SEQ ID NO: 39483 - DNA, 140 bp, Zea mays
  Clone ID: LIB3062-057-Q1-K1-D12
caatggaaaggtcgctgatgagtggacatgcagagtgacgccctacgtcatgctgacgatcaccatccctgggatcagaaaccattcatggtattccttctccataataacctcatgagcaatgtattccagaattccca

SEQ ID NO: 39484 - DNA, 412 bp, Zea mays
  unsure at all n locations
  Clone ID: LIB3062-057-Q1-K1-D2
cgcctccctctctccctcccacactccaccacccgcgccgccgcctcctactccgccccggcccctctgatccggaccgagcgccggccatggcgctcgctttcgacgagttcgggcgccccttcatcatcctgcgggagcaggagaagaagacgcgccttagggggctcgacgcgcagaaggccaacatcgcctcggccaaggccgtcgcgcggatcctncgcacgtcgcttggacccaaaggcatggataagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtacccaccgggtggtagtcat

SEQ ID NO: 39485 - DNA, 173 bp, Zea mays
  Clone ID: LIB3062-057-Q1-K1-D3
ctagtttcttaataaactttctaggcaagcaagcaagaatttagttgtgctgtagttaattgttttttggccgatcagtttgcatcgatcctattaaattctgaacaacaggtatttatatgcatcttattcaaatttaaactggcattctctacattatgcaaatatgttgg

SEQ ID NO: 39486 - DNA, 366 bp, Zea mays
  Clone ID: LIB3062-057-Q1-K1-B6
tcgatatggccggccattgtacatcatacatttgcttacagaagaagtgcatccttaattatgacactgggatgggattccaccttcaccatttttatggggtttccctagactagacacactggatgactgaacacgacttagagagcagcagtaaacttacagctgcattttgttatattttttggtcatttttttttttacttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttccgttctagatcgcga

SEQ ID NO: 39487 - DNA, 377 bp, Zea mays
  unsure at all n locations
  Clone ID: LIB3062-057-Q1-K1-D4
ggccctatggccagagggctgtcctcaagtttgcgcagtacactggtgcccatgccattgctggcaggcacactcctggtacattcaccaaccagttgcaaacctccttcagtgagccacgccttcttatcctgactgacccgaggactgatcatcagcccattaaggagtctgcgcttggaaacattcccaccatcgccttctgtgatactgattcccctatgcgctatgttgatatcggcattcccgccaataacaaggggaaacagagcattggttgtctgttctggctgctcgcccgaatggtcctncagatgcgcggtacaattcttccaggacacaagtgggacatcatggtagatcttttcttctacaga

SEQ ID NO: 39488 - DNA, 72 bp, Zea mays
  Clone ID: LIB3062-057-Q1-K1-D5
cacacacattaccaaacagctttctattctatacgaaaatgtaaagatagctcgacgggttactttttgccc

SEQ ID NO: 39489 - DNA, 309 bp, Zea mays
  unsure at all n locations
  Clone ID: LIB3062-057-Q1-K1-A10
ctcttctcctgcgtcccaactgggcaattccccaaacctaactaacctttgccaccgcgggagccaccatgggtggccagatgccggacgccgatgggaaggcccgctcggcggactcctcgtcctcttacgggtacccgccgtcggcgccgtcgcagcaccagtacggcacctttggccccccatccggagcctccggggagtttccgcagccggcggtcgggttcccccagccggcgccgtcgnctgggatgcagcactacccgcagccttcttcggcgtcgtatgccgtctacccacccccgcagc

SEQ ID NO: 39490 - DNA, 404 bp, Zea mays
  Clone ID: LIB3062-057-Q1-K1-A11
agcttctgtttggctgttgccttgcgggtggcggctgctttggtgcgctgcgcagtgcgctacgtccgtgcgtcgaccggaaggccgtcccctggcccctgctcgtcgtcttcctcgggcgctcgtcttactccgaacgcgcgcgggccgccgacctgcttgttctcctggaggagcgcgcccggcgggcaggcgacgcattccagcggaggcttgaggaagaatgcgagcgaccggtggatccccgtccatccgtcccctgctactattccttgggtcgggcgctcgtcatccactcttcctgcagccctccatctgatccccgtacgaccgttccctgctcgtcttcctggtgctcggctgctacagtgctcggaccctgctgcagtgctgctcagtcgcgt

SEQ ID NO: 39491 - DNA, 375 bp, Zea mays
  Clone ID: LIB3062-057-Q1-K1-A12
cccggtctgcacaccgaggccgtgggactgctgcgacagcgtggcctgcacaagggactacatccccaactgcatgtgcctggacaaggtggagtcgtgctcgagcaactgcgaacggtgcgagtttctgtatcattcggacccttctcgcttccaatgccgagacatcttccacggctatcctggtcccaagtgcaggacatggatcagtacgagcaactagctcagctcagctacttgctaaaagtagcgtagcgcagcgcgcgcggctacttgctagtatacgtacgttcacaaattaaaataaaagtggctagcgtacaaagctaacatctggttgttcgtcccgacatggacgattagcctagctcgatc

SEQ ID NO: 39492 - DNA, 415 bp, Zea mays
  Clone ID: LIB3062-057-Q1-K1-A2
gtcatccctgtactcctgtttgtgggcgtagtttttatcgtgattggccttggctgcattgcagcctcaaacagggtggttgaagtggtctatgagtatgagacttcatgcataccaagacacatgcttggcaacaaagtcgcctatatccaaaacccagctatagataagacctgcacatggattctcaaggttcctagggatatgaagcacccaatctacgtatattaccagcttgacaagttctaccagaaccacaggaggtacgtgaagagccgcagcgacaagcagctgagagatcccaaagaggccaacagcacgcagcagtactgcaagcccgaagctaccaccgagcacgggagcgccgtcgtcccctgcgggctcgtggcctggagcctgttcaacgacacctaca

SEQ ID NO: 39493 - DNA, 373 bp, Zea mays
  Clone ID: LIB3062-057-Q1-K1-A3
ggcgactccaggttcgtgggcgatgctgcgcgcgggaggtaggcagctccttgccccggtgctccggcggctcggtctgggcaccggcgccgcctgtgaggtgggccctgccgacgaggaggcagtgatgagggcgtaccacgagcgggtggaggaccactacaacaaccgcgtgtaacgtccgttccattgacaaggaggacctcatcgtctgtactgatctggtcatgacgactgcctgtggcgacgtcatgaagactgaaatacgcttcaacgtggactccagtaaaagcggctactcctgcattatgaccataggctgatgcttcgccataacgttattgtacgaagctactgaatgggtgcagggaaa

SEQ ID NO: 39494 - DNA, 166 bp, Zea mays
  Clone ID: LIB3062-057-Q1-K1-A4
aaccccggcgcgaccacgcatccaagcgactccatgcacgccggctttgccacacgccaaagcaagaccgcgccagggcggggagcttcgtctccctggggggggcaccctcacaaaaaaccacctgctaaaaaaaaaaaaaaaaaaaaggttttcctcttaaaaa

SEQ ID NO: 39495 - DNA, 260 bp, Zea mays
  Clone ID: LIB3062-057-Q1-K1-A5
attcgggcgactccaggttcgtgggctatgcttcgcgcggaaggtaggcagctcctggcccgggtgctcccgcggctgggtctgggcaccggcgccgccggtgaggtgggccctgccgccgcagctacagtgattaaggcgtaccacgagcgggtggtggaccactacaacaacccgcggaacgtccgttccttttacaaaggagaccccaacgtcggtactgggctggtcggcgcgccagactgtggcgacatcatgaa

SEQ ID NO: 39496 - DNA, 118 bp, Zea mays
  Clone ID: LIB3062-057-Q1-K1-A6
acgcgttcaataaatgtggatggcgcgtgcctctgtttcttcaggttcatgctgagtcttgacatgtttggcacttttggttccctggctggtaccatctgtgacaaatccgctcgct

SEQ ID NO: 39497 - DNA, 345 bp, Zea mays
  Clone ID: LIB3062-057-Q1-K1-A7
atcctctcggctagctagctagctaggacagatgagggaggggaaggcgctggctatggcgactgctgcggcggcggcaacgtctgccatggacgatccggacgtactgaactgccgcgacatatcttgctggatcacttccggagtgttgctaccgtcgaccgccattgtgattgtgccggcaccgttcgactagtgcatttaccacatgctgaaccgatcctgactttaccatgcagcgaagcttgagacgtgtgactaggatgacaatgcggtgacgaccagtcgtgtggactgtgaactgtcggacttgtacaataacttcaacagcacactgcacgggac

SEQ ID NO: 39498 - DNA, 414 bp, Zea mays
  unsure at all n locations
  Clone ID: LIB3062-057-Q1-K1-A9
agttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtgtatggagggtaagtaaatggttttcgtagtttcttgggcatgtttatttatttatttatttttggtaattcagatcacactacataactactagttacccaagctggcacatagctaacttaaaacataacactataacaagcaacttgtccaccatatgtcatcaagcatatntctttgaaagattcagtcaacctggagaaattatctttattggtca

SEQ ID NO: 39499 - DNA, 248 bp, Zea mays
  Clone ID: LIB3062-057-Q1-K1-B1
cccgagcaggtacatagagcatccgagacctcgtcgaggggcgacgagcatacgtcggcccggcacgcgtctcgccttccttcaagctacacccgaggcaggtgctcgatgcttgcacgttcgcgcaagggagaagcattgagaacaggcggaccgacgacgaacaagggtggtgtacgtacaagacgtggtggacgagcgagcatggcggaccttctacaacgaacttcaagatcacgcctgaaggt

SEQ ID NO: 39500 - DNA, 384 bp, Zea mays
  Clone ID: LIB3062-057-Q1-K1-B10
atctcttttcacctcactaacaccagctagcaactctgtctctcctgcaatgggggcggctcgctcctgggccgggcaggcgcagctggtcgcggcggccgcggtcctggcagccgcgctgctgctgctggcggcgggggccgggacggcgtcggcgtcggtgagctgcggcgaggtgacgtcgtcggtggcgccgtgcctcgggtacgcgatgggcaacgcggcgtcgccctccgcggagtgctgcaccgaagtgcgctcgctcaacagccgcgcgtcgtcagctgcagaccggcaggccacctgcaactgcctcaagagcatgacgggccggctcggcagcaacgtcagcatggacaaccccggcaacattctcggcaagtg

SEQ ID NO: 39501 - DNA, 401 bp, Zea mays
  Clone ID: LIB3062-057-Q1-K1-B11
gaacgaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacattcgcaacatggagttcccatggggccctgatggcttgtttgagacgaaggaccaccactgagccctgattagcacaccttcaggagctggtgcacgcttaaaagagttatatggttgtttcagtgat

SEQ ID NO: 39502 - DNA, 399 bp, Zea mays
  Clone ID: LIB3062-057-Q1-K1-B12
cacaaggaggagacgcggagcgcggcggtgcacgccgacgtcgccagggggtaccgtgcgcgcgtggaggccgagctctccgggatctgcgcggggatgctgcgcctcctagacgagcgcctcgtgcctgcggcggcggccgtggacgccagggtcttctacctcaagatgaaaggggactaccaccggtaccttgccgagttcaagaccggcgccgagcgcaaggacgccgcggactctacgctcgccgtctaccatgccgcgcaggacatatccgtcaaggagctgccgaccacgcatccgatcaggctcgggctagcactgaacttctccgtgttctactacgagatcctcagctagccggaccgcgcctgctcgatggccaagcatgccttagac

SEQ ID NO: 39503 - DNA, 352 bp, Zea mays
  Clone ID: LIB3062-057-Q1-K1-B2
gcaagtgaagaagtacagtggtggcatgaggaggcgccttagtgtcgccatctcgttgatcggagatgctaaagttgtgtacatggatgagccaagcaccggattagacccagcttcgaggaagagtctgtggagcgcagtgaagcaagcaaagcaggatagagcaatcattctcaccacgcattccatggaagaagctgaaactctttgtgacagactgtgtatcatggtcgatggaaagctccagtgcataggcactcccaaagagctcatagctagatacggagggtactacgtgctgacgatgacgacactgccggagttcgaacaagaggtcgaagatctggtgcgc

SEQ ID NO: 39504 - DNA, 424 bp, Zea mays
  Clone ID: LIB3062-057-Q1-K1-B3
ggaggggcagggaccttaaaaggaaccattttagtgtctgtttgactatttagggactaaaatgcagggactaaaaattagttcttggaaccaaataggtctaacactctaaaaggaagagctgcagtgttttctagaaatgattgtgtacagaatagtcactgctgtaaagtgggttcataccaatttgatacaacattcaccttcacaaagaaaattcagatgacatgtaagattatgcctgacagcctgaggaggtctttcaaaaaccaatctcacaactgctgtctgacatgtcctttcattacttaatatgtgttcccttgcgtctgtagaaaaactacataaaagaagaaacgatagaaaggatgaggttagatgaagaggtgcttatgggatttcttcagggaacacatcaacgtga

SEQ ID NO: 39505 - DNA, 345 bp, Zea mays
  Clone ID: LIB3062-057-Q1-K1-B4
tctacgctttcggtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgacgtggtcaccgccaccggcgagggcgagtacgagaggtacaagaaggaggagaaggagcacaagcacaagcagcacctcggcgaggccggcgccatcgccgtcggcgccttcgcactctacgagaagcacgaagcgaagaaggaccccgagcacgcgcacaggcacaagatcacggagg

SEQ ID NO: 39506 - DNA, 392 bp, Zea mays
  Clone ID: LIB3062-057-Q1-K1-A1
agttgctcaagatgtaattgcttcgattcatggtgtgatttacagcatccgtgagagtatcaagttcataaaagcttctccaagtcgtgaggagaagtttgctgagattgctctgcagctggagattcccagtaccaagactctttgtttagatgttacaacccagtggaacacaacttatctgatgctactggctgccttggactataagcaggcttttgctacactggagacatgtgatgataattacaatgaatctccttcagcagaggactggaagaaagttgaggctagctgtaattacctgaaactgctatatgactctgcacatagtgtgatggcttcagcgaaccctactgcaaacatctttttccatgaagcttggaaaattc

SEQ ID NO: 39507 - DNA, 396 bp, Zea mays
  Clone ID: LIB3062-057-Q1-K1-B5
agcagcatcaggtccagccgtcgccgttcccacttcccaccactgccacgcgcgcccgggatcgagggagggcacgcagacgctgaggagggaggatgagtctcttcgggcttggacggaaccagaagacattccgccccaagaagagcgctccatcaggcagcaagggagcacagctccgtaagcacatagatgccactctcggcagtggaaaccttagggaagctgtgaggttgcctcctggagaggatatcaatgaatggcttgctgtcaataccgtggatttctttaaccaagttaatatgctgtatggcacgctcacagaattctgcacacctgagagctgcccgacaatgacagctggcccaaagtatgagtacaggatggctgatggtg

SEQ ID NO: 39508 - DNA, 445 bp, Zea mays
  Clone ID: LIB3062-059-Q1-K1-H5
agtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgactttgttactgcagaggatgtccagaagagcaggatcttctatatcctatggtccccatccttcgtcaaggtgaagagcaagatgctttacgcaagctcaaaccagaaattcaagagtggcctcaatggcattcaggttgaactccaggccacagatgcgagtgaaatcagcctcgatgagatcaaggatcggtcacgctaggcgcaccgtcatcgcgagtttcatgatcacgcatcatggactcgcctactactgtggatttgtatgccattata

SEQ ID NO: 39509 - DNA, 394 bp, Zea mays
  Clone ID: LIB3062-059-Q1-K1-H6
gtttgctaggacttcattgtagatgattttaagagccaaggatcacatgtgccatacaacattgcagaattttctacccaggcttctcaaggtggttatggtgttgagtttactcatgcgccccaatctggatactctgggaattatatgaaccaaaacacacatcctggatactcccatattggtacatcaaatgacattgtatctcaggatcacatggcccatggatctcacggaatgtttactcaagtggggtataatgatccgtcgcaagatgagtcatctcagattcattatggaatggctgctgctggtcccctacattcgcagagcatgatgaaccccttatactctcaatcctatgctcactacaacacccagccacattctcttc

SEQ ID NO: 39510 - DNA, 428 bp, Zea mays
  Clone ID: LIB3062-059-Q1-K1-H7
ctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgtcagctggagcagatggtgttgctaatatcaatgtcaccgacagccagatcccactgactgggccaaactcaatcattggcagagctgttgttgttcacgctgatcctgatgatcttggaaagggtgggcacgagctcagcaagagcactggaaacgccggtggccgtgttgcttgtgggatcattggactccagggctgaaaacgatcgccggacttgggggtgcctgagaggtccgtctcctgccgtacccagcagactagcctgaacattcggagacatcgt

SEQ ID NO: 39511 - DNA, 331 bp, Zea mays
  Clone ID: LIB3062-059-Q1-K1-H8
tcgtgaactcaaaaggtttgtttgagaaaaaattgtcccaagattggattgcttgttaaagctcaatattgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaactaaacaaaaaaaaaaaaaataacaaaacggggggtctattaaaaagatccaaattatccttcaaagtattgccactaactcatctatatcaatggacaccaaaattaaccaaatggcccgctt

SEQ ID NO: 39512 - DNA, 137 bp, Zea mays
  Clone ID: LIB3062-059-Q1-K1-H9
ggtgtgcaaatcgcggcagtcgcagttcctgagcaacggcgatccggggacctcgggaggcctgtccctcgcgatcggcggcacggtcgttggtcactggactaacaagctgcaacacctgaagcagcatatgctgc

SEQ ID NO: 39513 - DNA, 379 bp, Zea mays
  Clone ID: LIB3062-059-Q1-K1-H2
tcggacggatctcttgattcagatgtcgaccatataatggatacactattgacgctcaacgagaggtcaactcaagctcatgcaggcagatcacaatctggagataacgaggggtactctacctccaacttaggactggtatgcatacatgctcaacttatcatgctctttgacagagacgtgctactacctgaccgtctatggcaactagtcatgcaatctccatccaccatactgcgagaccttattacaccgcgccacctggcgcgcctacaacgcgcgcctaatggtggacttcatcgcggacacactcggccttccgttcgtgcgaccgtatctgagctgacggatcgcggatgacttgcccggctgatccaac

SEQ ID NO: 39514 - DNA, 373 bp, Zea mays
  Clone ID: LIB3062-048-Q1-K1-G4
ccagttttggagtggccagctagggttaaaattgcggctggttcggctcgtggaatagcctatcttcacgaagattgtcaacgcataataatccacagggatataaagtcctccaatatcttgctggataataactttgaagcactggttgctgattttggtcttgcaaggttagctatggatgcttgcactcatgtaaccacacgagtgatgggaactttcgggtaccttgctccagagtacgcgtcaagcggcaagttgactgagagatctgatgtattctcattcagtgtacgcctcttggagcttattactggtagaaagcctgtatacgcatcgaagccattgggtgacgagagccttgttgaatggg

SEQ ID NO: 39515 - DNA, 361 bp, Zea mays
  Clone ID: LIB3062-048-Q1-K1-G7
atgacagtgtggcacgtttcttggaatcacgtggaatgttggaggaagccctcgagatagcgactgacactaattacagatttgacctggctgtgcagcttggtcgacttgaaatagcgaaggtgattgctactgaggtgcaaagtgaatccaagtggaagcaattaggggagttagctatgtcaaatggaaagcttgaaatggcagaggagtgtcttctacatgcaatggacctcagtggtttgttgcttttgtattcttcccttggggatgccgaaggcattaacaaattggcatctgtagccaaagaacaaggaaagaacaatgtttctttcctttgtttcttcatgctaggaaagct

SEQ ID NO: 39516 - DNA, 398 bp, Zea mays
  Clone ID: LIB3062-048-Q1-K1-H1
ggggttgggaagacttccttgatgaaccaatatgtgaacaagaagttcagcaatcagtacaaggctaggatcggcgcggatttcctcaccaaggaggtgcagttcgtggacaggctcttcactctgcaaatatgggacactgctggccaggaaaggtttcagagtctcggcgttgcattctaccggggagcagattgttgtgtcctagtctatgatgttaattctatgaaatcatttgacaacctgaacaactggcgagaagagtttgtaattcaggctagcccatcagatcctgataatttcccttttgttctggtgggtaacaaagttgatgtagatggtgggaacagccgcgtggtatctgagaaagaagccaaggcatggtgtgctttcaaagg

SEQ ID NO: 39517 - DNA, 422 bp, Zea mays
  unsure at all n locations
  Clone ID: LIB3062-048-Q1-K1-H10
cgcgtgcgaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccgggatgaagaagcgccgggcgagcctcttcgacgtcggtatcgcggactacaaggacaaccaggtgccaggccctcagagcatcgtcactgccaaaccggcgcctacgcaggagataatccacaccgaccgcggcgacgtccccataccaagacgatatagaggcctcggagagattttaggcagtaacatgcaggttaatcaactgactgactactactatttcaacaagaactnccatgttcccgcggggac

SEQ ID NO: 39518 - DNA, 158 bp, Zea mays
  Clone ID: LIB3062-048-Q1-K1-H11
cgtggaggtcgggaaatggagtgtcgctgagcccgggtcgctgtgggggcaccagctggaccccaccggacgacgaggacgaggtctatccgtaccttggcgcgaggggagaggaagaggacacggtcacgttatggtgcttgacatctgctgaggag

SEQ ID NO: 39519 - DNA, 345 bp, Zea mays
  unsure at all n locations
  Clone ID: LIB3062-048-Q1-K1-H12
gtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggcgggcagctgttctcggccatggtggtgcgcangccggcgcacctgttcctggacgagctgggcgtgggctacgacgaggccgaggactacgtggtggtcaagcacgcggcgctgttcacgtncaccgtgatgaagccgcttcttgcgcggnccaacgtgaagct

SEQ ID NO: 39520 - DNA, 370 bp, Zea mays
  Clone ID: LIB3062-048-Q1-K1-H2
ttccggtcgcggacgcgtgcggccacagtcatcagccgccgtagggagcatgagtgagggagcgcgatggcggagaagaaggggcgccgaggagggtccaggagggacgaggtggttacccgcgagtacgccatcaacctccacaagcgcctgcacggatgcaccttcaagaagaaagcccccaatgctatgaaggaaatcaggaagtttgcacagaaggcaatgggcaccactgacatcatgattgatgtgaaactcaacaagcacatctggagcagtggtatccggagggttgcgtggcgtgttcgttgtatgatcgcacggctgaggaacgatgagggagacgcctaggaagagctttactctcttg

SEQ ID NO: 39521 - DNA, 312 bp, Zea mays
  unsure at all n locations
  Clone ID: LIB3062-048-Q1-K1-H3
gnnatagagcaaggggactccaggacagangctgcatcaccgcttccttacaatgtaaaactggaggaagtcgaatctttttttgctcagtgtggcaaggtaaatagtgtgaggctacctcgacatgtttctgacaaaaggcatttctgtggcactgctttagttgaattttcagaagaagatgaggcaaaaggcgtttttgagaaaaatctcatttttgctggggcagacctggaaataagaccaaagaaagaatttgatactgaaagagaggcatagaaagaagcctatgagaagtcacatcctaataag

SEQ ID NO: 39522 - DNA, 152 bp, Zea mays
  unsure at all n locations
  Clone ID: LIB3062-048-Q1-K1-H5
ggaaaacangganccagagacggagcgagnagacgaggangggcnnggagnaagggagagcagggctgaggcngnaagagcagagagaagcaaccnnggcangcagccnngggagggaaccgacgaggacccaagcaaggcaagggcgcaca

SEQ ID NO: 39523 - DNA, 406 bp, Zea mays
  Clone ID: LIB3062-048-Q1-K1-H6
acaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgagcctccgccgcctgctgcggctcctcgccgcgtcgggcgtgttcaacgtcgacaagcatagcacggaagaggagcggtaccgcatcaagccccgggatctaccttctggtggacggcatccctcacgaggaccacatgaaccactgccgtctggtgctcacctgcaccttgacgcgctaca

SEQ ID NO: 39524 - DNA, 426 bp, Zea mays
  Clone ID: LIB3062-048-Q1-K1-H7
aacgccgatcggaggccggagagaccggctcagcctcgctccgccgccgccggcgaccatgtccctggcggctatcttcgtcttcctcatcgtgtccgcgctgcagctgctcgaccgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgccaaggagaaggaactggcaaaaatgcaggaacatgaccttaaagggaagcaatccttatacgacaaatacacaaaatttttggtggttactaaggtccatatttatgctgggctcgttctgggcttttggagtactcctgtaactgccagttcacaaca

SEQ ID NO: 39525 - DNA, 241 bp, Zea mays
  Clone ID: LIB3062-048-Q1-K1-H9
ttccggggcctgcgtctgaagacggattgcctggtcatgtagatgggtatcttttagaggcaaggataaaccatccagggggatgtacagtggtcgacaggggtagcatttatccggctgatgccatgaacttggccttaatactgatcaatgttacaggtgttacaactattgctgggggagaaattagtcatcgaaggccatgtttacggaccaactgctgaggcaaaattttctactg

SEQ ID NO: 39526 - DNA, 204 bp, Zea mays
  Clone ID: LIB3062-049-Q1-K1-A1
cgcgtacggcacgcattactactcactcactcactcaattcgaatgccagctcagctctgctcagctggggacacgttacacccacatgcctgccgacacatcaccgccgatatcacagcaaagcggtatccaggtccgtcgtctacagcggcggcagccatgaacaaagacaagcaccacgagcactagcaccaccctactca

SEQ ID NO: 39527 - DNA, 327 bp, Zea mays
  Clone ID: LIB3062-049-Q1-K1-A11
aagagtactccgaatgagagcatcttgcgttctcacggcttggagactcgcctattcaggggcgcgtgtgaaaccctgtgcgacaacggactaaaatggctgagctgcgcgaactagtatcttgtgtgctagagcatatacatcacgacttggatatcgttggttatacaaagagtgtatgcacctgaaagcattagtgcttgtgcaatgccatttcctgaacacgccaactacaccagggacacataatgaacattgaaatgagtgtctactcgagagcttatcaatcgggtacctcgaagagacttctttgtggataaacagatg

SEQ ID NO: 39528 - DNA, 414 bp, Zea mays
  Clone ID: LIB3062-049-Q1-K1-A12
gaattcccgggcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcaccaggggccggcttactgaagctgcacaagggcgacatcaccctttggtctgtcgactgcgccaccgacgccatcgttaatgctgctaatgagcgaatgttaagtggcggaggtgttgatggagctatacatcaagctgctggaccagagctagtgcaagcatgccggaaagttccagaggtcaaaccaggagttcgttgtcctactggagaagctaggattactcctgcttttgagct

SEQ ID NO: 39529 - DNA, 300 bp, Zea mays
  Clone ID: LIB3062-049-Q1-K1-A3
ccactcatcactcctcactcactcactcaaaacgaaagccagctcagctctgctcagctgctcacacctcacacccacaggcctgccgccacagcaccgcggatagcagagcagagcggcagccaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttct

SEQ ID NO: 39530 - DNA, 415 bp, Zea mays
  Clone ID: LIB3062-049-Q1-K1-A4
gtcacgcgtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctcgggctcgacagcctggacaccgtcgaggtggtcatggccatcgaggaggagttcaagctcgagatcccagacatggaggctgacaagatcgac

SEQ ID NO: 39531 - DNA, 348 bp, Zea mays
  Clone ID: LIB3062-049-Q1-K1-A5
caacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttggtgttgcccatctgtgtttttgattg

SEQ ID NO: 39532 - DNA, 346 bp, Zea mays
  Clone ID: LIB3062-048-Q1-K1-G3
aacctcggaagcagcaacggagcctgatcttatgcggaggaaattttgtacataatacacggacctgcaatgtacagaaacaaaagggctatttactaacgtctgctgcctgacagaattgaactagatcgcttggtacttgtacatggccgccctttgcgattatctttctcactattctcagtctactatacagatgagtgccatggcatggtaacctcaataacaacagatatagttaacttgggataaactgaagagataatcatgaacagggttctggaaaattaccagataccgtccaatctgaatctatagagctaaaggaaatctgactgtgttatgc

SEQ ID NO: 39533 - DNA, 226 bp, Zea mays
  Clone ID: LIB3062-048-Q1-K1-D10
ttccgggtccgaccgaccttccgttttggtttcttttttcaacctgttttcccccgcttggcaagcaacgccaaccctgagccagcaacccccttcttggaagcttttcgcaaccgattaactaacccttcgcgccaagattcggggaaaaaaacccaccggaacttaacttgaaccggggtggttggttcctgttccgccgcaccaggattgacccgaaacccct

SEQ ID NO: 39534 - DNA, 245 bp, Zea mays
  Clone ID: LIB3062-048-Q1-K1-D4
gcctcagcgctctacctcaacatctcgggagtgacggacttctgcgcacagcatgtggcagccccagctacatagctcctgaggttctgcataacagaggctatgacggctccttgtcagatctctggtcttgtggggtcatcctctacgtgatgcttgttggctgccttcccttcgacgacaggaacctcgtcgttctttatcagaagattttcaagggagactgccagatccccaagtggctt

SEQ ID NO: 39535 - DNA, 449 bp, Zea mays
  Clone ID: LIB3062-048-Q1-K1-D6
aattaatttaattgaagattcaacaaatattacatcatcagggcatagtttgcttggtcctgtaaaaacatggcaaattcaagattgtattgatgttcataaattgctggagacagtctttggtgatcagaatgttgcaaataggtggaaggcacggtgcgcggaatattttccgtactcgacgtactttgaaggcatcaagagcgctatttcaacctatgccattgaccatagtctcgagagcccaccagaaaatggaattgcttcaaaccctcatctgaaatcaaaagatggagaacaagggagtttgaatggaactctgcatattgtagatgatttgagcagcctaagcattcggtaatgcacgaacaagttgctgaatggtcacaactggaacacaccattttagaactggagccagtacccaaataaccaaagcgtacacgaac

SEQ ID NO: 39536 - DNA, 163 bp, Zea mays
  Clone ID: LIB3062-048-Q1-K1-D7
cgaaggttgtgaacgccttgaagaaggaaggggtcagctttgggtccttcgacatcttatctgacgaggaagttagggaaggattgaagacgtgctccaactggcccaccttcttatagctctactacaaatcggaacttattgggggatgtgatatcgttct

SEQ ID NO: 39537 - DNA, 390 bp, Zea mays
  Clone ID: LIB3062-048-Q1-K1-D8
accaattgaaaattttatttgcatttattttcctcatgtttggtttgctattataattaatgaatctgagatcttttgccttttgtgctttcctgaactgtgaattagactaagagctgtagaagtttattggtcacttctgtatcctttgcagttcagatctttgttcttgtttgttgtttcacaataagtgctgcaaacattaatcagattatatcttagtcacttctttttatttttacatatgtctaagagattagccatgtctgattgacggaaccaagatctagttgttgtgcagatgactttcttcactttagtatggcaatacggtgtcttactagcgaaattggttatttgaatgccatattattttgataccatcttctt

SEQ ID NO: 39538 - DNA, 231 bp, Zea mays
  unsure at all n locations
  Clone ID: LIB3062-048-Q1-K1-D9
aaaatatgtctgttgacatcgtttagagacacatgcctagttgagatagtccccagagatgccactccaacaagaggttagagttggatcctgtcctgtcttctccagttctctgtctatatcatgtatcaactatttatcctatcatcactctgaccactttggtattgtgatttcccttcattattatagagttntgttaagtttctggaatccacatgcacatataca

SEQ ID NO: 39539 - DNA, 175 bp, Zea mays
  unsure at all n locations
  Clone ID: LIB3062-048-Q1-K1-E10
gcaacgtcgtccgtagaagagtgtcagccctcgctngttgcctttcctcactcaagtagccgatnggtggatctactcttgaggtacgtgcgtaccggtggtcgcaatgtgacggcgcagaagggcggtctaagaacctagtccttacctcaaggtagcttacttactcggtgca

SEQ ID NO: 39540 - DNA, 408 bp, Zea mays
  Clone ID: LIB3062-048-Q1-K1-E12
agatgaggactaacctgaaggtggtcgataactccggggccaagcgggtgatgtgcatcgagtccctgagggggaagaaaggagcaaggctcggggacatgatcatcggatccgtaaaggaggcccagcctcgtggcaaggtcaagaaaggagacgtagtctacggcgtggtcgtccgtgccgccatgaagaaaggacgcagcgatggcagcgaggtccagttcgacgacaacgcggtggtcctcgtgaacaagaagggcgagctgatcggcacccgcgtctttggccccgtcccccacgagctgaagaagaagaagcacctcaagatcctggccctggctgaacacattgtttgaggtgtgtcgcataaccaagtgtttgtgggaatgtttttttttgtgtgttctc

SEQ ID NO: 39541 - DNA, 189 bp, Zea mays
  unsure at all n locations
  Clone ID: LIB3062-048-Q1-K1-E2
gngctcaacgangcgcacaagaccaaggacaacgcagagaagannggcaagaggcaggncaggancaggccgncagccaagggcagcagcaagagccggacgggcaagcagcgccanggcnacagaggagagagcgaggacgnngangaccaccgancgggcaagaaggagggcgaacccaacgggagg

SEQ ID NO: 39542 - DNA, 363 bp, Zea mays
  unsure at all n locations
  Clone ID: LIB3062-048-Q1-K1-E3
gnnntatatagtttcttgtcattttgtcataacactgactatggtatatccacacatggcgttcatgcaaattctcatactcataactgaaaagaatcgattgaaaacgagcataaacctgtccctcactcctatcctgaaccagtataatttaacttgcttcgagtggcagcattataaatttctgcatgacctatgtggtcagttctgcattattatttgtccatttgagatccaccagtgtatattatcagatcagtggagtatttgttttcataatgcaggggttatggtgccacttacgtggtcgatcagaatgaaaaatgcgctcggtgctgcgaatggacttgcttttctgcatga

SEQ ID NO: 39543 - DNA, 320 bp, Zea mays
  Clone ID: LIB3062-048-Q1-K1-E5
ctcatcctttgctcctcttcaaacgctcgagaaagagagagagagacgaaaccctgcttcgggaccctagcatagccactgccttcccgcacgctaggaaggggaagatatgggcgccgaggaggacgccgctgcacgccgcgagcgtctccgcgccctccgtgccgtcaaggacctcctctccacccgcgacggcgccccaaccccttccaccgacggagaacaccaaaatggcaaccatgagatggcagaagagccagaattaccagtttctcaggatgcacctggtgaggctggtaaagaggatggtagccccactg

SEQ ID NO: 39544 - DNA, 226 bp, Zea mays
  Clone ID: LIB3062-048-Q1-K1-E9
cagcagatacgcttatcagcgatcgtatacacgatgcccagtctttagcagcctgggacgtggcaatagccatgcgaactcagtcaaaagagaacgctgcctctgatgcagcttcagttgttctactaggcaacagactttctcaggtggtagatgcgctatccctgtctaaggcaacgatggcaaaagttcaccaaaatttggcctgggcagtggcatataacat

SEQ ID NO: 39545 - DNA, 373 bp, Zea mays
  Clone ID: LIB3062-048-Q1-K1-F1
cgccggcgttgagatgttggtttatcaggatctcctatctggcgacgagctcctgtcggatgcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtccaggggtgccaccaagtttct

SEQ ID NO: 39546 - DNA, 103 bp, Zea mays
  unsure at all n locations
  Clone ID: LIB3062-048-Q1-K1-F10
cggactcgtgggtgcgacatgaatgatggatctttttaacatcctaaccatcatggtantcgctcattatcgtattttgtatagtatttatgggttcacggat

SEQ ID NO: 39547 - DNA, 444 bp, Zea mays
  Clone ID: LIB3062-048-Q1-K1-F11
gctggttccagctcaagtagttctctgcaaatatcagaaccagaaccccaacaaatccaagaagaagaggagtactatatggaggatgattgtgatgatgattttgatggctacgacgaagatgattatgacttcgatgaagctgactttaaccagcaccttgctgataaatttgatgatttggatcttcctccaggcgtggaggccaccgtaccttggttgcagaaaactacacccaaggaagatgtcaaagagccacctaaatcaaatactgcagatgagaatgcaaataaatatacgcagttcaagcagtttgatactgttcagaatttctctgaccattactacgctaagaattctcatggagagccaaacagagccttgtcaaagagagttcaacatgactggaaacttctggagaaggatctaccagcgtatattttt

SEQ ID NO: 39548 - DNA, 189 bp, Zea mays
  unsure at all n locations
  Clone ID: LIB3062-048-Q1-K1-F12
cggacgcgtgggtgaaaaacgacctctttttgatgtcaagacatgccaaattgcgtgcangcgtccaaagcaaacagatcactgtacctggttatattcctttgaggaacaccctttgaccagtgaagtgggaatatcttctccagctttatatgatggattggttgagatcaaacaacccaatgacat

SEQ ID NO: 39549 - DNA, 311 bp, Zea mays
  Clone ID: LIB3062-048-Q1-K1-F6
gcgagcttgcaaatactgcacgaacaccgtcttccggccagccgcgatgccctgcgactcacgggacgtccagccggtcaagtcccaggcctgcataggccgcaccctgaagaacggaagtgtagtcgaacactgtcttgatctcttgtgctaatcaaggtctcctgcatcggtgacatgctgatgacatataccagcacggtcaaacgacgggtaaaccttttgactccagatagtaattgggggaatagcttacctccactgtgtttcctggcgcaccatggtgtaacggagttcctagagcgcgacta

SEQ ID NO: 39550 - DNA, 203 bp, Zea mays
  unsure at all n locations
  Clone ID: LIB3062-048-Q1-K1-F7
ccaccagangccgcanatccnccgccaccaccaggcccnggagncnacagnccngcacccccngcaccagggcaagcggccccaccaccgaaggggaggcaaganccaccaccaccaccacccccagcagcgccaagcccgccaccaggcacngcaccagcaagnganggagcacagaacgagccaccgggaggaacaccacc

SEQ ID NO: 39551 - DNA, 337 bp, Zea mays
  Clone ID: LIB3062-048-Q1-K1-C8
ggtaagcagcagcaggaaccctagcaccgccgcatccgcagccatgggtatcgacctcggggccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgacttgtcaagttcatggaaggaaaggagaagaacatggctgtgattgttggcacagtcacagatgacaggaggatccaagaggttccagcaatgaag

SEQ ID NO: 39552 - DNA, 341 bp, Zea mays
  Clone ID: LIB3062-048-Q1-K1-F8
cgccaacatggccatcaccggcgccacggccatggacgcgcccttcttccgctcgctcggggtctccgacaagatctggaacaacgggcccatcagcttccagctgcagtggttccagcaggtcacctccgccgtgtgcggccaggactgcaagagctacctggccaactcgctgttcgtgttcggcgagttcgggggcaacgactacaacgccatgctgttcggcaactacaacgcggaccaggccagcacgtacacgccgcagatcgtgagcgccatcgcggccggcgtggagaagctgctggccatgggcgccacggacgtggtggtgccgggggtgc

SEQ ID NO: 39553 - DNA, 187 bp, Zea mays
  Clone ID: LIB3062-048-Q1-K1-F9
cggtctcgaattccctgtcgacgcacacgtccactcccgatcagcacctgatcgctcactgttccaactcgatcatcccacacatgcgcgaacgttagcctctaccgctagctaggagctacccaatcggtcccgtacccatcacccacttcatcctcacccatctccactagtacggttcattctc

SEQ ID NO: 39554 - DNA, 201 bp, Zea mays
  unsure at all n locations
  Clone ID: LIB3062-048-Q1-K1-G2
gaagcaccaacgggtgcatcaaataacaaagcaccctggagcagtaactatttgatgcaccaacgggtggcagtggctgaaggatttgagacattcagggatagatatgtcaagagnacataaacatactcgaaatcactagatacgttactgncattcgtgattaagcgctcacaaaatctagctgaatgcacgtgtaaa

SEQ ID NO: 39555 - DNA, 351 bp, Zea mays
  Clone ID: LIB3062-048-Q1-K1-A4
aaaaccgttccctcccgatggcaaccgccgccaccgccatggtggtacccgagcagccacgccgccggaagccggccccggggcgcggaggagtggccctccctgcgggtctctcggaggaggaggccagggtgcgggccatcgccgagattgtctcggcgatgggggagctctcgcggcgcggggaggacgtggacctcaacgcgctcaagtccgccgcgtgccggagatacggtctggcgcgagcgcccaagctggtggagatgatcgctgccgtgcccgaagccggaccggccgcgctgctgccgcggttgcgcgctaagcccgtgcgcacggcatcgggtatcgccg

SEQ ID NO: 39556 - DNA, 257 bp, Zea mays
  unsure at all n locations
  Clone ID: LIB3062-048-Q1-K1-A5
aagctccgcagacctcactcctcagagagagccccaagccaagatctgcgcgggcaagncagcaggcgaagcaccggctcccatggccgtggacctgatgggctgctacgccccgcgccgcgccaacgaccagctcgccgccgccggcgcctcctgtcgtccacggtccgcccgtcagcgtggcgcagccgccgcaaagcctgacgctggatttcacgaagccgaacctggccgtgtcggccgtcacgtccgtcacc

SEQ ID NO: 39557 - DNA, 332 bp, Zea mays
  Clone ID: LIB3062-048-Q1-K1-A6
ggaagaaatacggagaagggctggtgctgatgataagccattaagaatggtcaaaaccgtgttgcatgaacttgtgaagcttcggggaacggcaataaagggtcacctttcgatggttcctatagatgctgaacctcagccaataattctagcatacattgatcttaatctccagacccttgctgctgctagaatgttgacgccatcgggacctatgggtcaaactcactggggtgatgctgcttcaaacaatccaaatccatctactcactcagcagacgcgcaattgaagcagaagcttgctgctgtcttcaagaaaatcgcgacaggca

SEQ ID NO: 39558 - DNA, 411 bp, Zea mays
  Clone ID: LIB3062-048-Q1-K1-A7
gagctggggagagtacccgacctagaccaaaagaccgacaactgatacaagatcgcgttagagaattacgagagattgtccctaatggtgcaaagtgcagcattgatgctttgttggagcgaacaattaagcacatgctgtttctacaaagtgtaaacaaatatgcatagaaaattaagcaagctgatgaaccaaagataatcgacaaagggagcggtgttatcttgaaagacaacccagttgctggcacaaatggtggtgcctcgttggcctacgaggttgctggccaaactatggtttgcccaataatcattgaggatctttcaccacctggtcagatgcttgttgagatgctttgcgaggaactagggctttttctggagatagctgacaacatacgtggaaattgtc

SEQ ID NO: 39559 - DNA, 398 bp, Zea mays
  Clone ID: LIB3062-048-Q1-K1-A8
cacacagcggcggcgatgtcgtcggcctcctccttcggcgccgccgccaacgccggtgaaggaagcggtgctgcggaggagggcgtggagatcacttacgtgagctatggcggggagcagcatctgccgctggtgatgtcgctggtggacgaggagctcagcgagccctattccatcttcacctaccgctacttcgtctacctctggccgcagctcaccttcctggcgttcgatgccagggatggcaagtgcgtggggacagtcgtgtgcaagatgggggatcatatgggtgcattcaggggctacatcggcatgctcgtcgtcctcaagccctaccgagggaggggaatagcagctgaggctagtaactagatcaattcgggcaatggatggaatct

SEQ ID NO: 39560 - DNA, 319 bp, Zea mays
  unsure at all n locations
  Clone ID: LIB3062-048-Q1-K1-A9
gcgtcctcctccttctcctggcactgtcagcgaagatccaaagatagcacaatcgcgtgtcacacgccgagctatttctactttgagagaatccccttctcccacaaggagcgagtaatttgaggcagagaccgacagagatggcagcggttatggtgtctcgccaaggccgggagctgcagcggtacagcgcgagcacgggcggtcgcgtggtggtgggctgcgtcccgtaccgcgtgcgcggaggcgacggcgaggtggaggtcctggtgatcagctcgcagaagaagggccccgcggngggcgtgctgatccccaa

SEQ ID NO: 39561 - DNA, 343 bp, Zea mays
  Clone ID: LIB3062-048-Q1-K1-B1
aagagggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgagataccgaggcaaaagggaaaggttacctggaagaccgtcggccggcatcaaacatggacccgtacattgtgacggggctactggccgagaccacgatcctctggcagccatcccttgaggcggaagctcttgccgccaagaagctggcgctgaaagtgtg

SEQ ID NO: 39562 - DNA, 264 bp, Zea mays
  Clone ID: LIB3062-048-Q1-K1-B10
aattaccagttcttaagggagaaacaaatgttggaacatggaagtgcatttgttgttcacgagaaatttggtcgtcttgtcatcaaaacaccagaattgcattattgcacgctagctactcatttctttggtaattatgtgcgtgcttggtgtttatgtacagttttatgtgcttgataatgggcacatggccagttcgacaatgtcatacagttatactacactagtacattgcttatgcttgtgagagaacataattaagtt

SEQ ID NO: 39563 - DNA, 227 bp, Zea mays
  unsure at all n locations
  Clone ID: LIB3062-048-Q1-K1-B11
ccttccacctncgatggccacaacggcgacaacgatggcgccggtgacggcgccggtggccacagccaacctcgaacctacaccaacacctctgcatccacgtcctgccgcgccacctcatctccgggcgctttccaccttggcccccgtcaagtcagaggctcctcccaccccctcgtcttctaccgccatcaccgccgcacccggagcggaggatccattctaca

SEQ ID NO: 39564 - DNA, 229 bp, Zea mays
  Clone ID: LIB3062-048-Q1-K1-B12
aaatttcaacgtgttatgagcaaaacaccagaattgccattttgcacgctaactactcatttctttgctaattatgctcttacttgaaaattatctacatttatatgtccacgataatattcacatggacctttcaaacatgtcatacagttatactacactcatacattgattatacttgtgatataacataattaagttaaaatgaccattactaaaatgcgtccaa

SEQ ID NO: 39565 - DNA, 337 bp, Zea mays
  Clone ID: LIB3062-048-Q1-K1-B3
cggacgcgtgggcggacgcgtgggtttcaattgaatcgagatggtttatcttttttgtttgagagatagttagtgaaaatattgcactttttcttgatctctggcacaattctctcgtgattttccaggcatatatctgtacaaggagtagaagcttacaccaaaaattagtattcatctaaggatctaatttcatttttaagtttacagaacaaaaaaatgtggtacatatggattcactaaaaatggacttgttgcacaatatgtatcttattactttaataagcttttgcatattgctcttgtaacttgagcattctatcccatgtaggaacta

SEQ ID NO: 39566 - DNA, 391 bp, Zea mays
  Clone ID: LIB3062-048-Q1-K1-B4
caatgatgtgtctcaatccaatagcttgtccagtggttttcttccgttatttggtgggttgcttcaagctcaaggaaaatatcctggagaaacaagagtgagcttttcttgcaagaataagcgtggcacaaggtttactcctatgtttcaatggcctgacaagtctgtttcgttaggagttactcaagccttggcatggaaaagatctggtcttatggtgagacccagtatacaagtcagtgtgtgccctacgtttggaggaagtgatcctggggtacgggcagaagttgtccattcattgaaagaggaattgaatctgatgtggggcctctcttgctcgcggcatccatcagcttatactgctctatctatttgacgatcaaagtggaac

SEQ ID NO: 39567 - DNA, 426 bp, Zea mays
  Clone ID: LIB3062-048-Q1-K1-B5
aggatcccaacataataaagagagtcctcaatgacgaggcaaactacggcagacagattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctgttcacgaagagtcaaaattgtcgccacatggttccacatttggtgatcatgcttctattgaagaaaacattcctgttgtagacaaggttgtggatgatggatggggtactcccagaggtagtcttcaagcttcttcaggttctgtgcccttgagaaacacgcacggcacattcgaaggactgagagttcaagctgtcgcatggc

SEQ ID NO: 39568 - DNA, 248 bp, Zea mays
  Clone ID: LIB3062-048-Q1-K1-B6
gacgagcccgacggccatccgcatcgcgcatggggcggcgtccaacacctcgtccgccagcttcggcgcgatggtggccatcgacgacccgctgacgacaggccccacgcgcgccgcgggcaccgaggtgggccgcgcccagggcacctacacgtttgcggtccagcagacgttcggcctcctcatggggatggacttcgtgttcacggccggggagcacaaggtcagcacgctctccatcctcggcc

SEQ ID NO: 39569 - DNA, 321 bp, Zea mays
  unsure at all n locations
  Clone ID: LIB3062-048-Q1-K1-B9
cttttgcttgttgttagttatattatggtgtaactcagtgttggttaccttcggcgtccgaaggtcctgggaaacgtgatttaatagtgtggctgcagtacaatgtgtaaacaggtatcctcgaactaaagtcggcattacagtggaccggaataatacgaaggttgactcagagccgaaggtgcgagcaggaaagcttctgcgcgacagcaaagagtggaaccgacttatagatgaaaaggctattcagacctcaatagactactatagagntattatcaaatgtaaagggcatgaatgtaattttgtaaggctgtgtcc

SEQ ID NO: 39570 - DNA, 263 bp, Zea mays
  Clone ID: LIB3062-048-Q1-K1-C1
ccctcaccctggcctacgacaccatcaagaatttccggttcgggtgcggcgagaagaaccgtgggctgttcggtagggcggcggagctgctgggcctcggccgcgggaagacgtcgctgccggtgcaggcgtacgacaagtacggcggcgtgttcgcgtactgcctaccggcgacgtcggccgggacggagttcctggacctggggccgggcgcgccggcggcgaacgcgcgcctgacgccgatgctggtggacaggggcccg

SEQ ID NO: 39571 - DNA, 344 bp, Zea mays
  Clone ID: LIB3062-048-Q1-K1-C12
gtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcagggcggcgcgcacgacgagatcgacttcgagttcctgggcaacgtgtccggcgagccctacacgc

SEQ ID NO: 39572 - DNA, 322 bp, Zea mays
  Clone ID: LIB3062-048-Q1-K1-A3
gtgcctgcgagtcacggcctcactggggataagaggacactcgaggagatacaactgtgggctgttttcgcagcaattgtttttttgtcttggtggtatacttgttctcgtgttgctctgagtgtgtcttggtggtagagtattgtcatcaggaagagttgttaagatgtggcaattcatagggataccatactaccataccgatagccagctacagcgatctggatgtggttgtttgttggactcatagaacagatactgttggtgtgttatatgtgcattgatgctgctacgatgataaagaaattccttcttttattat

SEQ ID NO: 39573 - DNA, 250 bp, Zea mays
  Clone ID: LIB3062-048-Q1-K1-C5
ggtgcagcaacgggacctgatgggtatggtcaacagggttacccacagcagggtggccagggtccagcttcatatgggcagagtgcaccagcagctccaggatatcctcagcaaggcacgcatcaaggtggctatgcacagtacccgcagacccaaccagcatatggtgatcaagcagctcaagccaatgcgaactatgggtaccagggagctccagcatatcctaactacagaagtgcgtacccacagc

SEQ ID NO: 39574 - DNA, 384 bp, Zea mays
  Clone ID: LIB3062-048-Q1-K1-C7
cccagattaggaagatgaagggtttgaagcagaagaaggctcacctgatggagattcaggtcaatggtggtaccattgctgacaaggtggactatggctacaaattctttgagaaagaggtccctgttgatgctgtcttccagaaggatgagatgattgacatcattggtgtgaccaaggggaaaggttatgagggtgtggtcactcgttggggtgtcacccggcttccccgcaagacccacaggggtctccgcaaagttgcttggatcggtgcatggcatccggctagggtctcctatacggttgcccgtgctggtcaaaatgggtaccaccaccgtactgagatgaacaagaaggtttacaagatcgggcaggctggacaag

SEQ ID NO: 39575 - DNA, 333 bp, Zea mays
  Clone ID: LIB3062-043-Q1-K1-G5
tcttcctgaccaatctaatctaaaacctccccttttattttcctttaacatagacacatactcgggacgagttacttaacactcagagcagaactcacaactcaaagcattccatgtacatacaaaacctactataaattacaatatacattaacatacttcacaatcacattctcaatcctaatgaagcaaactaataacaaatcacacacaatgatctattaccacaacaactcaaacctacttccacaccttcactcttttgatcaccacttttacactctactacactaattactctaacattctccacacatactcattaatcacttc

SEQ ID NO: 39576 - DNA, 427 bp, Zea mays
  Clone ID: LIB3062-043-Q1-K1-G6
gatctatccatgctttgaacctaatggcagactcagttaattgtcttgtgcgatggtcacaagaggttagagaagctggtggagaggcagatagaatattggaaggaattgcagagatgtggctgcggctggtgcaggctctacgcaaggtgtgcatggatcaaagagaagaagtgaggaaccatgcattgttatcgttgcatagatgcttggtagttgatggaatatcagttaagtcttcaacatggttgatggcatttgacattattttccagttgcttgacgaactgttggagattgctcagagctactcaccaaaggatttcagaaacatggaggtatctctcttgcatgctgtaaaactgttatgcaaggtgttcttgcagtcacttaaagacctctcaggacagcacagttttgataagct

SEQ ID NO: 39577 - DNA, 361 bp, Zea mays
  Clone ID: LIB3062-043-Q1-K1-G7
acggatctatccatgctttgaacctaatgtcaatttcacttaattgtcttgtgctattggggcagagatttatagaagctggggtatgaccaaatacaatattcattcgaattgcacacatatcgctgcgtctagttcagactctacgcaaggcgtacctggctcaaacagaagctttcaggatccatgcattgacatctgtcactctatgctcgatagttgatagactatcagcttactcttaaacatgttcgatggcatttaccattatttaccagtcgctcgacgatctctcgtacattgcctagagctactcacccaacgattccacaatcatctaggtctctactcttgcatgctg

SEQ ID NO: 39578 - DNA, 348 bp, Zea mays
  Clone ID: LIB3062-043-Q1-K1-G8
gatctatccattctttaaacctaatttcactctcagataatcgtctccctctacggggtcagaatgacacagaagctgggtcataaccacatagactattcaatcaaattgcacacatatccctatcactattacattctctactcaagattcgcatctctcaaacacaagaattcatgatccatgcattgatatctttccatcaatgctccatatttcatccaatataacctaactctccaacatacactatctcatttaccattaccttccagtttctcgatcatctctcctacattagctagagctactcattcaacgatttcataatcatataagtatctctct

SEQ ID NO: 39579 - DNA, 176 bp, Zea mays
  Clone ID: LIB3062-043-Q1-K1-H1
gttcaatgtcgtcgtcgtcgtcgtgtaccttacgtgacatgctgtagcacgtacgctagcagagcagcacctcaatgtgcttgggtttgctttgctggctctctgttttcgtcttgtgttgcttttaatctggcacaggtttctaaattataataatgaatacttttttgtccatt

SEQ ID NO: 39580 - DNA, 413 bp, Zea mays
  Clone ID: LIB3062-043-Q1-K1-H12
tccgagcagatccgccggcgagcgctcgggggcaatgggtgtcgtctcggcagcggcggacgcgattgtcgcggttttgtccgtcaccatcgtcgtcgcggcgccgctactcgacgcgcagtccgtactcccgcataccctctacccggcgccgctcctggaactcaagcgctggtacgccgccgagtttggcgactacctcatggcccagccccccggcttcttccgtggccttgtttgcctcgagctcgccttccaatggccgctcgccgtcgccacactctacggcatcctcacccgccgccgctgggctgccaccacctccctcatggccggcgttggcaccctcacctccatgtctgcaattcttggtgagatgttaggttcaagcaaatcaacaccaaagttgcttt

SEQ ID NO: 39581 - DNA, 445 bp, Zea mays
  Clone ID: LIB3062-043-Q1-K1-H2
gtggagcttactgaaggtggcactttttggttgtcggaatcaccatcggttccaggaagcggttcatggggagcaaaggcaccctgcattgcaacatgggcaacgtttcaactcaaaaggctagaaccacctggattcagtttccagatcgtaaatacaaatcttgatgaagttagccctcgtgctcgacgaagaagtgctttacttacatggcaacatatagcatcgctgccacccaatttgcctgttatctattgtggaggcttcaatacacagaaggaatctatgactgggcggtttttgcttggcagatccagagaacatggtgttgctggtgatatgagagatgcttggccaaatgctcgagtgcgaaaaaatgtttcactaatacacacatatcatggatttaaaggggagaaacaaggtgccctggaatttcttaaat

SEQ ID NO: 39582 - DNA, 445 bp, Zea mays
  Clone ID: LIB3062-043-Q1-K1-H3
ccccttccctccctccctctccccgcgggccgccagaggcaatttcgccctcgattcgacggcgagtcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtaaccaaggctaacaagctcaagctag

SEQ ID NO: 39583 - DNA, 418 bp, Zea mays
  Clone ID: LIB3062-043-Q1-K1-H5
acagcatcgtgaacggcagcgacgccgtcatggagccggttgttgctggcagcaacgcgggggtagctgttgcccaagtcgagttgctaacaatgaacgtgcagcagccctctgatgttgccggacccagcgagggggtggcggcgatctccaaaggggggaaggtagggcctaaccggtgcagcgcctgcaggaagagggttgggctcacgggattcaactgtcggtgtgggaacttgtactgcgcgctccaccgctactccgacatgcacgactgcaagttcgactaccggtctgctgacagggacgccattgccaaggctaatacgctggtgaaggcagacatgctcgacaagatctaaggtgggttccctacggctggtgtcaagaagattgtaataccgcgtaactcgtcatg

SEQ ID NO: 39584 - DNA, 375 bp, Zea mays
  Clone ID: LIB3062-043-Q1-K1-H6
tcctcttcactcagctcattctcgtccatccttttctgtataattttctttgatctgtgggggttgcatccatgggacgccctcatcttcctgcactacagctggcctcctgtgcttactacgtcaatcattccctccatgagaaactccttctctcctacatcgccttagctatctacttcacaccagaagccattccgttccactaaccaatccatgactcttagtgcccaaactcggcgtcctatgtccccatatggatgagtcatgttcttggatccctgacatcacacatattaacacaaaccggccatccaaaatctggacatgcaagcttgcatagacatgtcttgaacagtcagatctgcaaacaac

SEQ ID NO: 39585 - DNA, 431 bp, Zea mays
  Clone ID: LIB3062-043-Q1-K1-H7
ctggaagtggtatgctttcagctgctggtttatctggagggaccactgcaaaacccaggacgggcatgcttcttgcgccacctccagtcgcagctgggaagcttagatcttcacttccaccaccacctaacgaccctgcagctgcaaggatgaattctggacatactgcaggaatcagggctccaaaagaacccaccacgagaaataacgatcctttttcagatctttctgctataaagcaaaatctaccttcatctgctgaacccggacaaacaaagagcacaggagctggatgggcagcattctgacgatggatgcatgatctactgctactattggcattcgtgtatctgaagaacgggaatgggtagttgaagcaccgaacaaggatctggaactgctggatgcctctacccctctcgaaactgaat

SEQ ID NO: 39586 - DNA, 398 bp, Zea mays
  Clone ID: LIB3062-043-Q1-K1-H8
ctgaaggagaatacaaaagcaatggaggaccctttgatgagcgatacgctcaagagtatggaagagacactccaacgcgctcttaagctcgtcaacgagtgccagaggaagcacgtcgtgctccattacttaaatgccggcggcatgtccaagaagctgcgccaggtgcaggaggatatatcatataaattgtggaatggggtcttggccaccgttgtcgacacaaggattgctttggaaaagcagatccaatctgctattgatgcccctctgcaccaacaccaacagcgtgcaaggcaagtggaaacctcacaaagtagtcattcaagaactgatcaagctagcgagaaaggaaaggccatgttagcaagagtaaaaagggagcaatctgaactttt

SEQ ID NO: 39587 - DNA, 238 bp, Zea mays
  Clone ID: LIB3062-044-Q1-K1-A1
aaaaaaaaaaaaaaaaaacaaaaaaaaaaaataaaataaaaaaaaaacaaaaaaaaaaaactggataaatttaaaaaaaaaactattcaaataccaaatataactaaaaaaatataataatatactattaataaaaccccctaatcactttcttattaaaaaaaatctccaccttttcatcatccacttttaactcacccttcctttccccaaataaccctttactaccggtccccaa

SEQ ID NO: 39588 - DNA, 456 bp, Zea mays
  Clone ID: LIB3062-043-Q1-K1-G4
cgcgcttggtttttttttttgtaggcaactcatcaaaccgcgtccattccaaaagcaactccaaataattgtacaaagatgctgaccccagccatgccagataaacatgcgacttaaaataacagtctatcaaccaagaaaagctatgtagatgactgacgactctgatttcaccgaacacaaacattcatctcggagaaaacacaatgaaaatttgcggggaagctgaaccttggaaacgaaatgaatggaatggcatccatttgacccttgtttgccttcaaccttcactctttatcatccttcttatcatcggatgcaggagcctcctctttctctgcattttcctccttgctgggctctgccactgttaacttctgtgccaaatcagaagcggcagtggagacttcatcattttctttctcctcgctctttccttgctgttcagctatctct

SEQ ID NO: 39589 - DNA, 424 bp, Zea mays
  Clone ID: LIB3062-043-Q1-K1-F1
gttttggcccggttttatcaggaagcagctacttctccatcctgaatctgatgattcagctgggcgttctcagattgagacagagaagcttctagcccagttagttgagactgagatgaacagacgtttgaaggagggcacttacaaaggaaagaagtttaatgcaatctgtcacttctttggctaccaagctaggggagcactgccttccaagtttgactgcgattatgcctatgtcttggggcatgtgtgctaccacatcatagctgccggtttgaacggttacatggccacagtgacaaatgttaagagtccagtgaacaagtggcgatgtggtgcggctcctatttcgtctatgatgactgtgcagcgatggtcgcgtggcccttcagccacccaaatcggaaagcctgctggtcacatg

SEQ ID NO: 39590 - DNA, 325 bp, Zea mays
  Clone ID: LIB3062-043-Q1-K1-F2
gatgatcctgctcgagaggaaaggctactataggtatgatgccctttttatcagatcgtccaaaccggcagtggtgggtgctatcccagatggcgggcagcatgcctcgcttatctaggcatggtgaccaccttttcgtcacatggaattccttatctggctattaatattgattcattgtacattctaatattgtactgtgattaggctatactcgctttgcatgtctttcaccgatagatggccagagtcatatcctgccaaccaagcagagcagccattctgattttggtctatgatacttttaccaacaaaaattaagaat

SEQ ID NO: 39591 - DNA, 414 bp, Zea mays
  Clone ID: LIB3062-043-Q1-K1-F3
cattttcttgctgatcacagctagtagggagcgagagttaccttgaaatcaaggcagtacgtgcgagtacgatcgacagtgtggacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggaacgatggcagctggaggatgacgccgacaaggtgaacctgtggttcgaggtgcctgggcagtccaaggatgacctcaccgtggagatcgacgaagacgtgctcgtcatc

SEQ ID NO: 39592 - DNA, 305 bp, Zea mays
  Clone ID: LIB3062-043-Q1-K1-F4
aggaaaatctactataatagtcatgccctctttttcacatcttccaatccttcacaagcatagttcatcccacatgtcaggcatcatatctagcttacctagtcatcgttaccacccttaatccacattcaattccatattttactcttattattgctacattatacattctaatattatactgttattaagctttactccatatacacatctctcacacactatatctccctattcatatcctgtcaaccaacacaaacacacacattgattatcgtctatcatacttccaccaacaaaataca

SEQ ID NO: 39593 - DNA, 222 bp, Zea mays
  Clone ID: LIB3062-043-Q1-K1-F5
gccgtgagacaggtctgcacgtccgaggcctccaccgatgcgctggccgacaactccgtcagcaagcacaggcagctggagtcggaatgctatctgcaactaattgacagcgcgtgtagtgcgctgctccccgggccggaaccttgcatgatcggaagcttgccatccgggcacacagcccagaccaacggcatccaggaagacgttacatagagctcggta

SEQ ID NO: 39594 - DNA, 438 bp, Zea mays
  Clone ID: LIB3062-043-Q1-K1-F7
accaagaccttcacgtctgatttccctcatgtcgagaggtatttctggaccatggttaaccggcctaacttcaagaaggtcattggtgaggtcaagcaggcagagtctgcacctactattccgaaaaaggctgctccttctaaggagccaaaggcaaaggatgtcaagaaggaggctccaaaggaggcccccaagccaaaggtggttgaggcaccagcagaagaggaagcaccatagccaaagccaaagaatcctcttgacttgctgccaccaagcatgatggtccttgatgactggaagaggctatactcatacacatagaccaacttccgagaggttgccatcaaaggtttctgggacatgtacgacccatagggctactccttgtgggtctgtgactacaagtacaatgatgagaacaccgtcttccttgtgacc

SEQ ID NO: 39595 - DNA, 436 bp, Zea mays
  Clone ID: LIB3062-043-Q1-K1-F8
gtaaaacctgaagaaggagaccgccacccttattctatgttagattgtgtggcacagcgtggaacaattttgcctttcgtactctatatccagaaaacattgcgcaggaggcctttcttaataaaaaatcttgaaaatgttatgcgcaaattcctccaatccttggagttctttgaggaaaatgagaggaagaaactcgccatattcacagcccttgcattttctcaaaagctgtcagggcttcctccggagacagtgttccagccattgctcaaggataatctggttgccaaagggatagtactttcattcataactgagtttttcaaggagtacctgaaggaaaacaccttggatgatttgattgcgcttttgaagaaaggaaaaatggaggacaatctgttggacttttttccatcagctaagagatcctctg

SEQ ID NO: 39596 - DNA, 395 bp, Zea mays
  Clone ID: LIB3062-043-Q1-K1-G1
gattccatgaagtgatcatctgaaatgaactatgaggctgggagctgaaaattgtagcttcgcttgattcgctccacaagcagaatccttttgcatagaatttcaccaacataatcgcttctcttagagaatcacttctcagtcctcacagatccaggagtgcaggaggagctctagcgctctaccaaacaggcctaacaagagaacggaagttatgggagtagtgttgcctacttgtcttgctctctttatttaatttctccaacacttcttgatcactgtgtggcaggaggtagcaagagcaggctagattattgaactgcgactgatctggactgtaactcgctccacattttctaccgagctctgtgctctgcagctcgcacgcctttgat

SEQ ID NO: 39597 - DNA, 434 bp, Zea mays
  Clone ID: LIB3062-043-Q1-K1-G2
cggacctaatattgcttctgaaatttacaacaaagaatatgcaaatgcacgtatttgtggagctgacaaatggagaaagccccttgcaaagtttttgaggcagcctcattttattgtgtgggataacagtgatctcatcactcatgaagtcatgggtggcttaaaaaatgtctatgctattggtgctggtatggtagctgcactaaccaacgagagtgcaaccagcaaatctgtttactttgcactttgcacatctgagatgatctacatcacacaccttctggaagaagaacctgaaaaacttgctggacccttattagctgacacttatgtcacattgttgaaaggtcgtaatgcatggtatgggcagaagttagctaaaggtgaattgacattagaaatgggtgacagtattaaaggaaaagggaccattc

SEQ ID NO: 39598 - DNA, 365 bp, Zea mays
  Clone ID: LIB3062-043-Q1-K1-E9
cgcgaactccgcacgacagaatgcgaattgggcaccgtcgcttccttaaacgcggtgtcgtccttagaagatgtgccgccctttgatacctactcgcggtccatatactcagtacagatttcttggaaacttatagcagatcacgtctaaatatcgccctaccatcactccaatcggtcatggagcctaccgcatcttctgctcggcgttgaactcggagacgaatgaaatggtaccggttaacaagataatcaactctttcgataatcacatggacgctaagcgtacgcttctggaaaataaccttctccgacatttggatcacgagaatgttatcacgatctgagatgtcactgcttgctctt

SEQ ID NO: 39599 - DNA, 415 bp, Zea mays
  unsure at all n locations
  Clone ID: LIB3062-043-Q1-K1-G3
cggggagggaagcacgcccccaaacgttccgaggtttcgcctctcggagcgcaccaacgccggccggagcgactcgccaccggcgcggagaaggagggcggaggctaggcgatggcggacgagaatgaggctgggaagaaagaggaagaggaatttagcacaggccctctgtcagtactaatgatgagtgttaagaacaacacccaggttctcatcaattgccgcaacaacaagaagctgcttggccgggttcgtgcttttgatcgccactgtaacatggtgctcgagaacgtgcgggagatgtggacagaggtccccaagactggcaagggcaaaaagaaagctctgcctgtgaacaaggatagattcatcagcaagatgttcctcangggcgactcggtcatcatcgtgctga

SEQ ID NO: 39600 - DNA, 425 bp, Zea mays
  Clone ID: LIB3062-043-Q1-K1-D4
gcacgtctccatctctggtttgaccgccgccgccgccgccctactcggctacgccaggcgcggaggccttcgtcggcattttcgtcggcaagcactcaccaggtattcagccatggtttttcttgaggcagagatgtcatggaatgtgttgatctcacctagccagctggaccgcaagggcctcctgctccgcaaggctatcattgtgcgtcttctggaggatgtcacaaacaggagggcttcgaaagagcatggctactacattgctgttaatcagctgaaggcaatatctgaagggaaagtgcgtgagctaactggagatgttctgttcccagtttcatttacttgcattacacagaagcctatgaagggagaagtcatggttgggcacgtggacaggatcctcaagcatggcgtgttcctca

SEQ ID NO: 39601 - DNA, 306 bp, Zea mays
  Clone ID: LIB3062-043-Q1-K1-D5
tctttctcttatgttcctacaatacttccctcattattatccatgcccacttatacaacttctggcagggtacttctccatgccaggccatcatttacatccaatactaaatacctccatgcagatactgactatactactatcactatgatctgagctatattagttcttctacctttcttcaaccctctctttgatgaactcatcctcctacaagccatcatataaccactaccattcattactggtgtgtctgctatcctactttatcttcacctgaatgactatcctctcaatgaatttata

SEQ ID NO: 39602 - DNA, 422 bp, Zea mays
  Clone ID: LIB3062-043-Q1-K1-D6
acaaaatatcctgacacgatatctgtcgtccaaacacttataataatttccacgctgggttgtccctcttgtgtgcctgtacaatagaaatattgcagacttacaacacacatgtaaactggtgtcactttatttcacagaaatagcaatgaataaaataaggttaagcagtcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaagggggggagagtttaggggtccaaggtttaaaaacgtgtgattgggaataaaaatttttttattggggtcccctaaatccattttattgcccattttttaaaaacttcttaatgggaaa

SEQ ID NO: 39603 - DNA, 443 bp, Zea mays
  Clone ID: LIB3062-043-Q1-K1-D7
gtccagaacgcccagatcttactggacacgtgcgtctacgcgtctcctgcgccaaacgttgggagcagaccggtggacggtggtagaaggatcctgagggcggcggggatgggaggaggggcgacgctgaaccatccgccagctcgtcctcggtttggctgcatcacctacggctactacctgtcgtatttctgggcgaacgatgaacgcactcgaacagctcttgggatcaagaagggaacagtggacgagtgggtgaggtgtcacgacgcagacctgccgtacacgatcgacctcaagagcgccatcaagtaccaccggaacctgacgtccagaggctaccgcgccctggtgtacagcggcgaccatgacctgctggtgccacacctgggcacccaggcatgggtcaggtccctcaacttccccgtcgtcgacgactggag

SEQ ID NO: 39604 - DNA, 276 bp, Zea mays
  Clone ID: LIB3062-043-Q1-K1-D8
cccactcttactcatcactactaacacatcctactatacttttttctcactcacaccttcccacactcaagactgattctatccaaaatccggcaaccaacctacctcatactaccaacccacctaatacccaattcatcacatctatccaacaatcctcacctaacacacattaaatctaataattccaccatctctctctcaactactcacacaactatctaccacaatcataattccataccacaaacacctcaaaatacacttacttccata

SEQ ID NO: 39605 - DNA, 407 bp, Zea mays
  Clone ID: LIB3062-043-Q1-K1-E1
ggccatctcacagaccgacaacgccctaggcaagcagcaagcgcacacgtaaacgtacaccgacctcggcgagcaaaagggaaaacgctgatcggagcaacgaagcccgcagccatgccgacggcgacggccacggccacggcagctcctcgccacgcggcgctcttcctgcccctgctgctgctcctgctcggcctccacgccacgtccgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcggcggcgggtggggcggcggctacggcgggcccggcggcgggtacgcccg

SEQ ID NO: 39606 - DNA, 430 bp, Zea mays
  Clone ID: LIB3062-043-Q1-K1-E2
gggaaataaaaagccatccatggttcctaaagaacttgccgagggagctcacagaggcggtgcagggatcctacttcaggagggacaacagtgtctctgcattttcagaccaaacaaccgaagaaatcatgaagattgtcaaggaggcaagaaccttgccaaaatcgtcgagatcaggctatggctacagtgaagaatgctcagatgaggaggaaaaggaagtggagagcgaacccaaagaggaggaagaagaagctgagtgtgataagacagttagggaggttcgcgagagcggggagctggatatgacctcactgcacatctaaatgctgcctgtgaggctgtgacgtgtctgtagataattggctttattgtctgctgaatttggtagaacttatgcaattctggcgtcagatatagtggtctatat

SEQ ID NO: 39607 - DNA, 463 bp, Zea mays
  unsure at all n locations
  Clone ID: LIB3062-043-Q1-K1-E3
atagccaacagctcccacagcaacatcagcttcagcaacctgctgtctctagccagcaatctcaaagttcaaatcaacgatctgcaacaagaaaaactaggaattggaagtatgcctgttgatgggggcataccaaactcatttgggggagctgaacagacagcgaaaaagagaaagaagccaggctcatcctctggtagagccaatagttcaggcacagccaatactgctggtccctctccaagttctgcaccctcgacaccttccactcatacaccaggagatgcaatgtctgtgccacagctgcagcagaatggcggttcagctaaacccatggtaatgtttggctctgatggaactgggagcttgacatctncagcaaacccattggatgatgtggaccgtttgctggaagatggctcattggatgataatgttgaaatctttctatcacaggatgaca

SEQ ID NO: 39608 - DNA, 423 bp, Zea mays
  unsure at all n locations
  Clone ID: LIB3062-043-Q1-K1-E4
gggtttttgattttagccgccgccgctgctcatctcacatccctcgagaagacgcctgctcgtcggcgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgtccgctggtacgagaccgtctctgcggctgtagcctcaagattccctggtaaggctgttggtgtaaatctgcctgcgggatcagctcctgcggcagctgctcctgcggatgaggctgaagatgatgatgaccttgatctttttggcgatgaaactgangaggacaagaaggcagctgatgagcgtg

SEQ ID NO: 39609 - DNA, 438 bp, Zea mays
  Clone ID: LIB3062-043-Q1-K1-E5
ccggtctgcaagaaccgtcgataagagggactacccaagagggggtctccagcaacggggggggcaactggtccaggggaaggtggatctacgacaacgtgtcccgcccattgtacagcgttctcaagtgctccttcatcttccccgaggtggcctgtgacaagtatggcatgaaggatgccatgtaccagcactggagatggcagcctcatggtcatggatgcgacctcccaagatttgatgccatcaatctgcttgaaaatctgagaaacatgagaatggtgtttgtgggcgactcagtcaacaggaaccaatgggtctctctcgtgtgcatggcggaggcctcaatacctgacgacaggctcaagatacgcaccttcaatggctcactcatctccttcaaggcattggaatacaacgcatcgatagatttctact

SEQ ID NO: 39610 - DNA, 439 bp, Zea mays
  Clone ID: LIB3062-043-Q1-K1-E6
catgactaaaaaaacacacatcaatacgttaagtatttggttgataaaaatacttttatgggattttatgttgtttgataatagtcaccccactagattaaatttatttgatgcatgctctatgagtgtcttcatgattaaagcatgtgcccggcattggtgtagtgaggtttgggctaataatcatgttctcgctgctagcgggccaccactagttctcttgttaatgctcatttatttaatgaatgtagatacatgagtttagaatttgtcaacccttgactgataagtgttgttagtattgtttgtcatgaatttggtttgtttggtcaaagtggtgacgtggagcataggtttgaggtataaatgatgtgaagaatatgaattataggcagggtgtgatttgattaaaaatactctatctgctaagtcataaaat

SEQ ID NO: 39611 - DNA, 399 bp, Zea mays
  Clone ID: LIB3062-043-Q1-K1-E8
ctatgcaaaggttgttgtttgtttagcaaattggatgccgagtgatttgtgacctgtgccggatgtttttaagataacaatgttcttcgctcggtggttcactgctgcttgtgtctatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgccccttttaaggtaccaagcttaacttccccgtctttcaaaagtaatacctttttaaaggggacccaaaattaaattcaactgcccttgttttaaaaacttcttaccgggaaaacccttgcttttcccaaattaaatccctttg

SEQ ID NO: 39612 - DNA, 423 bp, Zea mays
  Clone ID: LIB3062-043-Q1-K1-D3
cgtctcgaatggtcgaacagtagtttgctcgctattatccatggcgacttctacggctgctgccactgcactgctccgccccaggccggcagttccagccaagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctacttt

SEQ ID NO: 39613 - DNA, 361 bp, Zea mays
  Clone ID: LIB3062-059-Q1-K1-F2
tcgcccagattaggaagatgaagggtttgaagcataagaaggctcacctgatggagattgaggtcaatggtggtaccattgcgtgactaggtggactatggctacaaattctttgagaaagaggtccctgttgatgctgtcttacagaaggatgagatgattgacatcattggtgtgaccaaggggtaaggttatgagggtgtatccactagtcgtggtttaacagggcttacgtgagagtccctctatgggctacgtatagtctggtgtacatgcgcatgtgtttctacgagctcctggactctagtctgcagtgcaagtttgcttgagttgagacgcatatcatggaggaactggttcg

SEQ ID NO: 39614 - DNA, 342 bp, Zea mays
  Clone ID: LIB3062-059-Q1-K1-F6
tgctgctaccactcttcctatattaacccgtacaatttcttagttctctacatcatcacccaataccaccaggacggtttcatctatctgttggagatcctttccatccacttctcctactatatctacctcgttcagcacaacacctacgtgtgttcctatacacgcctatcctcattacacgttcatacgttctcatcacgcaatttacccacatctataatctcatgtacgccatgaactatgacccttatcttcatgaacctatacaactcttccacattcccctacacccttactttccccaacaccttcgacatctgccatatcacctacatcacc

SEQ ID NO: 39615 - DNA, 232 bp, Zea mays
  Clone ID: LIB3062-059-Q1-K1-F8
ttcccggctctacccactcatcctctcgtcgtcaaaaaatccccattcgtttcccttctcgcctccactatccttcgcaaagttccctctcagctcttgtccgaatctcactctagccctaaccaaatcccatacccatcccagccctatccacaccaaccagctcgccagctaccatttttaacccgtacaatctgattatatcatatcttctacctcaattacacctttc

SEQ ID NO: 39616 - DNA, 418 bp, Zea mays
  Clone ID: LIB3062-059-Q1-K1-F9
ccggaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcac

SEQ ID NO: 39617 - DNA, 448 bp, Zea mays
  Clone ID: LIB3062-059-Q1-K1-G1
tcgctcctggagagctcctcctcccggatgccatccccgtgacgctcccagccgcctctcgcgacgccatccccacgagcgccttctccgacgccgtctccgctccgccgcattctccgacgccgtctccgctccgccgtcttctccgacgtcgtcaccttcccctcgacaagatatgggttcttgggaggagaaagttagacaatttttgttagatgaggaagaagacgacgatgagttgttctttgttattctccctgctataattccatacctctcagaagagaaagagcccatccacacctactcactcactggtgctaaaaagcttcctagctctatccaaactcataccaaaattgcaacagattataggttcatgccattgtttcagaactgcattggtgccatcgacggcacacatatacccatcaccatagcataacat

SEQ ID NO: 39618 - DNA, 213 bp, Zea mays
  Clone ID: LIB3062-059-Q1-K1-G10
cggacgcgtgggctcctgctcagagtctcagttcgctttgttgtactagagcgctgagcagagcgttcatcgggggggcattaccgtccgaaagcgaggggtccacgatgctagtactgctggtcctggtgcgatgctcatcctccctcgcccaagaaggcgttctctccgacatgccgccgtgcaacaagctggagttgatactggcggggc

SEQ ID NO: 39619 - DNA, 339 bp, Zea mays
  Clone ID: LIB3062-059-Q1-K1-G11
ccttgatgtagaagacatttctgggaggaggacaatgcactctttctacagtgatgttgtgcgccttcagggtctaagggaaaggttttcacattgtaactcaaacatggacgcaggccagtgtttctttccacgtgaagttgtgaagcacattgtcaacccagttttcgttcttaatccagcatatgatgcctggcatgtacaacatgcgttggctccagaagcatctgaccctcaacattcatggctggactgcagattggatattagcaagtgcagccctaaacaacttggaattcttcaaggttcaggaaagaactgcatgacgctataagtgaa

SEQ ID NO: 39620 - DNA, 451 bp, Zea mays
  unsure at all n locations
  Clone ID: LIB3062-059-Q1-K1-G12
gctcgtaccggttcggagtttcgacccacgcgttcgctcccacctctagcccgacaggtgaagccgccgccgctgcagtgtccatagccaccggaggagactgagatggggggttttgtcaagacccacaagagcaatgcgtacttgaagcgtttccaggtgaagttcaagagaaggcgcgctggcaagacagactacagggccaggataaggctgattaaccaagacataaacaagtacaatacacccaaatacagatttgttgtgcgatttaccaacaaggacatcacagcacaaatcatctctgctagtatagcangtgatatggttcttgcttctgcttactcgcatgagttgccacgatatgggcttgaagttggtctgaccaactatgcagctgcctactgcactggccttctgttggctcgccgtgtgctcaagacccgtggtt

SEQ ID NO: 39621 - DNA, 411 bp, Zea mays
  Clone ID: LIB3062-059-Q1-K1-G3
tcgcacttgggtaacacgcataacatctcatctgaaagaggccatcaccatgagaccccacaaatgcttaattggcgggtgataaaaggcggcctacctccgttaatctgcaagccagccttaccaccacttccaattccaaaacaaccaagcaaaacgctaccacaccaaccaggctaacaccagcacgacaaaacccgcgctaatactaggcctaaactactggtaattccccagatccaaagcgagatgcaccattcataaaaccatggcgcctctcggcaagctccgagtgagggtggacgactctaccacgaccaacggaaaactactacttgtggcaccgcgccgacgacggacgagacgacgctgcgggaaccatggagggtgttcagttgaactgggccccgc

SEQ ID NO: 39622 - DNA, 389 bp, Zea mays
  Clone ID: LIB3062-059-Q1-K1-G4
acagcatctaatcaatcaagacagccccgtgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggtgccatccccttcctcgagtccctcgtcgtcgccgacgtcg

SEQ ID NO: 39623 - DNA, 394 bp, Zea mays
  Clone ID: LIB3062-059-Q1-K1-G5
ctgacattgttgtcgatgtctcgttttatcacctttattatctcatcgtacaaggtcaggatctatcttaaaatagctctctaagctacaggtggacgaagaacctggtatcaggacaaacacgacaattcttcttggcaatattgcaggctacatgaacgatgggacaaggaagagagtgctgatcaatgcattcacagttcgtgcattacgtgataccttccctccggccagagcagctggaatcatggcactaagtgtcactagttcatactatgaaatgacagagattgcaactcgcattctgcctaacatcgttgagctcacatttgacccacatagtgatgtccgaaccaaggcatttcaggctaccgatcaggtcttgcaaattgca

SEQ ID NO: 39624 - DNA, 443 bp, Zea mays
  unsure at all n locations
  Clone ID: LIB3062-059-Q1-K1-G6
gcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctncactgccacagagtcgaaagtgttttacctcaagatgaanggtgattatcacaggtaccttgctgagtttaagactggtgctgagaggaaggaatctgcagagagcacaatggtagcttataaggcagctcangatattgcattggctgaactgccacctattcatcccataaggctgggactngcacttaacttctcagttttctattacgaggatcagaactctccaa

SEQ ID NO: 39625 - DNA, 332 bp, Zea mays
  Clone ID: LIB3062-059-Q1-K1-G7
ttaattcccgactcgagccactcattcgacgtcaccttctttttttttccttcattcatcatacattcgtcagcctttcctgaaggaggactatctcttctagttggctgcaacagtagttgtgctacaattaggaacattttccccagcatcaggattacattcgcacgatttcaacttcattgactatctttcgtgcacgtgcaactacgctgttggatatggaaactgttcattcaagctctcgtcaacatacggagataccttatctcaccatgccaccggactctcacactaacttcgcctagttacagactgtatctcagacacac

SEQ ID NO: 39626 - DNA, 169 bp, Zea mays
  Clone ID: LIB3062-059-Q1-K1-G8
tcgggctctccccaattctaagcgagactgtgcacaggaagaggagagcctaaaagcctagccccccgaatcggatgcggccgccggagcgcggaaccccaccccggccgccatggaaaagggagggatgagcgacgctgaacggctggtcttcttcgagatggcctgc

SEQ ID NO: 39627 - DNA, 93 bp, Zea mays
  Clone ID: LIB3062-059-Q1-K1-G9
tttgtgatggatctaggggcctctttgtcaattcattcaataaacaaagtgtgaaatggaagcttaatgtgctggctgtatcctgctaaatga

SEQ ID NO: 39628 - DNA, 358 bp, Zea mays
  unsure at all n locations
  Clone ID: LIB3062-059-Q1-K1-H1
cttcgacggcgtgcccgtctccccgggctcattcgccatgcattcctcagcctccgcgagaggaggactagggctcctcttgccggcggcggttgtggtgctactgttgggtgcagtggcgccagcggcgggttgctatccgtgcgtgttcaacttcggggactctctggcggacacgggcaactacccgttcgtctatggcaacggctcatccaagctccgtccaccatacggcgagaccttcttccaccgcgccacctggcgcgcctncaacgggcgcctagtggtggacttcatcgcggacacactcggccttccgttcgtgcgaccgtatctgagcggacggatcgcggatgac

SEQ ID NO: 39629 - DNA, 399 bp, Zea mays
  Clone ID: LIB3062-059-Q1-K1-H11
gaaagaaaaggtcacccctctaacaccacgccgccgccgtttgctgctcggcgcctgtgctgacaacccgtacgccaacgtctccaatctcgtatactttcgtgctcagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcatagcatcattggagcaagcggagagttcagtgact

SEQ ID NO: 39630 - DNA, 402 bp, Zea mays
  Clone ID: LIB3062-059-Q1-K1-H12
tcgacccacgcgtacgaagagcccagatgagcaccctttctttcctgaggatctgcctgagccccggttgccagctatgcagtacccaagggttttgcatcccattgccgattctatcaatatcaacaaagagatttggaaaatgtattttgatgaacttcttccaagattggtgaaaaaaggaagtgatggtaatgctggatccagtgctctttgtgacacgacctgcttgcaggcgctctccaaaaggatccactatgggaagtttgtggcagaagctaagtttcaggagtccccggaagcttacatgccatccataatagctcaagaccgtgatcaactcatgcaccttctcacatatgaaacggtggaacgtgctatcgaacacagggtggaaaccaa

SEQ ID NO: 39631 - DNA, 261 bp, Zea mays
  Clone ID: LIB3062-059-Q1-K1-D6
tctgtacccactcatcctttccctatttacaaaactctgtactctattattcacaattcactttttcccagaccggttctcttattcacacaggtggctcattcaccaaccattaacaaacatcattcagtgatcctctccttcttattctaacttaccctatcactaatcatcataccattaaatattctaaacttacaaacattcccaccatcgccttcttagatactcactactctattccctatgcatacatcgtca

SEQ ID NO: 39632 - DNA, 437 bp, Zea mays
  Clone ID: LIB3062-059-Q1-K1-D7
tcgcggactcgtgggctgactcgtgggtggatccaataaaatgtggattgaattgtaatgttaattatctagctgtgtcatgttgtatggttgtatgattatgatttattctgaatcctgagtacctggatcgcagttccaaaactatttagatttagaggtacattgccagggaaacttgtgacctgtttgacaaataatcatcatgtgtgattataattgtgtgtgttcacaccatgacactttgatactatggttacattttggtctccgttgtaacccaggtttcattctgagatatggaaattttttgtggttgtgtttccctggcgtatagcttttctttctgtaggcacctttttggatgcctgttcttcaaagatggtgttaagacatgacaacattatgtacctatgtagtgctagactcatactcag

SEQ ID NO: 39633 - DNA, 238 bp, Zea mays
  Clone ID: LIB3062-059-Q1-K1-D9
ctccatctcgaccgtcgctcaccgggaagctactctacgacgtaacatggcgtccagcgatcggccgcgcaacagaggtggtcctgcgcccattgaaaactctgatgactacagactcgcatatggccgccctcaagatgaatatcgtcaacccacacggcatctacgacgcgctcgttgcgtgaaccgcaagaccaaatgctcccaacacgacattcagctaacgagccatggacat

SEQ ID NO: 39634 - DNA, 401 bp, Zea mays
  Clone ID: LIB3062-059-Q1-K1-E10
gcaatccacgtgtcaagaaaataccagatgaagagtggtattgtttggcatgtaaaagaaagaaacctaagagacaacgtggaaagtttgcaaatcccaaagttgaatcatccaagggcattcaaagaccccgccgaggtcttggtcctattcgagatatgttactggattctgaatcatatgaaagtggggttcggattggtactaagtttcaagcagaagttccaaaatggtctggtcctatttctagtagagaagatgagtttgctgagcccactgaacttgatcgtagtaaaacgacaatgctgagtttcgaggataagaaaaccagtatcggtaactggatccagtgccgggaagttctagacacaagaattggttgtggcaaattggcggaggca

SEQ ID NO: 39635 - DNA, 407 bp, Zea mays
  Clone ID: LIB3062-059-Q1-K1-E11
gtcgtcgtggctcgtccgcgccctgacccaccgggccgtgcgcgaggtggatgcctagcgagactccttgttcgccttcatggatgtagtggtaggtgagcgcttggatcgacgagaaggtcaactgaagaagaggaggaggagggagaggatctgattgacgttctcctccggagccacaaggaaggaaacctcccgttccctctcaccatgaggacaatcgaagcggtcatatttgatctgatcggagggggtatcgagacagcaacaacaacgctgcagtgggcgatggctgagctgatgaggaatccaggcatcatggccaaggcacaggccgaggtcaggggattgttcatgggccaaaccaaggtaaccgaagaccggctaggtgagctaccctacctgca

SEQ ID NO: 39636 - DNA, 404 bp, Zea mays
  unsure at all n locations
  Clone ID: LIB3062-059-Q1-K1-E12
ggcaaggcagtggttgttggaggaggttatattggcctcgaacttagtgcagccctgaagatcaatgactttgatgtcactatggtgtttcctgaaccttggtgcatgcctcgcctcttcactgccgatattgctgctttctatgaggcttactatactaacaaaggtgtaaagatcttgaagggcacactagctgttggttttgatgctgatgccaatggtgatgtcactgcagttaagctaaaggatggcacagtacttgaagccgatattgttgttgtcggtgttggaggcagaccattgactactctcttcaagggtcaagttgctgaagagaagggtggaatcaagactgacgcttnctttgaaacaagcgtacctggagtatatgccattggtgatgt

SEQ ID NO: 39637 - DNA, 392 bp, Zea mays
  Clone ID: LIB3062-059-Q1-K1-E2
tcggaaaccaaggccaaggagcacagcaccccgtccgtccccagcaggagagcgagagacagaaggctgtgcgaagggaaagaagagactgtgggagaggagggcgacatggagaggccggcaccggtgaggaagtctcacacgtcgacggcggacctgctgatctggccggagggggcgccgcaggagtcgcccgccggggccacgccgtcatccaaccgtcggccgcatcagccgtcggaggcgctcaggaaggtggtgttcggcgggcaggtgacggaggaggaggccgagagcctcaacaagaggaaaccatgctctgctcccaagtggaaggagatgacaggaagcggcatatttgctgctgggggcgaggctgaagaagatgaatc

SEQ ID NO: 39638 - DNA, 258 bp, Zea mays
  Clone ID: LIB3062-059-Q1-K1-E3
tcgcaaaaatatcattaaaggcatccaaggtttattatctcttgctgaaacggcaaatgagacagggtttcaggacctcctgctgggaagccatctgtttgataggttgtcttgactgctacaacgcagagaggttgaaaagaaccacgtgaggtcctagaccgtctctctggtgatgaaattggcctgcactggacgagagccatacgttcataggctcctggagcttaatactcgtcacgagcctattgacattct

SEQ ID NO: 39639 - DNA, 439 bp, Zea mays
  Clone ID: LIB3062-059-Q1-K1-E4
ctccatcttccgttccttcccttactcgcgctcggcacgcaggcgacggcggcggcggcggcgctcatgctcgggctcgggctctcagcgacggcgtcagcggcttcccctcccgcctctcgctagtcgactcgcgccctcgcatccgttcctccgcacaccggccggtgaccctgcgtttcgttcttgttaactattcaagaagtaggaaatgatgagcaacttccaagccactacttgcaagcctcacagtaggatcattgtgaagaaacctatagcaagtcttggaagcacatgtcagtatccattatattcacatgctctcggattccacacgttgcaagagaaggtgtacccaaggctagttctcatttctgctagccacaaaaggctttactctgtatgtgccttaagtggaaagggaagctctggcactgct

SEQ ID NO: 39640 - DNA, 442 bp, Zea mays
  unsure at all n locations
  Clone ID: LIB3062-059-Q1-K1-E5
gaataatctcttcttcacctcactaacaccagctagcaactctttctctcctgcaagaatggccgctcgctcctgctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcaggcccaccgtcgactgcaccaagatc

SEQ ID NO: 39641 - DNA, 192 bp, Zea mays
  Clone ID: LIB3062-059-Q1-K1-E6
tcttcctaaactatctctatttcacattactactcccatctctaccctctctactttcggcaacgattcacacttaactttgatggctacagactcatcctgtcgattactctaacgctctaacctccatgcatactggtacttgcatcaacgtatctacccacttcaatcgaatataaagcttcaaacatc

SEQ ID NO: 39642 - DNA, 324 bp, Zea mays
  Clone ID: LIB3062-059-Q1-K1-E7
cctgaattccctcggctacccactcttcctaaactatctctatttcacatcactaaccccatctataccatatctactttctgcaacgattcccactcaatcttggtggcttcagactcatcctataaatcactctaacgctctaacatccatttctactgctaatggcatcaacgtatctacctatttcagtcaatataaagattcaaacatctcacatcataagtgtaaccaatcctcatctactcaatcatcagactctctttcaactgctctatatgatatatctcaaatcgctctctttactctaacgcatgctttcca

SEQ ID NO: 39643 - DNA, 386 bp, Zea mays
  Clone ID: LIB3062-059-Q1-K1-E8
ctaggaatgtggaatcgctgaagaacttcgtgttgaatgaagctgagaaagcaggtgaggcaaagcttcaagctgattgaggcaggggagtttcagcaagcatgtggcgtagacaaggaacaatgctgtgcaacattgtcttctatcctgtcatttacaaagccaatttacaggaaagaaatgatcttatgaccccgtatcagagtattcctcttcgaaagtaactccgaatcagttcatagaagctgtactccattccatagtttttatcacattgacaaactccgaatcagttaatagaagctgtactccattccatagttttcatcacattgacaaactgaagtaatgattggaacgcatccatacaaagggcctgttatgtc

SEQ ID NO: 39644 - DNA, 407 bp, Zea mays
  unsure at all n locations
  Clone ID: LIB3062-059-Q1-K1-E9
atgggggtcagtctcagagaaccttggtctacttcaaggatgccttctaacctgtagggctgatgattgaatgttgctgcgtttatctctggctcnnctgttntatgcactaatccaatgaggctgaactcttgttgtcaattgcaaaaggaaaatcctgctcgagccaacggccacatcttcaatgttgggaatccgaacaatgaagttaccgttagggagttggcccaaatgatgacagaggtatgccatatattgttgaccctgactggtgtacttgttacttgtttctattgtaagtcatctattgtgatcttgtcacgaggttctagtattttcgcaacggacaaaagagttggagagtactacctatattcgaaaggtctngatgtttgccaaattgatgg

SEQ ID NO: 39645 - DNA, 344 bp, Zea mays
  Clone ID: LIB3062-059-Q1-K1-F1
agtgcagatcactgacctcagcatggttcaacttcctgatgaactacggcgtgaccaggtgggctagctccccgacgcggatgctctgcacgttcttctacttcgtaccctactactccatcctgagcaaggcatctctcaagtccgacgacatcaacttcagcgtcgatctgctggagctcatgaccgacctgaaacctatccacaagtcttcattgactagggccgacaagagcctggctctatgggctacgtctactctgctatacatcccactatatgtcacgagactctcggacactacgctgcagtgcaagatccctacaattgagacgcatatcatg

SEQ ID NO: 39646 - DNA, 266 bp, Zea mays
  Clone ID: LIB3062-059-Q1-K1-F10
cggaggcgtgcgtgctgcggcctgcggcctgcaggaccagagatcggggactgatctagggtctgggactgggaggcggagatgtcgacgccgtcgaggaagcgcctgatgcgggacttcaagctgttgcatcatgacccgtccgccggcatcagcggctcgccgcacgacaacaacatcatgctctggaacgccgtcatattcgggccggatgacacgcctagggacggatgcacgttctagctgactcttctatgtacagaaga

SEQ ID NO: 39647 - DNA, 405 bp, Zea mays
  Clone ID: LIB3062-059-Q1-K1-F11
ggaagagagaatcctaccaaacctagctaccaactcgatcgtcgtcatcacgctcgaccgcacaactgcaccgaggggggaggagacctaaaaactactacatcttttagctacacatctagctaaagatcgagaggggtaaataaggacgagtgggcgctagctagaagagcagctgcaggtactaccatcatcgtcgtcgtcgtcgtcgccaggatgaccgtcgtcgacgccgtcgtctcctccaccgataccggcgcccctgccgccgccgccgtaccggcggggaacgggcagaccgtgtgcgtcaccggcgcggccgggtacatcgcctcgtggttggtgaaactgctgctcgagaaaggatacactgtgaagggcaccgtgaggaacccagatgacccg

SEQ ID NO: 39648 - DNA, 211 bp, Zea mays
  Clone ID: LIB3062-059-Q1-K1-D5
atccctacttacaaaactctgtacttaagttttcacaattcactatttcccaggccgtttctctcattcacacgtctgttacattcaccaaccatttacaaacctccttcagttatccaatccttcttattctgactgaccctaggactgatcatattaccattaaagagtctactcttacaaacattcccaccatcgccttctgtaatac

SEQ ID NO: 39649 - DNA, 440 bp, Zea mays
  Clone ID: LIB3062-059-Q1-K1-B8
cggacgcgtgggcggacgcgtggggtctgaagctgaggctcatgcttttgaagtcaagtcttttggcctctacaatgaattatcagagcttgttgggttaggatgcgcggataacaacttaaacaccagcaatgtggaaactacggattatctcatgttgccacctgacagagaactgtcggctaatgattacatggaactaaacgatctccttgctcctgacccaagctttcccagtgaattttctgctcaggacaatcaatatatgcagcatcctcttgctcagtacaatggacattatgatctgtcggtccttcggagccaacaatgcctagcattttcgatgtttttcctcccaataatggagtcctcgcaacagatgatccagccaactacttggacccagccatgcagttccctttctcatgattggttaccat

SEQ ID NO: 39650 - DNA, 411 bp, Zea mays
  Clone ID: LIB3062-059-Q1-K1-B9
acgctgaagtagaagcacttgtgctcgcagtcgaaatgcttggaaccggaaggtggcgagaggttaaacttcgcgcttgtgacaatgcaaagcaccgtacctacgttgaccttaaggacaaatggaagacgctggtacacacagcgagcatctcgccgcatcagcggcgtggcgagccggtgcctcaggagctgctcgaccgggtcctggcggcccatgcctactggtcccagcagcaagccaagctccagcctaagacgccctcgctggctgaggctcgcttgctcacccaataattcgatgatcccggctgatggcctcctctgaggccgttgcagcctttgtataaagtcagtaagtcccttcacaggaggtttaatgaaaatataatattaggggaaaaaaagaatg

SEQ ID NO: 39651 - DNA, 308 bp, Zea mays
  Clone ID: LIB3062-059-Q1-K1-C1
aaaatcaataccctggatgacacatatatagcgagaggcaaagatccttgcgaagagtgtatcaatcacagacaatctcataagctagctcctcacaggctcgtcattcttcacaccgaagtacctgtactatatctcgcgggtcctacaatgtcaccatgtgccacatattcatcatgaagcttatgcagctgaaaatagtagaattccacataccttgccttgtcacgatcctagaactgcttaacattacactgtcaaccacacaacttgtcgtactgatgcagatctacaaaggccagactgtc

SEQ ID NO: 39652 - DNA, 139 bp, Zea mays
  Clone ID: LIB3062-059-Q1-K1-C11
cacgacctgctttcaccctctctactaaacaatccactatcgttagcctcaagcacaaactaattttcatcaatcccctcaagctcacattcctgacataatatctcatcacccagatctactcatgcactttctcaca

SEQ ID NO: 39653 - DNA, 175 bp, Zea mays
  Clone ID: LIB3062-059-Q1-K1-C12
gtcgcttcttaaaccttagtactacggatgttatgagctaataaatatatgtggtgtctgaaatgttctagaacctctaaatctattactaagagcaacgatattgtcgcttcttaaaccttagtactacggatgttatgagctaataaatatatttcgctaatgtgatgcagtt

SEQ ID NO: 39654 - DNA, 479 bp, Zea mays
  unsure at all n locations
  Clone ID: LIB3062-059-Q1-K1-C2
ttcggtccggattcccggctcaccaaccacttcttcgcagagaacctgatcgggaacggagggaacagcagggtgtacaggggcagcctcgcctgcggccggcaggtggcgatcaagctgtgcaaggcgtcggcggaggcgtccaaggacttcctccgggaggtggacatcatcaccaagctgcagcaccaccggatcgtccccttgatcggcgtctgcgtggaaggccgcaacctcatctccgtttaccgctacctccccaggggcagcctcgaggacaacctacacggggaaaggtcaaagccggcgctgtcgtgggagaaccggtacaaggctgcgctggggatcgcggaggctctgagctacctgcactccggcagctcgcggccggtgatccacagggacgtcaagtcgtccaacatcctncttacagaagagttcgagcctcagctatccgatttcgggctggccatctgggc

SEQ ID NO: 39655 - DNA, 362 bp, Zea mays
  Clone ID: LIB3062-059-Q1-K1-C3
tctttgatcaatggtttcaaatatctttcgaatatgatcaacatgatctgatccatcggcttggtaatgttctacggcgatctcttctcagaaggctcaactctaatccagaaagagatctacctccaaagtactaatccatactcaaaggctctatatctcacacgcagaagcttcactattatactttacatctaaattcttctgatgcaagccaatccagttctgaatacgctagcaactgccaataaggctcaataaccatctcattaaactggtccaattctatccgaccaatatttctatcgcatgataaaactaaaggccttgaaagaatctaatcttgctttctctcaacatgg

SEQ ID NO: 39656 - DNA, 449 bp, Zea mays
  unsure at all n locations
  Clone ID: LIB3062-059-Q1-K1-C4
gaaagcacaaagcaggaggaagccggcggtgtaggcgacccatggctccacagacgaggagagagaggttggcgggggaggcgcggccgagctcgtcggggctaacaccggcgaagccgggggcggtcgaggtgcagcgccgacgggcgggcagcggttggacgagccgtcggatctccatctacgcctcccgagtctacttcctcctcatcatgctccagatcccgctcttcagggtcccttgtagagctggcacatgcacaactcctattcaagtaacatcatctcagttggtctcaaatgatatattcccagcagctgttgtgaaggccatgctctaccctggagctaccgtgagcagcctaactaanagcaagacatttccgagttggaatgacctgtttgacatgtacaacctgacagaagcananaatgcttctgcagtagtt

SEQ ID NO: 39657 - DNA, 463 bp, Zea mays
  unsure at all n locations
  Clone ID: LIB3062-059-Q1-K1-C5
ggatctactgcttatggggtgaaaaacatcgatgtcctagagggtgcaagggctgctctgaatctgtcaggagccgtgcttggatattatcctgtcaatgttctgccgtcaaaaactgccattgcaccagtcaacaaaacattcctacccaggtctaacgatgaacatgaaatgtgtgcaaggactatctactgcacaaattaacattgacaagaaggtcactcaagcagatctaaagttattctttgagtccatatgtggtgaggttggtcgttctttactccaaacacaatctcccttctgtatagctaaaagtttgcagaaatggcaccatcaagatcgatctggagaccaacaagatcatggacttcatcaagtttgacgtcggcaacgtggtcatgatgaccggcgggaggaacaccgggcatgtangagtgatcaagaacagggagaagcacaaggg

SEQ ID NO: 39658 - DNA, 441 bp, Zea mays
  unsure at all n locations
  Clone ID: LIB3062-059-Q1-K1-C6
ggcagtttttaattgggtccaagtaatgacattgttaatgggaagtttttgtgtatactcacgccaccaaattaaagcaaaatcagtaaattcactaatggcagccttcacttggctattagcaggaatatcatggcatgaaaatttctgttctacctctaattcccaatcaagatatgcagcaggatcatatttaccattaaaagatggaattttaaatttaatcttagaaaataagtcattagggggatgacgaaccacacgacgtgcacgaccacggcgatctccatcgtcctgctcagtgtcaccgccgtattcctgctccatctttgtggtcaatgcatcaaggcgtgccaggatggtgtcgagtgtggtgcgagtcgccgtttgagcaaggtcaagttggttgaaacgctncgtcgtcgaaatgatcggtggatc

SEQ ID NO: 39659 - DNA, 463 bp, Zea mays
  Clone ID: LIB3062-059-Q1-K1-C7
cgatgaactagacgatgactctgatgtggatgaggatactgatatatctgatgaagacgaaggtgacgacgatgaagtgaaagaaagcataaatggttcagaggatgaagctttagaccagaaggaagacagcgaagaggaagacaagtcaaaaggcagtggctctaaagcgcagaagaggaagtttcatgattatattggacagctaagttctgctgatgcaagccttcgagttctgaagaggttagcaactgccaagaaggctgaagaaccatctgatgaaactggtaaaattctatccgatgaagatttcaaacgcatcaaagaactcaaggcaaagaaagaggcgaagctggctttggctcagcatggactaatcaagggtgtcgacacatggtctgtaacctttaagatgccatcatctgaccagctcagcaggaagcgtgtcgatccacttgagctt

SEQ ID NO: 39660 - DNA, 243 bp, Zea mays
  Clone ID: LIB3062-059-Q1-K1-C8
aattccctcggctacccactcatctctcactctattaaatctattactactaatttcattgctaaagacaaatctatcagcatagttactctaaaaaattgaagcgcaatcaatcaatacactaatctccaccttcactacactattaacaacaatatcatatcattaaaattccttatctacctttaattcccaatcaataaatacatcataatcatatttaccatttaaacattcaatttt

SEQ ID NO: 39661 - DNA, 336 bp, Zea mays
  Clone ID: LIB3062-059-Q1-K1-C9
gggcgagttcggcggcaacgactacaacgcgcagatcttcggcggctacaccccggagcatgcgagcggtcagagcgccaccatcgtggacgccatcggcaagggcgtggagcagctcatcagcctgggcgccatgtacgtggtggtcccggtcgtgctgcccgtggggtgcttaccgatctacctgacgctgtaccagacctccagcgccggcgactacgaccagtacggctgcctgaagcgcttcaacgcgctgtcggcgcatcacaactcgctgctgcaagccaaggtgtctagcctgcatagcaagtaccccggcgcgcgggtcatgtacgc

SEQ ID NO: 39662 - DNA, 423 bp, Zea mays
  Clone ID: LIB3062-059-Q1-K1-D1
cgatgaactagacgatgactctgatgtggatgaggatactgatatatctgatgaagactaaggtgacgacggggaagtgaaagaaagcgggaatggttcagaggatgaagctttagaccagaaggaagacagcgaagaggaagacaagtcaaaaggcagtggctctaaagcgcagaagaggaagtttcatgattatattggacagctaagttctgctgatgcaagccttcgagttctgaagaggttagcaactgccaagaaggctgaagaaccatctgatgaaactggtaaaattctatccgatgaagatttcaaacgcatcaaagaactcaaggcaaagaaagaggcgaagctggctttggctcagcatggactaatcaagggtgtcgacacaaggtctgtaacctttaagatgccatcatc

SEQ ID NO: 39663 - DNA, 372 bp, Zea mays
  Clone ID: LIB3062-059-Q1-K1-D12
gaaggattcggtggaaagtgtaataaagcagataagtggcattgctatttccgagtcagatgcaacgccgtccacagatactacaaacaattcacaaccggaatcatctgctccagacatagataagaaaattcgagcattgaaaaagaagatacgcttagctgaagcacaagtacaaggtgaccctgaaaaattgagatctgaggcactggaaaagatgaaaaagcttgatggatggcttatggagctgaagcttttggaggacaagagagcgcctgctgcttagacaaaatcaacttcggttctgatgtagagccaccgcgaccacaccatggtgccgatccagattcgaaagtgcaactgaatcaccat

SEQ ID NO: 39664 - DNA, 251 bp, Zea mays
  Clone ID: LIB3062-059-Q1-K1-D4
cctcctcttttacacatttttactattaacacagatttctatctacatagcttggttcctttttcagttgctagtactattctatacacattacattcaaccatttaccttcaatcattccatctatcttaatatcctaaatccacaattatcaaaccatattttcactcttttaacttcattaccaacttcacttaacatttcaatcaacatatctcaaattcatatcaatctaacttattatttcaatt

SEQ ID NO: 39665 - DNA, 437 bp, Zea mays
  Clone ID: LIB3062-059-Q1-K1-B7
ctgatgattttgctgagggaaaaatcaataccctggatgagttatatagaactggagccaaggtaccttctgaagtgtttgtcaatagcaagttaacaccaaagcttgctcggcaaatgcaggacgttctcgcactatgtagtggcagtttaccttcttggtgttatcaaatgaccaaggcctgcccattcctgtttccttttgagacaaggaggcagtacttctattccacagcctttgggttgtcacgagcattgaatcgactccagcaacagcagagtgataatcacagctctggtggtgaaagagaggtcaggtttggcaggttacaacgccagaaagttcgtgtttcccgtaaccgtattctagattctgctgctaaagttatggagatgttctccagtcagagggctgttcttgaggtggaatacttttgc

SEQ ID NO: 39666 - DNA, 439 bp, Zea mays
  Clone ID: LIB3062-035-Q1-K1-H6
ctgggagatagagagaggagagggagggttttctcaaagagaacctgaacccaaacggaaggagagaacactagcgttgggtcaccagggcgggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacaacgagctcgtggccgcgctgcccggcgacgactgccgctacgccgtcttcgacttcgacttcgtcactgttgacaactgccagaagagcaagatcttcttcatcgcctggtcaccggcggcgtcgaggatcagggccaagatcctgtacgcgacat

SEQ ID NO: 39667 - DNA, 454 bp, Zea mays
  Clone ID: LIB3062-035-Q1-K1-H7
gctggtggaccacgccctcagcagcggttactcggagcgcgagccctccgtcttctccgggagcaccaagttcgaggaggagctccgcgcggtgctgccccaggaggtggaggccgcccgcgtcgccgtcgccgagggcaccgcccccgtggccaaccggatcgcggacagccgctcgttcccgctgtaccgcttcgtgcgcgaggagctcggctgcgtgttcctcaccggcgagaagctcaagtcccccggcgaggagtgcaacaaggtgttcctcggcatcagccagggcaagctcgtcgaccccatgctcgagtgcctcaaggagtgggacggcaagccgctgcccatcaacatcaactaaaagacgccaggcgccgccatccatgctgccgcccgcgcatggccggaggagaagaggaaaatacatgaaaaaataaaacttgtacacgtg

SEQ ID NO: 39668 - DNA, 326 bp, Zea mays
  Clone ID: LIB3062-035-Q1-K1-H8
ccgaaaaaaacaagcacaaagttggtcaacaaacttatattctctatcctccaacacattatcatggtcaccatcatatctagtggacctactaacctgacacacctcacaattcatatattaacatcatcttacaccccaacatcacaatcaatcaacccaccctaactatcatccttcgcacttaacatccctcatccatctactcaatcatatactcacacatgaatttcactacctgagcactacctacctatgcactacatcctccttctactagctgactccaactaactatttgctcatccaccccatgataacttacc

SEQ ID NO: 39669 - DNA, 439 bp, Zea mays
  Clone ID: LIB3062-035-Q1-K1-H9
gccggcacccccatcaaggtgggttccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagacattcgccaagaaccgcgagctggaggtgatccactcccgctgggccatgctcggcgcgctcggctgcgtcttccccgagctgctctcccgcaacggcgtcaagttcggcgaagccgtctggttcaaagccggctcccagatcttcagcgagggcgggctggactacctcggcaaccccagcctgatccacgcgcagagcatcctcgccatctgggcct

SEQ ID NO: 39670 - DNA, 394 bp, Zea mays
  Clone ID: LIB3062-036-Q1-K1-A10
gcaacaatggcattcagaatgggtcttgataagagtgacgttgaaccggtggttcattgtatcttgccagaaatcgtgggagaatacatacatgtatattgcatgcagattccccccaccctcccattttcttctcttttctagacatcttactatgctctttctaggaaactggtcgtgctgattcaacaaaagtcaaagtcttttgcacaaatgaaaaaaaaaaaaaaaaaaaaaaaacaaaaaaaaaaaaaaaaaaaaaaaaaaaaaaaaaaaaaacaaaacaaaaaaaaaaggcggaccgcccttaaaggaccacagatgactaacatgcagttcctacgaattagctgttctataaaagaggccacagctcatttaactggccgccggg

SEQ ID NO: 39671 - DNA, 218 bp, Zea mays
  Clone ID: LIB3062-036-Q1-K1-A11
tcgctccaaggagatgcaaggaggtcactctagtatatctacagttgaggcgaaggagcagttagatgccctgtctgggtgtgtaggaaatgttgattatactaacaccccacaagaagtgcacgatcatttccaagcttgaggaactgtcaacagggtcacaatcttgactgacaagtttgggcagccaaaaggttttgcttatgatgaatttctgg

SEQ ID NO: 39672 - DNA, 369 bp, Zea mays
  Clone ID: LIB3062-036-Q1-K1-A2
gcggctacaaccggtcgacggggttcgtgtggctgcggtaggccgacaggctgacccacaccttggggtcgatcggcaagcatgggtggtacgacagggaggttacggcgttcgtggagccgggtcggatgcacggcctctccggggtgaagagcaaggagctcctcatctgggtcaccatctacgagatcgtactcagcctctcctgcaccaagatcgtgattcgcacccccgcggggcgtcggacgcgccttccctgtcaccgccttacagctcgagcccgagggggaccacaaggccgacgacgccgtcgtcggcggcgaccactgatctgctctagcttccggctgcggcttgcttacatgggct

SEQ ID NO: 39673 - DNA, 383 bp, Zea mays
  Clone ID: LIB3062-036-Q1-K1-A3
gttgggtctttgtctatgtagtgcaacccttatttttgttttctaataccatcacaacgcatgtggagtaaaccaaacttttatacgcttcatgcttgcaaaactttagttcttattctaatgaactgctggtttgtgatgaagttttgtttagggtttagggtttggcattgtgtataaaggttgtgtttaattgctaacccttaattttgtcaaccttaactggatgatatacaatagtatggtcctttccaaagaccctttagttaagaaccatgaaatgctcctgaatctcctaatccaagacatcttttggtaactaccaaattgcaggttgttggagcatttgctaatttggaacaaatgactcaagttaaccataa

SEQ ID NO: 39674 - DNA, 410 bp, Zea mays
  Clone ID: LIB3062-036-Q1-K1-A4
aaaaatgtgcataatcatttgctaagtttaatgacctacgtcaggtcttacgtactaaaaaatattcgctagttgagtggttcgggcatattcctgagtgtgctacggtgaacttgtatgtcattatcatttcaacgtatctagatgcattatggaagatttttagttttctttgttatatttgagaagttatatattgcatatacagagagatgcagctgggtattatttgctgcaacttcgcgatgttgcagtcattttattgtacataggttatatgatacgtctgtgtcaccgcatgaaaatctactgctgtgccatatgaagaccttgcttatcacggtgtttgtacctaagatcaactactgggcctacaccgtggacggagtatttaattgatgaaatggcta

SEQ ID NO: 39675 - DNA, 420 bp, Zea mays
  Clone ID: LIB3062-036-Q1-K1-A5
ggctttagcgatggtcctgttcatggctggcgccgcgctgctcgccggggctgccggggccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcatgcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgcctggcaagc

SEQ ID NO: 39676 - DNA, 395 bp, Zea mays
  Clone ID: LIB3062-036-Q1-K1-A6
aaaagagatactgtccccaaactgcaagtctgccaagagactgaaagcattggtggcgttcggttcggcgacaactgaccagagcaaagaaccggatcaaattgggatcaaaatgtatgcctgggacgatttcttgaaagtggggaaggataatcctcgtcaaccttgccttccgcaggcaagtgacatctgcactgacatgtacacaagtggaacaggcggacagcccaaaggtgtgatgctgacccatgaaagccacgccatgtatgtgaaaggggtggacctcttcatggaccagtttgatgataagatgacaacagatgatgtcttcctgtcgtttctcccgcttgctcacatccttgaccgcatgatcgaagagtatttctttcacaaag

SEQ ID NO: 39677 - DNA, 444 bp, Zea mays
  unsure at all n locations
  Clone ID: LIB3062-036-Q1-K1-A7
ggccccgaagcctaagccaaagaatccccttgatttgcttcctacgagcaagttgatgcttgaggattggaagaggctgtattctaacacgaaaaccaacttccgtgaggttgctattaaaggtttctgggacatgtatgacccagagggctactccctgtggttctgtgactacaagtacaatgacgagaacacagtgtcgtttgtgactatgaacaaggttggtggcttcctgcagcggatggatctgtgccgcacatacgcctttggcaagatgcttgtggttggctctgagccccctttcaaggtcaaggggctctggctcttccgtggccccgaaatccccaagtttgtcatggatgaggtctatgacatggagctctatgagtggaccaaggtcgacctctctgatgaggcccagaaggagcggntcaatgccatgat

SEQ ID NO: 39678 - DNA, 199 bp, Zea mays
  Clone ID: LIB3062-036-Q1-K1-A9
ctggaacacgcacatcaagcgcaagctccttttccgcggcatggacccgcagacgcaccgcgggctcgccagcgcgaccgcggggcagcagcattaccagcttcaggagccgaaaaaccaagcggccggcggcggtccatcaggccatcctgaccaggaccacttggaggtcgtcgtcattttgaattgcccgaccaag

SEQ ID NO: 39679 - DNA, 468 bp, Zea mays
  Clone ID: LIB3062-035-Q1-K1-H5
ggctgtggtaaaactgtcattagtcaggcactttccaagtacttcaattccgaagctgtggtttatgtgggctgtggggaacgaggaaacgagatggctgaggttctcatggactttccccagttgacgatgacattgcctgatggccgtgaggagtctgtcatgaagagaacaacactggtggctaacacatcaaacatgcctgtcgctgctcgtgaagcttccatttacacaggaattacaattgctgagtatttccgtgatatgggctacaacgtcagtatgatggctgactccacctcccggtgggctgaggcattgcgtgagatctcagggcgtttggctgaaatgcctgctgatagtggttacccagcttacttggctgcacgtttggcatccttttatgaacgtgctggtaaagtaaaatgtctgggaagtccagacaggaatggcagtgtcacaattgtt

SEQ ID NO: 39680 - DNA, 429 bp, Zea mays
  Clone ID: LIB3062-036-Q1-K1-B1
ctcaggtcgctgctgctgtgccacgcgctgcccaagtactactcgctggccgagttcgaccgggtgagcgcgctcggcccggtggccaccctcgccggctcgcagtacacgctgaacctcacctacgacatgggcaccgtccgcgtgaagtccatgtggtccgaccccaagatcagcagcagcgtgtactccacccgccccgtcgcggtgtacgaggtcggcaaggttctcctgccgatgcagatcttcaagagcgaccccccgctggcgcctgcccccgctccggcaccggatgccaaggcatccgacgtcgctcccagcccggcgtcggggaaatcgtcagcgagtgcgaaggcgaaggagaaggcgggagagaagagctcgtcgtgccgagccggtgtcgtcgcccattacttggcgatcgctgtc

SEQ ID NO: 39681 - DNA, 403 bp, Zea mays
  Clone ID: LIB3062-035-Q1-K1-G1
gccgctctcctccaacctgccccacctcgtgtcgctccacctcgtcctcacccaccctgccagacggggcccgtcccgggtctcgccgctccccggcgtagatttctcctgcgccttccgcggccggcccgcgtgggtgctcgtgtccgcgagcaaccccgccaggcttgcctgggccccgcccgggggtctccgtgcccgcttcgcggccgcgctagaagccgcgcgcggtgccccgcccgctacgcggcccgagaagctgcttgtagtcttctcccgcggtgtcggcgtggatatcgcgcggcggctagccgaggggttcgaggccgccgaggctgacttgctcgaggagttcattggcgactccgaggaggagaatgaacaccggtgggttgtcgtcagc

SEQ ID NO: 39682 - DNA, 402 bp, Zea mays
  Clone ID: LIB3062-035-Q1-K1-G10
gcgttcaagggtccaagtactgagggtagttcaatgaggcaaagcaattcggatggcgctttagagactatggcacgtagaccggctgatcctgaagaagaacttagatggatgtctcaagaagttcgtggttatgtcgaggctgttttgaatagtctggcagcaaatgttccaaaggctattgcgctttgtcaagtggagaaagcaaaggaagacatgcttaaccagctatacagctcgataagcgggcaaagcaatgctaagattgaagagctgcttccagaggaccataatgctaagcgcataacggagaagtaccaaaaacaatcatctatcctgtcaaaacttactcgtcaactcagtatccatgataacaaggcatctgtatactcttattctaat

SEQ ID NO: 39683 - DNA, 357 bp, Zea mays
  Clone ID: LIB3062-035-Q1-K1-G11
ttaatttccgtgtcgaggcacgcgtgcactcagtttcaaaagcaagttgagtagcaatatctctcatatgtgtagaggcaatttgaaaggagccatgttgcttaaaacggtcggaaggttaactttctttttatacatacactaaatctactaataactttacacctacagctctactacattttccattacctaactctagaatttattttatatactcttacaattactatcaataacatatatattatcacactcttatgctgatcatctttacaacaatcattacattttctactacacttgtatatttctttctttttacttattgtataattttccatacttaacattttt

SEQ ID NO: 39684 - DNA, 439 bp, Zea mays
  Clone ID: LIB3062-035-Q1-K1-G12
gcgcaactacccactggccactgcagccgagtgttcctttctagccttcacttctcagcacggcgaggctgggatcccccgactgcagccgccagccgcgccatggagcaagcagccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttacgccgcgggatcaccttcttcgacacctccgatgcctacgggccccgcaccaacgagaccctactggggaaagcgctcaagcagctgccgaaggagcaagtgcaagtggccaccaagttcgggataagtcaaggcgccgctggcatgaccgtgtgcggcacgcccgaatacgtacgcgcct

SEQ ID NO: 39685 - DNA, 411 bp, Zea mays
  Clone ID: LIB3062-035-Q1-K1-G2
ggacatgaatggtttcagggcattggatgctaaataacctactggggatttccatatgtatggcgtttgtcagccatgtgaggcttcccaacataaagatctgtgcactgcttcttgcctgcttgtttgtgtatgatattttctgggtgttcttctcagaaaggttctttggagcaaatgtcatggtttctgttgccactcagaaggcatctaatcctgttcacacagtagcaaataagctcagcctgcctgggttgcaattgattacaaaaaaagctggagcttccagtcaagcttgtatttcctaagaatttgttgggtgggattgttccaagaagcaatcctggtgattacatgatgcttggccttggaaaccatgccattccagggatgcttctagctctggtactc

SEQ ID NO: 39686 - DNA, 348 bp, Zea mays
  Clone ID: LIB3062-035-Q1-K1-G3
gtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacac

SEQ ID NO: 39687 - DNA, 173 bp, Zea mays
  Clone ID: LIB3062-035-Q1-K1-G4
ggccgtgcgtaccgtcttcttagtactttccttgcaagtgtcgttccgtccctgtagtgaggcagtatactttcgaatgtcttcacttcatggtcgctccactcctgttagatctggactcttatcctgcattctgtacttgccctaagcatctatgatgcctgttttaaaaa

SEQ ID NO: 39688 - DNA, 447 bp, Zea mays
  Clone ID: LIB3062-035-Q1-K1-G6
gtcccataatacatgtgggccggcatcatgaaggggacttgatcattcatcaagctagcacggagccctcatatagttatgtgccatcaatctttttaccacaatggtgtaatatatcttgttcttgagtacatggaccgtggatcgcttgcagacattgttaagcaagtgaagactattctggagccataccttgcagtactttgtaagcaggtcttggagggtttattgtatcttcatcatcaaaggcacgtgattcacagggacataaaaccatctaacttgttggtcaaccgtaaaggtgaagtcaagattaccgacttcggagtgagtgctgtgctagcaagctcaataggtcagcgagatacatttgttggaacctacaactatatggcgcctgagcggattagtggtagcacttatgactacaaaagtgacatatggagt

SEQ ID NO: 39689 - DNA, 443 bp, Zea mays
  unsure at all n locations
  Clone ID: LIB3062-035-Q1-K1-G7
cagggcacggcaccagacgcgtccatggaccccaccggcgtcgacggcgattccgcggcggggaggggaagcggaggcggaggggggacaggggccggccggtgggcggttggcgcggtgtgcgggggcctggtctactaccactgcgcggtacggcgagccagcgcggtgtcccttgcagcagacgtgctcctcgtccttctctgctcgctctccatcctcggcctactcttccgccacctccacatctcggtgcctgtggatcctcttgaatggcagatctctcangagatggcaaatagcatagttgcatccttagccaatacagtaggagctgctgagtctgtattaagggtggctgcaactggacatgacangaagctgtttttcaaggtggtttctacattgtattttctagcagctttgggaagggtggtgtcagg

SEQ ID NO: 39690 - DNA, 335 bp, Zea mays
  Clone ID: LIB3062-035-Q1-K1-G8
cacctaactattcttgaacttgattggcgactcaaccggcgaatcaaatccgatcagatagggcattacatcatggtgcccctattgtggtaagctacacattgcataacatgcgatggaccatatgaatcccttgccaaaaggcatgacttcaatgcaatagcatgacaccaacgatgagcactcaactgctccattcagctaacatacatactctatccacattaaggacctaacgatgctatccttgctaacgctgatggtgcggttcatgatgagtgatgttagtaatctaactacgaatgactggcatcatctaccacagtctacatatg

SEQ ID NO: 39691 - DNA, 225 bp, Zea mays
  Clone ID: LIB3062-035-Q1-K1-G9
catttagcatcatgctgcatgtatatccttacttaactatgcagcaacatcctccattacaatgtacattgtcacttatcatgtggcacttaaatccctcacacattacttcatcctatttgctgactctcccttcattgctatcaaccattcataacttaattatcatctcatttacttctctctccttttactgtttactctttcaaatctacatgctttact

SEQ ID NO: 39692 - DNA, 298 bp, Zea mays
  Clone ID: LIB3062-035-Q1-K1-H1
agtaaaggactcgcatcatcccatcaaccctttcatttcacctaatgccatgcgatattatctgagggtttacttcaagagcacaggggatacatacttttcacttctcaagttgtctcttaccaaggctaatctataccttcaagatcttattgctcacaaacatgctattcctttccctagatactgacctgctgttactcataccgttcaagctaataatcaccacttcaatgttcacctcctctagaccgttaaatcatccagttccattctactatagcttaaaaatgctcat

SEQ ID NO: 39693 - DNA, 442 bp, Zea mays
  Clone ID: LIB3062-035-Q1-K1-H10
ggtcgatctcagcgttctccattgctgtcgatgtacggcgattgcagtctgccgctcttggtatgctgagcacggtcgggactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaagtcgtcgacgtcctgtaccccaaagttttcattggtttgattgttggagccatgctttcctactggttctctgccatgaccatgaagaagtgtggaagcgcccgcctgaagatggcggaagaggtccccaagcagttcaacaccat

SEQ ID NO: 39694 - DNA, 263 bp, Zea mays
  Clone ID: LIB3062-035-Q1-K1-H11
agaacgggcgacagagacctagctcgatcaatagctccccatggcgaccgtcaacctgtcgagggtgggggtcgctgtggacgggatccaggagagcatgttcgctctgcatttggcgctctacaacctccttctgcgccccgactgcaaactcttcgtgctgcacgtccagccgctgtccaacattgccacgtgactcaacccggcgcccatacgcttaagcggccctagcggtttggaagtgcccgcattcacgctggcca

SEQ ID NO: 39695 - DNA, 444 bp, Zea mays
  unsure at all n locations
  Clone ID: LIB3062-035-Q1-K1-F9
ctcttcgtcacctcactaacaccagctagcaactctttctctcctgcaataatggccgctcggtgctcgtcctcccagccggagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgtgcgtcgtcggcggcggaccggcaggccacctgcaactgcctcaagagcatgactggccggctcggcggcggcgtcagcatggccaacgccgccaacatccacggcaagtgcggcgtctncagcggcgtgcccatcagccccaccgtcgactgcaccaagatcaactgatcg

SEQ ID NO: 39696 - DNA, 433 bp, Zea mays
  Clone ID: LIB3062-035-Q1-K1-H12
gaaatctaagccagcccaagcgcggaaggtctaaccgattgctgctcccccgccgaggcgtgacaaatctccaccagcagttgtgtagaaatggctgatggtgaggacatccagcctcttgtctgcgacaatggcaccggaatggtcaaggctggttttgctggggacgatgcaccaagggcggttttacctagcattgttggccgtcctcgccacactggtgtcatggtagggatgggacacaacgatgcatatgttggcgatgaggcacagtccaagagaggtattctcacgctcaagtacccgattgagcacggtattgtgagcaactgggatgacatggagaaaatctggcatcatactttctacaacgagcttcgtgttgcaccagaggagcaccctgtgttgctcactgaggctcctttgaacccaa

SEQ ID NO: 39697 - DNA, 283 bp, Zea mays
  Clone ID: LIB3062-035-Q1-K1-H4
cgggtcggcccacgcgtacgctgggagatagagagaggagagggattgttttctcaaagagaaccttaacccaaacggcatgttcgcactgcagagcgaggatgtcaagctcgtcgccgtcaactaccccttcatcaccacggattacatgacctacatgttcaagtacgacaccgtgcactgccaatttaagcacatcgacatcaccctcaaagactccaagacgcttctcttctgctagaatccggtcaccgtctttggcatcatgaacccctaagagatc

SEQ ID NO: 39698 - DNA, 341 bp, Zea mays
  Clone ID: LIB3062-035-Q1-K1-E10
gcgcgacgaagcaaggaacgcaccccgaatcccaactcctgtgtccgccatcgcctcgtggcggtggctccggctcctgctgctgctgctgctcccccagccgctcccgcccggagcacgccgccggcgccgacgccggcgcgtcgcatggatatggcccccgcgtctgtctacttcaatccgcgctcggtcgaggaaatcttcaaggacttctccggccgccgcgcggggctcgtccgcgccctcacctccgatgtggacgatttctgcagcttgtgcgacccagataaggagaatttgtgtctctacggccttcccaacgggagctgggaggtgtcgcc

SEQ ID NO: 39699 - DNA, 331 bp, Zea mays
  Clone ID: LIB3062-035-Q1-K1-E11
aattagtttatacttatatgaacgtttttataaatgaggacgcttaccaaacaaataaatttaattcaatctctcacttctttttctaccaaactattataacacttccttcaaatttttatttctattattcctaccttttgtttcatttattctaccacatcatatcttccctatttaacttttacattactaccttcacaaatcttaataatccaatcaacaaatctctatacttctccactcctattttctctatgatcactcttaaaccattatctcattacccttcatccacccaaattttaaaacccactgttcacataaatat

SEQ ID NO: 39700 - DNA, 283 bp, Zea mays
  Clone ID: LIB3062-035-Q1-K1-E12
gcagctgacgcgtttgcggacgcgtgggcagacgcttgggctggtgtttcagtaatgtcacaattagcaatggctcttaagtttgtgcaatatcacaattttcttaaaaaaaaaaaaaaaaaaaaaaaaaaataaaaaaaaaaaaaaaaacaaaaaaaaaaatttacaaaaaaaaccctataaaaaataaacacataaaacaaaaattattaaaccattttccaaaaaaaaaaaaaaggctgccctttttaaaagacccaagtttaaacaccctttatatcaa

SEQ ID NO: 39701 - DNA, 210 bp, Zea mays
  Clone ID: LIB3062-035-Q1-K1-E2
tttcaccatactacccttcaactactgtttccctccatcaactaccctcctgccgtcggatttctaccatccgtagggctaccctactcactactctcatactcctcctccacatcatcatcttatcatccttccttccttcatttacacatactacattcttttctataccactttcttgcacttcatcctctcattaattaatcctaa

SEQ ID NO: 39702 - DNA, 455 bp, Zea mays
  Clone ID: LIB3062-035-Q1-K1-E3
ggaacctggcaatggcttgacatatggaacgctctgtaccgtgagcggattatcttcattggggacaatatagatggagaagtcagcaaccaagtgttggcaagcatgctctatcttgacagcattgataattccaaaaagataatgctatacattaatggaccaggaggagatcttactccgtgtatggcactatatgataccatgctaagtctaaaaagtcctattggcactcactgcttgggctttgcattcaacctggcaggattcatccttgcagccggtgaaaagggttcacgcactggtatgcctctatgccggatttcactccaatcacctgccggagcagctcgaggacaagctgacgatatagaaaacgaagcaaacgagcttatccgcatcaagaactatctctatggcaagcttcgcgggcacacaggccattctgtcgagaa

SEQ ID NO: 39703 - DNA, 103 bp, Zea mays
  Clone ID: LIB3062-035-Q1-K1-E4
ctaagcttaccactctatacacgatccaactttatttacgcctgcatgctacctcatatctgttctgattctacacttagtttggcttcactctccatcactc

SEQ ID NO: 39704 - DNA, 446 bp, Zea mays
  Clone ID: LIB3062-035-Q1-K1-E5
gcccaaggtgtccacaacgaggaaggcgactcggatcacagcgcctacatgaaacccggctgcttcgacgcgcgcatcactacgttgggctggaaccaggttgacctcctgcgagagcatgtgaaggaatctgggcttgcggataagattgagctggttatttgttctcctttgtcaaggaccatgcatactgcagtgggagtttttggtggctaaagctgcagtaatggtgtgagtgtgcctccactgatggtggagaatgctggacgtacggcagtctcaagtatgaactgaccaccatctctcgctgctgaggcctgcaaggagcgcttgggtgtccatccttgtgacaagaggaggagcatcacacagtaccgtgctctcatacctgccattgatttttcgctgatagagagtgacgaatatgttctatgggtaccagatgt

SEQ ID NO: 39705 - DNA, 420 bp, Zea mays
  unsure at all n locations
  Clone ID: LIB3062-035-Q1-K1-E6
cctcccgttagactaggttaggctaggctagggtgtcgaccagctcgcggtaatggtggccgtcangttccatcagtacgaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactatggcatctggctgcgctaccagagcagaaccggctaccacaacatgtacaaagagtaccgcgacacaaccctgaacggcgctgtagagcagatgtacaatgagatggcttttcgccaccgcgtgaggtccccctgcat

SEQ ID NO: 39706 - DNA, 321 bp, Zea mays
  Clone ID: LIB3062-035-Q1-K1-E9
acgcagccctagtttccagggagcttggttcaagatcatcgtctcagctggtgcaaagccttcatggagtggatcgacacgcacacattttcaggacgctgatgatggaacccctttgcaacatcaaagttcaacagagcaatcaacacagttgtagttgcttcccagcatatcaaccaacaattgaattgaatctgtcaatctgttgtgtaacattagctaatatctgttcgaaacctgttgttaaattgtatcagtagtgtaacagttgctgagatttgttcaaaaactgctattttgcatttgtccgtgaatcacaaa

SEQ ID NO: 39707 - DNA, 303 bp, Zea mays
  Clone ID: LIB3062-035-Q1-K1-F10
gaagaggatcaggttcgttccaagggaaaggagaagagggtcatgagagagagagagagagagagagagagagagagagagagcccttgctcgtgcgttcaccaccacagctccgatcgatccgcaaggcaggcaagatgtacaacgcgccgtcggcccaggagatgtcctacttggagcacgtgcagaggcgccacgaggagaagggctgcctctacgcctgcatcttcactgcgctgtgctgcttctgctgctacgagacctgcgagtgctgcctcgactgcctctgctgctgctgcaact

SEQ ID NO: 39708 - DNA, 441 bp, Zea mays
  Clone ID: LIB3062-035-Q1-K1-F11
actggaggagccgtccttgtcagaaagctcgcaaatttgagccccacggaagtgtttgtcggggacgttgtcttgttaaaagacccagagaaatctggcaattttgttattcgacgactggctgccctggaaggctatgagatggtctctaatgatgagaaggatgagccgtttgtgctcgagaaagaccaatgctgggtcctggcagacaacctagtccttaagccaaaggaagctagagatagccgcttgtttggacctgtcccaatgactgacatccttggcagagtgatatactctttaagaaccgctgttgatcacggtctagtcgagaacagcggcatggccacgaaactggatggtccagtactggcagtggagcttgatgtggaagagttggcgaagaacaataaggcgtagacacttgatgttttcgacatg

SEQ ID NO: 39709 - DNA, 330 bp, Zea mays
  Clone ID: LIB3062-035-Q1-K1-F12
gcgcggggaagttcatcatcccagagatcagcaacttcgctagtatctggttcatctctctcttgagctgggtcttcgccacgggtatcctggagatgaggaggagcggcgtgggcatcgacgagtggtggaggaacgagcagttctgggtcatcggaggcatcttcgaccacctcttcgacgtcttccagggcctactcaaggcgcttgccggcatcgacaccaacttcaccgtcaccttcaaggcctcggatgaagacggccacttcgctgagctgtacatgttcaagtggacgacacttctgatccgcgccaccagcaatctgatca

SEQ ID NO: 39710 - DNA, 425 bp, Zea mays
  Clone ID: LIB3062-035-Q1-K1-F2
caaagtaacttgaaccacatatatatgttcttaaacattaccagaagatcagcgacacaaacagttgcacgcttgcacaccgttacaggtgaacagtcctaataccagtaatcatgatatatatacaggacatggacatgtcgtgcaatgtataattgttacatgcatgtatttttcagttctactacttatcgtcttttttcttctccctttggttcttttttcaacgaacacagtctttgacgcattctttttctttttcttttttttgatattttatcaatgtttaagcaagcagagcagtgtggatactggatatgcaccccatgtctttttttggctcgtcggcaagccagcctgatcaggtcagcgcgttggccaaatggcgcgagaacgggaacagccaaacctgtatgagatgcgtg

SEQ ID NO: 39711 - DNA, 104 bp, Zea mays
  unsure at all n locations
  Clone ID: LIB3062-035-Q1-K1-F4
tccggaatctcccgggntcgagcccagcgcgtgccggcaacaacaattggtgacttcaaaccagtggatgatgtccttctacagtgtacaatgatgctccagaa

SEQ ID NO: 39712 - DNA, 450 bp, Zea mays
  unsure at all n locations
  Clone ID: LIB3062-035-Q1-K1-E1
cttgatttcaccaggctacccgggcaaggacggctacccgccagcggggtacccgccggccggcgcagggctaccctccgcagggctacccgccgcagtacgcgcagccgccgcctccacagcagcagcagagcagcgggccttccttcatggagggatggtacgttcttggctcccccacttttgtgccgcgcagccgctcataagttgttcctagatcggagtgtcttcgaaaatttcctcgctaggttagatggtaggcaccttccttcggctcaccggcggcggcggcgactgccgtgctggtgcggcacgttggcccctgtgggtgggtggggtctggacttgacgcgtgaaccacccttggaaaagggcgccgncgncacgccacgccacgccaccctcgtggccttccgtggcgacgtgtcngttgctacacgcaaaggtagg

SEQ ID NO: 39713 - DNA, 431 bp, Zea mays
  unsure at all n locations
  Clone ID: LIB3062-035-Q1-K1-F6
gaacaccaccgcgaaagcaaaggaataacgagccgaggaaatggccacgcggtcactgagccggcgcacttccgctctcgagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgncgacgcgctcctcgccgacctcgcggacgatgagttcgatctcatctctctaccgggaatgcctggttcttcgacttttggagagtgc

SEQ ID NO: 39714 - DNA, 182 bp, Zea mays
  Clone ID: LIB3062-035-Q1-K1-F8
acgtgtggtctctatccaacttcataacttagcatctgactcctagtctccacataaccggaggggtacacatatatgaggggtaaagctttctcaacgcaagtcatggtggaagacttgctgatgataaccgcaggcacggatgagaccatgatggacgaaatatatatgcgaataggtca

SEQ ID NO: 39715 - DNA, 344 bp, Zea mays
  Clone ID: LIB3062-045-Q1-K1-F5
gcgcgccgccacacctgccgttgctaccgccccgtacctcgcttgctttcccgtcggcgagatgactaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaaacatgattta

SEQ ID NO: 39716 - DNA, 331 bp, Zea mays
  Clone ID: LIB3062-045-Q1-K1-F7
gggcgcgcgtggcgtgcgcctccagcgcgtgcttggccagctgcggggaggacaccgggggcttggtgagcgaccgggtggccgccgcgagctccagccccgccgcgcgcatcaggtgcgcgaggtgccccgcgaaggcccgcgtcgccgcgcgggcttgctcggcgcaggtggtgaagagctccgccgtcggcgcgccgccgttctgcttggagggcgggacgtggtggtggcgcccgttgcggcggctggtggccgccgcgagcttctctttgagcgcgttcacctcggcctgcctggactggagctggcgctggaggtcgtcgagcgc

SEQ ID NO: 39717 - DNA, 347 bp, Zea mays
  Clone ID: LIB3062-045-Q1-K1-F8
gagcactgatgcagagctagcgaactgcgtgcccaaactctcacggccttctccagaatagctcgccatgtaacgctgctgcggcccctgatactgctggcctcgccggcagtcactcgcctagcgtccgccgcctgcgcagacgagaagttcccggcggctcgtgcgtactcgtcatgcgaggacctgccgaagctgctcgcgtcgctgcactggacgtacgacgcgtacaacagctgcctgtccatggcgtgcgcggcggcacccgatattacagctgatcactggcgtatggcctgaacccaactggcgatgtcatacactgtgcgcatgcacttacggcgctt

SEQ ID NO: 39718 - DNA, 320 bp, Zea mays
  Clone ID: LIB3062-045-Q1-K1-F9
cccctctcctgcgacgtcagggttgggtaacgccgctcgccgccgtcgccctacgcaggtgctgaggccttcatcgatctcttagccgtcgacaagcacccaagagatgcaggatagaatgagacggcagggccaatatggtgaagcggatattaactccatggttgctgcccagttgcatcactaccaggcacagcaaagggtacagaaacaccctgagaatagctacactggaagagatcctgcacaagcttctgcggagcatcagtacacttcccctaaggcaagacagagtcaatgggatcgaggtggaccaaatg

SEQ ID NO: 39719 - DNA, 264 bp, Zea mays
  Clone ID: LIB3062-045-Q1-K1-G1
cacggacggcgagggcgtggcagctctaggtaggcgcgacatcgtcctggcatggcgcgggtcgaggacctccgcgaaatggggggaaggacgtcgaggttctgccgacgtgtccctggccggcgctgggcctgtaggaccactccgtcgggcacgggcacccgtgcgcccgcgtgcacagtggcttcctgtccttgtacacggagccacccaagcctgccaaagacaccaactccgacatggcgttctttgtcaacggcagcg

SEQ ID NO: 39720 - DNA, 79 bp, Zea mays
  Clone ID: LIB3062-045-Q1-K1-G10
aattccctagcagaccgactcttcatctccactctaactattgccaacgtttttactcttactctaataactcacacta

SEQ ID NO: 39721 - DNA, 438 bp, Zea mays
  Clone ID: LIB3062-045-Q1-K1-G11
gcgggaaaaagttctaccgtggtaattacctcaaattctacaatgctataagagaggcctagccagacattcagatgatttcaaactgtgatggttcatctagaccacttgaccatcctgcggatttgtatgatttccatgtctatactgattctaagactttgtttaacatgaggagcacatttgacagaacatctcgtagtggacctaaggcttttgtgagcgagtacgctgtctggagaagtgacgcgggtagaggcagtcttcttgcttcgttggctgaagctgctttcctcactggtctggagaagaacagtgatattgttcagatggcaagttacgcaccactcttcgtgaacgacaatgaccaaacgtggaacccggacgctatcgtcttcaactcctggcagcactatggaactcctagctactggatgc

SEQ ID NO: 39722 - DNA, 454 bp, Zea mays
  unsure at all n locations
  Clone ID: LIB3062-045-Q1-K1-G12
tcccgggcaggtgcagagtctttcgtcatctcttctccggcgaagaacccccagtcgcccaccagatcacttgttaaacgtttgttgaggggtgatggcggtttctttcgcaaacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaacttcagatgttgctgaagcacatgccccagctgctgangaggaggacgatgatgatgttgacctttttggtgaggagaccgaagatgagaagaag

SEQ ID NO: 39723 - DNA, 439 bp, Zea mays
  unsure at all n locations
  Clone ID: LIB3062-045-Q1-K1-G2
tcgccactctcccagcctctcttactctccgncgtcgccctgctcgccccgaaccactggccgccaaatgggccccaaaaggaggcggtaggcccccgtcccccgccaagaaaaaggcggtggtganaaacccgctcttcgagaagaggccgaagcagtttgggatcggcggcgcccttccgtccaagaaggacctccaccgcttcgtcaagtggcccaaggtcgtgcgcatccagcgccagcgccgcatcctcaagcagcgccttaaggtgcccccggcgctcaaccagttcacacgtaccctcgacaagaaccttgcaacaaacttgttcaagatgcttcttaagtaccgtcccgaggacaaagctgccaagaaggagaggctcttgaagagggcccaggctgaaaacgaggggaaaacttgtgagtcaaagaaacc

SEQ ID NO: 39724 - DNA, 340 bp, Zea mays
  Clone ID: LIB3062-045-Q1-K1-G3
tcggcctccacgcgcttcgagggcaagccgctcgttcccatccctggcaagcccatgatccagagaacatgggaaagagttatgctagcttctttggtggaccatgttggtgtggcaacgggtgatgagaaaattgcagaatgctgtcgaagatttggagctgatgttataatgacatcagcatcttgcaaaaatggatctgaacgctgctgtgaagcactaaagaagcttgataagcactatgatattggtgtcaatattcaaggagatgagcctctcattgaaccagagattatagatggtgtaagtatgtcactgcagcgagctcctgatgcagtct

SEQ ID NO: 39725 - DNA, 471 bp, Zea mays
  Clone ID: LIB3062-045-Q1-K1-G4
tcggacatggatatatgacaaaattcatcatgagattaaccagttctgcagtgctcacagtttgcagcaagtttacattgacatgtttgatcagattgatgaaacaatgaaagaagctattcaaagagactgtacacgctatgctcctggaattgaaatcatcagtgttcgtgttacaaagccaaatatacctggtagtatcagaagaaactttgaacttatggaggaggagcgtacaaaggcactgatcgccatcgagaagcaaaaggtagcagagaaggaggcagaaacacagaagaagattgcgctatctgaagcagagaagaacgcgcatgtgagcaagatcctgatggagcataagctgatggagaaggacagttccaagagacaggagaagattgataatgaaatgtacctggcacgagagaaagcactagcagatgcaaactactacaggattttgaaggaagc

SEQ ID NO: 39726 - DNA, 391 bp, Zea mays
  Clone ID: LIB3062-045-Q1-K1-G5
accaaaacagaggagcccgtcggccgtcgcaaaaaaacaaaacaagaccaccgcaccatgggatcgctgacgcttcgcgcttcgacggccgcctcgccgctgcagcgacgccggctgctccccggacggcagcgcgcgacgtacgtccgcgccacggcctccgccggcgagccggacctctccgtgcgcgtgaacgggctgcagatgcccaacccgttcgtgatcgggtcggggccaccgggcaccaactacaccgtcatgaagcgcgccttcgacgagggctggggcgccgtcatcgcccaaaactgtgtcaatggatgcttgaaaaggtattccaccgtacttcctggtaatgcaaagcttcgggcagaaccaattggggctgccatgg

SEQ ID NO: 39727 - DNA, 481 bp, Zea mays
  unsure at all n locations
  Clone ID: LIB3062-045-Q1-K1-G6
gaacgaactcttgctccgatcacgagctagctgaggtcgacgatggcggctgtgctgaacggcatgaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgtcaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaatatgcctaccgaacgtacacgtacgcncctggcgctgcacgagtgatg

SEQ ID NO: 39728 - DNA, 252 bp, Zea mays
  unsure at all n locations
  Clone ID: LIB3062-045-Q1-K1-G7
aagatgttaggtgatgaatatggtactgcttcgaacatcaagagtagagttaatcgtcaagctgtgttggctgccatcacctcagctcagcagaggttgaagctctacaacaaagtgcctnctaacggattggttctgtacactggaactattgttactgaagacggaaaggataagaaagttactatngattntgagccattcaagcctatcaatgtatcactctacctttgtgacaacatgtccacactg

SEQ ID NO: 39729 - DNA, 265 bp, Zea mays
  Clone ID: LIB3062-045-Q1-K1-G8
taactctacacaattcctcctaacttatccttctacacactgaactatgctactgatactcaaaccacacaaattactacgattttgaccattcaatcctatcaatgtatcactctaccttaagacaacaagactccacactcagctctaaacacctctcaaatctatcacatgtctaatacattgttatcatcgtaataacctctctttgcacactaaatgacattacccgtgaattcctacacaaatacacttttgacctccc

SEQ ID NO: 39730 - DNA, 440 bp, Zea mays
  Clone ID: LIB3062-045-Q1-K1-G9
gtcggcggtgacgccggcggacgtgcggactctgccggggctcaacacgctgggcgtgtcggtgtcgcgcatcgactacgcgccgtggggcgtgaacccgccgcacgtgcacccgcgcgccaccgaggtcatcttcgtcctccagggctcgctcgacgtcggcttcgtcgatgccaccgccaccgccaccggcggcagccgcctgtacgcgcgcgccgtcggcgccggcgaggtcttcgtcttcccccggtgcctcgtccactaccagaggaacagcggtggcagccccgccgccgtcctctccgccttcgacagccagctgcccggcacgcagcccgtcgccgaagccctcttcggcgcctcgccgacggtgcccaccgacgtgctcgccaggagcttccaggtcgacggaggactcgtggaggccatcaggtccaact

SEQ ID NO: 39731 - DNA, 255 bp, Zea mays
  Clone ID: LIB3062-045-Q1-K1-H1
tcggcttatgaggccttcgtgcggcgtgcttgctccatgggaaagcatcatatcatcagtttgtcagggttgtgaacaatccggagatcatcgatgaagccgatgtacacgtgcatggttaagttcaagattgtcagcctgaaagtcataaggccggtggagtacgtgcctgaactgactgatgagcagaaggaccaggtctcggtcgagcaaatatcgcaggtagtattctcggatgctgatcgcccaagccca

SEQ ID NO: 39732 - DNA, 428 bp, Zea mays
  Clone ID: LIB3062-045-Q1-K1-H11
aaacctggagtgcttggattgattgaaaaggcaacaccatcactcgccgcagcatactccatctctcgggctgttagtattccagtgatgtgctcgtcagggttaagctcggtgactgcaccaatggcagtaactgcaggagctgctggagttggagtcggttctgctattaacaaactcaacgacgttgtggcaatgatcgctgaggtgagaagcattgcgcaagcaatggagcttgcgccaagaatcgtgtccgaaaacttgagaacaattagttactagtggctaggaatacccttgccatttctgagcaaacttgagcagtcaataagaaagcataagagagtcatcgactctcaatttgattctctctacgctgtcttttgcctgtggcaatgaatagcgcattagcatcatagaagtattag

SEQ ID NO: 39733 - DNA, 412 bp, Zea mays
  Clone ID: LIB3062-045-Q1-K1-D7
cgagaaccgcctccccctccgctccttccagctcgctctgtaatctgcatcagccgggccggccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgaaggtattattcagattgaaaatccaaacttggtgaaagccaagaatataaaggccaaggaagttgattttggcaagacaactgaactctcaaagcgtgaaagagaagagcttgagaaacaaaaagctcatgaa

SEQ ID NO: 39734 - DNA, 446 bp, Zea mays
  Clone ID: LIB3062-045-Q1-K1-D8
atcagcatcacgagctctggactatggcaaagagatggagagaaacttggatttttgagaggcttccattacattggatcgttcgcaggctctaatgattccctttgcaagctcgtgcagtctgttgctgatgttctacttgttctcgtctgtttcacatctcgtgacagcttttactgctgtggcctcagcattggcactgttcttttgcctgtctccacacatcacctatctcaaggcacgattcaatctaatggacccattcatgtccagatgttgttcgaagtcatttacacggttgcaaggtttgctgatgctcttctgcatagccacagtcttagcttggttggtttcagggcattggatgctaaataacctactggggatttcatatgtatagcgtttgtcagccatgtgaggctttccaacataaagatctgggcact

SEQ ID NO: 39735 - DNA, 460 bp, Zea mays
  Clone ID: LIB3062-045-Q1-K1-D9
ctacactgtcaaacatgcccatcattctgcactctgcactgattaccaacctctatttcatatcccagcttctgtacaggaagtacagtggaaacttccttgttaaccttcttgggatgtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaaaacgtggattgaagtttctggttcatcagcaaaggatgttgctaagcagctcaaggaacatcaaatggtgatgccaggacatcgtgagtcaaacttgcagaaggaactgaaccgatacattcccactgctgctgcatttggtggagtatgcatcggcgcattgactgtcctggctgatttcatggg

SEQ ID NO: 39736 - DNA, 198 bp, Zea mays
  Clone ID: LIB3062-045-Q1-K1-E10
cacacagccacagcaaatcctaccgtaccgtaaagcacaggacatcaaaccgcgcaggaacgagcactaccaaacgtttcttgtaaccaccatacccaacatcacacaacaacatcaaccctacacacactaacgcacacacacataccatcatatacgagccaacatcacaactgaagctaccacaactgacaccaa

SEQ ID NO: 39737 - DNA, 442 bp, Zea mays
  Clone ID: LIB3062-045-Q1-K1-E12
atgttagttcaaccagatgattctatgtctgtgccatatagatctagtgctgctgattctcaaaaactaagtgttgccatgaagttcaagggtcaactgttccaacttatgcaaagactggaaagtacaacaccacactttattcgttgcattaaaccaaataatttacaacttcctgcaatttatgaacaaggacttgtgcttcaacaacttaaatgctgtggggttctcgaggttgtccggatttcaagatctgggtatccaacaagaatgactcaccagaagtttgctcggcggtatggctttcttcttcttgaggatgttgcatctcaagatccactcagtgtttcagttgcaattcttcatcagttcaacattttacctgagatgtatcaagttggctacacaaagttgttcttccgaactggacagattggcaaac

SEQ ID NO: 39738 - DNA, 384 bp, Zea mays
  unsure at all n locations
  Clone ID: LIB3062-045-Q1-K1-E2
ggctagtttgcgtaaagtacgatgcgcctccccctcgctgccggggccgttgaggcgcaggaagagtggcatccgctcccgctctccacggccgacctttccctcccgctcaccctccccaccggccagaccttcctttggcgccgcacctncctctccccgctccgcttcaccggtgccgtggggtcccacctcgtctccctctcccacctgcccgactccgacgatggccgcctcgcattcctcctccacaacgacggcggttgccccgccttctcgttgcccgccgtccgcgccgcgctcctcgactatctcaacgcggccgtctcgctcgctgacctctggccgcagttcgccgccgcagatgagcgcttcgctgatgtc

SEQ ID NO: 39739 - DNA, 386 bp, Zea mays
  Clone ID: LIB3062-045-Q1-K1-E3
ctacaagagaaggtttttgtcatcgttgttttaggttatatatcctacaatttcgtcattggtgcttattcctactggggcccaaaggcaggtcaagagatctacaatatggggagtgcagatcttatgtttggtggaattactatagtgtgtggaattattggatcactagcaggaggtttcatccttgacaagatagggtctactattcctaatgccttcaagcttctttcgggtgcgacatttgtaggggcaatattctgctttggtgctttttgtttcaagagcctttatgggttcataccctcctttgcagttggggagctttcagtgttcgcaactcaggcacctgtaaattttgtatgccttcacgccgtgaagccaca

SEQ ID NO: 39740 - DNA, 423 bp, Zea mays
  Clone ID: LIB3062-045-Q1-K1-E4
gaattccgggcgacctggcctgcccctgcagcagcagcataaccagaggggagtacatcaagccgtttcgagagacagctttaggctgctggtagctgctagcagtatggcttccgctgcgcgcttcctggtggccgtggtcgtagcgtgcgcactcctggccagcaacaactgccacgcggcgcgccgcttggccgacacggccgcggctcccgctgctgctggtgccgtccctggcctccccgctgtgccgaccttgccaacggtgcagccagtgccacaggtggcgctgccacctatgccggccgtgcccgcggtcaccgtgccgcagatgactgctgccgccatgccagcggctcccaaggtggccgtgccgttgccgtcaatgcccgtcgtcccgtccgtgcttgccaagctgaccct

SEQ ID NO: 39741 - DNA, 413 bp, Zea mays
  Clone ID: LIB3062-045-Q1-K1-E5
gtcatggccaccgtcaagaaggggaagcccgacctcaggaagaaggtgatgcccggcgtcgtcgtccgccagcgcaagccgtggctccgcaaggactgtgtctacatgtacttcgaagataatgctggagtgattgtgaatcccaagggtgagatgaaaggttccgctatcactggacctatcggcaaggagtgtgctgatctttggcctaggattgctagcgcagcaaacgccatcgtttgagagcttgttggaatatgttcagacttctatatgatcatcttattatcagttgctaagagtgctattgggcttaatgggccctttatgtttgttcactcaaatttgtagtaaacagaatttggtataccaaggtgatctatatatcaatgtatgccataaattgtctgact

SEQ ID NO: 39742 - DNA, 267 bp, Zea mays
  Clone ID: LIB3062-045-Q1-K1-E7
cccaccgccgccgctgctgctagggagcttccatccgcgcgcgcctacaacgagagctagcagcagtagcggccgttatcttgtcgctccggctccgttcgtgtacccaagtcccagcctagatgccgcagatggaggggtccactgatcagatcgccgccggctggttcgctaaggagccggctttcgagcggcccgtgggcttgccgaggaccggctcttacagtcgccttaacgcgcatgcgccggagttcgtgccgcgggggc

SEQ ID NO: 39743 - DNA, 468 bp, Zea mays
  Clone ID: LIB3062-045-Q1-K1-E8
cagccagctcgagcagaaggggcggtaccgcaacgtgctggacatgaacgcgcgcctgggggggttcgccgcggcgctggcgctggccggcgacccgctgtgggtcatgaacatggtcccgaccgtggcgaacgcgaccactctcggggccatctacgagcgcggcctcatcggaagctaccaggactggtgcgagggcatgtctacctacccgaggacctacgacctcatccatgcggattcggtgttcaccctgtacaaggacaggtgtgagatggaccgcatcctactggagatggacaggatcctgaggcccaggggcacggtgatcgtcagggaagacgtggacatgctggtgaaggtcaagagcctggcggacgggatgaggtgggagagccagatcgtcgaccactaagactgtccgctcgtcagggagaagatcctcctggtcgtcaagacgtactggac

SEQ ID NO: 39744 - DNA, 433 bp, Zea mays
  unsure at all n locations
  Clone ID: LIB3062-045-Q1-K1-E9
cgctcgtcctcctcctctcctcctggacagcagagcacagcacatcacaccgagaaagaacgggcagccgccaccggagctcagaaccaccatcagcagcagcagcacacccggtcaaccttccacacacgcgcgcacacacacatggcgtcgcagcagaggcaacagcaggcgggagcggcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccgccgcaacgcgccgctgctgggcctgggcggcatgtcggacgccgacctncgcgggatgctcgccgagggcgacttcgacggcgacggcgcgctcagcgaga

SEQ ID NO: 39745 - DNA, 336 bp, Zea mays
  Clone ID: LIB3062-045-Q1-K1-F1
acgagagcattgatatcacaaagatcacaccttctacatgagtcgctctacgtaatgatcgctagtctgcggcatctgatcctaccaagcagtgttgatccattggtcaatctcacgaacgtttagaaggctcctgattctacatatgatatgattggaggccttgaccagcaaattaaagagatcaaataggtcattgagctttctatcaaacatgcggaactatgtgagagcctctgaattgtccaccccaagggtgtgcttctttatggacctacgacacatgatcgacattgatggcacgtctctgtgctcatcagacttactgcaccttca

SEQ ID NO: 39746 - DNA, 398 bp, Zea mays
  Clone ID: LIB3062-045-Q1-K1-F10
gcagtactggaggaaacgatgagcttcggttctgtgggcatggaggaggagggcggcgccggtgcgtcggcggaggagatccggcggctgccggccgaggtgaactgggagatgctggacaagtcgcggttcttcgtcctcggcgcggcgctcttctcgggcgtgtcctcagcgctgtacccggccgtggtggtgaagacgcacctgcaggtggcgccgtcgccgcacgctgccagagctactgccgccgccattctacggcgggactgcctgcgggggttctaccgcgggctcagcgcgtcgctgggcggcacggtgcccgctcgcgcgctgtacatggcggcgctcgaggccaccaagagctccggtcggtcggccgacgttcggctgggcgtgtc

SEQ ID NO: 39747 - DNA, 65 bp, Zea mays
  Clone ID: LIB3062-045-Q1-K1-F11
gacttcttcctcccctcttctacgacaccattatcttttattctctatctacgtctcagtcctac

SEQ ID NO: 39748 - DNA, 441 bp, Zea mays
  Clone ID: LIB3062-045-Q1-K1-F12
cgctgtcgtcctcgctcacctcgtccgtcctcgtgagctccgcctgccttccctctggacggctccagcctccagccatcttgccccacctgtacacagttacaaagcttggcacttcgcagttcgcactcgcatgctcttcgccccctcgcgcttaccgctgccgcgcctcccgactcgccgcctccgcctagctccgggctctccaatggcctccatgctcgccatcctcaggccctcggcgccggccccgctcgcgggacgccgggccagggctgccgcgccggcgaccgcgagggtggcgctatctaccagatctaggtattcgtcagccagggtgtcgctcggctccgaggttgcagtgggcgccgacgcgctcttcgccgactataagcccaccaccgctttcctcttccccggccagtgtgcccaaaccgttgg

SEQ ID NO: 39749 - DNA, 204 bp, Zea mays
  Clone ID: LIB3062-045-Q1-K1-F2
gcactcgttcgcggactcgtgttcgacgacgaccactgggaatccattccggcgcgtgcgcactctctgtcgggggggcgtcttcgccatggtgtgggtggccttcgactaggcctcgatcgagatcgttgcgatcaaatcggcgcgcgcctgtcaatccgtggcgcatctgcagctccaggcccctgtactccggtgcctctc

SEQ ID NO: 39750 - DNA, 452 bp, Zea mays
  unsure at all n locations
  Clone ID: LIB3062-045-Q1-K1-D6
gccatctaaggaggaggtggcctgttcatattgtgaaacatcatgatgcttattttgggggtcttaagctatcttctctggcacatcaatgatttcatgagcttcaaggcccctttattttaaaagttgattctttgcataatcctctctgtgggtgcctacaaagtttaaatgtggacatggctgtcactactcactagtctcattgaagcatcatggtgcaaatcctgcttcaaggtctgctattgatagcttagagatggctgtgatgtcaacgcctcagcattaatttggacttctaggccttccttgcgtatttatgctttatataagcatatggggtatggtcgatcttgtctatngcccttcggagttcctttcaacttcacttgagcctttgatggcacatttggagtcatgtgcctctgctcagaaaatcagtttttaactga

SEQ ID NO: 39751 - DNA, 433 bp, Zea mays
  unsure at all n locations
  Clone ID: LIB3062-045-Q1-K1-C10
agcagccagagagctcatttcccttgcaactcctggacaagttgaccaaagccaactggaccgtgctaaagcctcaggtaaatcagcgatactggcgaatttggaatcacaggcatcactaacagaggacatggggcgccaagttttggcatttggtgaaaggaaacctgctgagcaccttctcaaggctatagatggtgttactatgaaagatataacgtctgttgctgaaaagatcatttcatccccattgacaatggcatctcatggaaacgttctgaatatgcctacttatgagtcggtcagtggcaagttccgctcaaaatgaggagtacatgacccttcccttcattntatcaccttgtttgctggacaagttttaccagtaccttgtcattcacgtctaggccatggttcttggtcagtttcagaa

SEQ ID NO: 39752 - DNA, 436 bp, Zea mays
  Clone ID: LIB3062-045-Q1-K1-C11
cgggcttgggtcggcacggctcaacgaagtcacgacgtggtttagggctaggctggaccattgtttttacactttaggctggcacgacacaacttaaatttttttgagctttcctggcccgaacacgaagcacgatgggctttggccgggcctaatcacgacagcgtctgatggctgcgtcacggtcaccctaccaaacttgttaaactttgtcagtgcagcacggctgcaaactgaccagcgccggcctacgtactacgcacaagttacaagtaccatcatgatgcttgacttaaatcatactgctacatacagtgatatatacaggattgacggactggatggacgctgctggtgcaggactgccacgtgcacgcgatcgcgcgggactacggggcgctgacggcgcataaccggcagagcatgctggaggaca

SEQ ID NO: 39753 - DNA, 232 bp, Zea mays
  Clone ID: LIB3062-045-Q1-K1-C12
gcggtgagctgtgagcaatttgaacggcgatgagcttgaggttcatgatccgtgtgggcgcgcttgtggcgctggagagcacggccaggtaggtcaaggacaatgcgcatgcgctggcgcagtcagcgtccatgacgaggagcggccgcagctggtcaccagacgccgtgacggttgagtcacggtgagcgtgcgccgccgctgcagctgtggcagtcaagatgaaggcgga

SEQ ID NO: 39754 - DNA, 449 bp, Zea mays
  Clone ID: LIB3062-045-Q1-K1-C2
aagaaaatgaacaagaacaagaagcttgttaagaagcttgccaagaagtaccatgctttttgggcatcagagaccatcatcaagcaaattccccgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccagatgagcatcaacttcctcgtgtctcttctgaagaagaactggcagaatgtaagatgtctctacatcaagagcaccatggggaaaccattcaggattttctaagtctggttttttgtgaagtctgctctttatgatatttggtttttgaaccgaggttgtcttgaact

SEQ ID NO: 39755 - DNA, 463 bp, Zea mays
  unsure at all n locations
  Clone ID: LIB3062-045-Q1-K1-C3
aaacatccgatccgaccatggcggcagacgcacttcggggccttctccccggcgtttacgcggtgctgatggtaatcgccgtcacaagcgccgtcttcagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctncacggcgctgactgcgttgcacagctccacagcgctgcggtgaacccgtgccccggtcaagaaccttccagaattgtgccacaatcgtcaaagggcaacttcgtcgtggtccctggaaagacagactacccatcgaaggaatgtgcgtncgcaaccctgtgtgggtcgat

SEQ ID NO: 39756 - DNA, 475 bp, Zea mays
  unsure at all n locations
  Clone ID: LIB3062-045-Q1-K1-C4
ctcgtctctcttcttcgccacgggcctcgtaagaataaccctaagaaccatgcctcagggcggaagcccttccaagccgggccggaatctggccaccccaacaaccgccccgaccggtgctcctaccgncatcccggccattcctgccatgccgaaaccgncggtcgtgcccaccgtgcccgcggccaccctttcaccgatacccgccgtgccgacgtcgacggtgcctgcgctgggcgtgccaccgatccccgcgttacccaagatccccgcgatgccccctatgccggctgtacccgcattgccaaaggtgacggtgacgctgccgncgtcgatgcccgtcgtcgtcatccctaaggttggcgccttgccgccgatgcccgccgtgcctaagctgacactgccgccgatgccctcgatcccgggcgtgcccatgccgtttgtggcgccgncttcttcgcataantcaattcac

SEQ ID NO: 39757 - DNA, 380 bp, Zea mays
  Clone ID: LIB3062-045-Q1-K1-C5
gttgggttggagagttggcaaatacaggatctgaaatgaactgcaagctatcagggcagagggacatgtcccgaatcgagacattgtatcatgctgacaaggagaagactgaagcacttatcctggagctggtcgtgtggcttcatcatcttatcagtaaatcaagacacgccagtggaggtgtaaggtctcccatcaaatctccagtcagctcaccaacacaaaatggcgctgcaatcacactgttgccgggcaaaacgaaaatttcaccaccgattctcacccaagaggatcaggatatgctaatggatgtcaagtacaggaaaattgtccccaggataagcaaaagtcaggagtttgacacaaagtcaagtcacagc

SEQ ID NO: 39758 - DNA, 425 bp, Zea mays
  Clone ID: LIB3062-045-Q1-K1-C7
cttcaaactggatcgcaaattcacattgaaaatccagaatctatagatatctctgatgaggggcatcagaaggcagagcagtcagagattgatgaattgaagcaaagattgtgtgagcttactgaggccaaaactcaactagagacccacaatcagaagctgcaagaggaaagcatgtacgcaaaaggcctggcctcggctgcaggtgtggaactgaaagcactgtctggggaggtcaccaaactcatgaaccacaacgagaggctcgcgaacgatttggctttggcaagaaattcaacacgagtgagaagtggtcatagggttgggaggagggatagctatactaaacggcttgagccagcgagtagaagagatgttcatgctagcagtgaaagggaatcagctctggaggtcatgcttatggg

SEQ ID NO: 39759 - DNA, 481 bp, Zea mays
  Clone ID: LIB3062-045-Q1-K1-C8
gtgggcggactcggaggagccggggcggcggacgcggcgcagcagcagcagctggcagcaggggaggccgcggcggggcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcagcggcggcggagctgctgtacctcgcctacaacggtgacaaggaggtgacgtggagtgaagcttgcggcgttttcggcagcttctgccgtcaggcgcgcacctccgtcgccatcacct

SEQ ID NO: 39760 - DNA, 403 bp, Zea mays
  Clone ID: LIB3062-045-Q1-K1-C9
atcatatctccacacaactaagaagccagctgcagttaaagggagtgaatcaaaaaggtgggatcatcaacgggatcagagatgatcaaggaaatcgatgtccagcttagtccagaggagaaagaaagtttagatgagatcatcaaggaagctgagagcgacttggagtctgaggaagtcctggatcaatcccttgccattgttgccaagaatgaaggtttggacaaggtctcaactacaaaactcacaatttacactgtaggtggtgtttcgaagaatctgacagagggccccttgagtgttatggataagcacatatatgcatgacacactgtcaaaccatataccagcctgattgaagctggaaagactggttgtctcatcatctcagatatatttgcta

SEQ ID NO: 39761 - DNA, 207 bp, Zea mays
  Clone ID: LIB3062-045-Q1-K1-D1
ccgttcgaccgactcgtactcttcaatcctcgttaaacactcttccactctaaccttaatgctgctcctcttcatctacgcggactgagtcatttccatcttactttagctaccatccatcctcgaacttatgaaaatcaataacccattcattatcctcagctacagctacatactcctgcacctctataccatccctactgacct

SEQ ID NO: 39762 - DNA, 437 bp, Zea mays
  Clone ID: LIB3062-045-Q1-K1-D10
atcatcagatagatcactggccccgtgctgattaccgcgcttcccatctgagcaggcggcgggccaggctacagggagagacgcataggagacagctgctgcctggctgagacgatggccggaggcggcgaccactcccagacgaacggaggccacgtcgaccagagggccttggacgagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtgggggctagcggtgatggtgatggtgtacgccgtgggccacatcttcggcgcgcactttaacccggcggtgaccct

SEQ ID NO: 39763 - DNA, 368 bp, Zea mays
  unsure at all n locations
  Clone ID: LIB3062-045-Q1-K1-D11
cggacgcgtgggtcctcatcaaccagcagcacctccatcgaatcttgtaggcaaagccaaatgatcaatcaccagcgacatcaattcctcgcccgtccgcgcgtcgaggaaccgtcgcacagttccagttccatgggcaaggtgcgctccttcttctgccgcgcccgcagcggcaagcgcggcggctcccggccaggctcgtcgtcctcgtctctctcgtcccagtgcccgtccgcgaggatggcgtcgccgtcggccgggacgagacggagcgcgtcttccgcaagttcgacgcgaacggcgacggccagatctcgcggtccgagctggcngcgctgttcgagagcgtgggccacgcggccaccgac

SEQ ID NO: 39764 - DNA, 443 bp, Zea mays
  Clone ID: LIB3062-045-Q1-K1-D12
caggctacatagagggagcggcggccgaaagtggtggaggcagagtggtcggcggtggcgggggccctgcagccagagtgacaagcgacactgtgacgaccgaacaaaggcgcgggcgggccgggggcaccggcgtgggcgtggggtcgccggacgaggcggaggcggcatcggtgtggtcaccagacagatggaggcgcacgagggggagaaatgaaacagaggtggttagaaaggaaagtcgagatatgggtaaagtcgtttttttggacgtacgtgttattttcgacgggctaaaaatagctacggccgacgaaaatgctattgttctattgtgtagcgtaactgtcgcactgatggagctcccatgcaaccatgatcggtgcaagcgtacttgtgacatgcacggtagtagtagcaagcaccagctagaatgatgatga

SEQ ID NO: 39765 - DNA, 461 bp, Zea mays
  unsure at all n locations
  Clone ID: LIB3062-045-Q1-K1-D3
acggctacgaaaatagtagcgctgcgcggccggttcgagatactgtccatgtccggngctggcctgccggcgccggcgccgtcgggggccacggtgctcaccgtgtacctggcgggggggcaggggcaggtggtgggcgggagcgtcatgggggagctcatcgcgtcgggccccgtcatggtgatcgccgccacgttcggcaacgccacctacgagaggctgccgctggaccaggcagacgccgaggagggcgccgtgctgtccggctcgtccgagggcgccaccgcgcagcagctggagcagcagcagagcagcgggggtcccgtcgtgccgtcgtccatgtacgccgtcccgcagacgccgtcgtacccgcacgacatggtcgggcagtgggggcacgcggctgtgacgcgcccaccgtcgacgtccgtctagctagcgctagatgcacatgcaccagc

SEQ ID NO: 39766 - DNA, 287 bp, Zea mays
  Clone ID: LIB3062-045-Q1-K1-C1
caattcccgtttcgaccgactcgtactttcaattctcaccatccatatccctttatatcgcatcatccatctaatacaatatcaaacgtgcagtgcactattgaagctgtgttaataatacactcttctcacatcctaaacctcacccctaaccatttctcattaccaatcactactaaatatcactatctgataaagacttataatcacattattatacaaacatttcattcttctcttcttaacatgcatgcatacatgccactactctatactaccatttatat

SEQ ID NO: 39767 - DNA, 444 bp, Zea mays
  unsure at all n locations
  Clone ID: LIB3062-036-Q1-K1-E5
ttgcactgctcataattaggttctaaggaacaagcctgattttcgtaagaggccttggtcaagcatcagcccaggtgcgaaagattttgttagaaggttactagtgaagaatccaagggccaggctaacagctgctcagctcttcacatcggggtagagaagaggagaagcatncgatttcccggtcgacatatctgtgtaatcaaacatgcgtaagtttgtcaagtacagccgtttcaagcaattcgcgcttcgggctctggcgagcacccttaacgaggaagagctatcagatctgaaggatcagtttgatgcaatggatatcgataaaagtggatcgattagtatcgaggaaatgcgtcatgcccttgcaaaggatcttccttggaaattgaagggtccccgtgcgctggagattattcacgcaattgacagccacactga

SEQ ID NO: 39768 - DNA, 242 bp, Zea mays
  Clone ID: LIB3062-036-Q1-K1-E6
tcataattaccttctaactaacaatcctaatattcgctttacgccttcgtcaatcatcaacccaggtgcgtaaaaatttaacagtaaggttgctaaataacaatccaactaccatcctaacagctattaaaactctctcacatccctatcaaatacatacaggataaacatcctatatctccttccacatatttctcttatcaaacattcatcactacttcaaatacatccttataaatcaa

SEQ ID NO: 39769 - DNA, 455 bp, Zea mays
  Clone ID: LIB3062-036-Q1-K1-E8
ggcaggcaggtcggcgaggagggcaggaagaccgaagaccgagccgtgcgggggctcgggacgggaacgggacaggaccgcaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatacagtacttggagaga

SEQ ID NO: 39770 - DNA, 323 bp, Zea mays
  Clone ID: LIB3062-036-Q1-K1-F10
aaaacggatccgtaacttcgggaaaaggattggctctgagggttgggctcgggggtggcgggcgcgaacccgtcggctgctggcggaatgctcgagctgctcgcgcggcgagagcgggccgccgcgtggcggccgggggacggaccgggaacggccccctcgggggccttccccgggcgtcgaacaaccgactcagaactagtacggacaagaggaaccccacctggatgtattatgaggaaaaagtgactgtgcacatgaggagtctgagaattactcgctcccgtcccaaactaactgtatttctacgatttgaaatatat

SEQ ID NO: 39771 - DNA, 444 bp, Zea mays
  Clone ID: LIB3062-036-Q1-K1-F12
ggttcctctgcgatgctgcggccggagcctcctcaggtcccgctggagaagccaagccccagggatttgcagagagatacccagctcttgtcacaggtttcttcttcttcttgtggtattttctgaatgtaatatttaacatcctcaacaagaagatcttcgactacttcccctatccatattttgtgtcagtgagccatctttttattggagtactatactgccttattggctggagcttcggcatcccaaagcgcgcgccaatcaactcaacacttctgaagcagcttgttccagttgcggtttgccatgccattggccatgtaacaagcactgtgtcatttgctgctgtagctgtgtcatttgcccacactattaaagctctcgagccattcttcaatgcggctgcttcccaatttatccttggacaaccagttccattga

SEQ ID NO: 39772 - DNA, 460 bp, Zea mays
  Clone ID: LIB3062-036-Q1-K1-F2
gtcttcctcccgtggcctgtctgtcatctggctctgaaacgatggcagtcctgcaagttgctgctggtgcccctccccctgtctgtgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatccttgaacttgctgaagagctcctgttgccactcgctgcagttaaatactcccgtggaacgttcatattccctgaagcacagccttccccacacaagaactt

SEQ ID NO: 39773 - DNA, 455 bp, Zea mays
  unsure at all n locations
  Clone ID: LIB3062-036-Q1-K1-F3
agaccattcatgttcctactggggagaagctttctgtttttgatgcggccatgagatacaaagctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgcatcgttcgctttgacactgangtggagctggcgtacttcaaccatggaggcatnctnccttatgtcatccgcaacttggca

SEQ ID NO: 39774 - DNA, 329 bp, Zea mays
  Clone ID: LIB3062-036-Q1-K1-F4
catcccatggctgtactacatagagcagggctccactcgcatggacgcctagcacatacctgcaactgcaatgcagtggctgctatctatctatcgttcgcttcgctaccattccagtgctgcacttcaccgatggatgaagcatcgagcatgatatcatatacgacgcactcggtcgatttacatgcattcaccaattcatactataccattctgaaggtacgtttgaacttacttcacatgtattgcactatagctagctgcttaactaccggataaagaaccgaaacgtacacgatttctaccataatacaagtactactccattc

SEQ ID NO: 39775 - DNA, 425 bp, Zea mays
  Clone ID: LIB3062-036-Q1-K1-F5
cccggccatgtaccgcgaggtgctcggcggggacgccgcctacgccgcggcgcgcggctcggggggaggctccgtcgacatcctgcactgcatcgaggactgggcgcccgacaagcagcgccacgcgtacgaggtcatggcgcgcttcgagcgggagggcctcgaccgcctccagatcatgcccggggcctcggagctgtgtggcttcctggacgcgaagcagatcagaagaggtttgatcacccgtaatgtgaaggacgcagttgatttgttccaccaaagatttggtatgacgttcactcctgcactgagcagagaatttcgcccctataaaccaaatcctgctccactgcttcacatatgctccgctcggaacattccaccacacgaagtgatcatggttggcgacagtctcaaggatgatg

SEQ ID NO: 39776 - DNA, 457 bp, Zea mays
  Clone ID: LIB3062-036-Q1-K1-F6
gcgcgccgtccgccgcgtgcgccgccccgcgcgcagcccctggctggactgcatcgacgcaggacccggcgcgcatggacgcctagcacgtacctgcaactgcaatgcagtggctgctatctatctatcgttcgcttcgctaccagtgcagtgctgcacttcaccgatggatgatggatcgggtatgatatggtataggacgcggtcggtcgatttgcatgcatgcaccaagtgttactataccgttctgaaggtacgtttgaactttgttcgtttgtattgcactattgcttgttgtttaagtagcggttaagggagggagacgtaccgctgtgctaccataatggaagtactactccggtccggtcctgtgtgagccttatgtacgtgcaattttaatgtgttttgatattacaagacttgacggttggcaatgttgctgttgtgtttcgattga

SEQ ID NO: 39777 - DNA, 409 bp, Zea mays
  unsure at all n locations
  Clone ID: LIB3062-036-Q1-K1-F7
cggacgcgtgggcggacgcgtgggcttcgctaccagccagacgggcagctcacgtgtgcaggcggcggccaagatgatggcggaggcgtggacgccggtgccgttcccgccgacggcgccctgcttctggctgcacgacacgcactcggttttctggcggggaggagacgcgtggacggcggcggaaaacaaactgttcgagaaggcgctggcgcagatcgaccgtaacgcgcccgacaggtgggagaaggtggcggaggtggtgcgcacgaagacggtcgacgacgtgaggaaccactaccacgacctggagaacgacgtcngcttcatcgaggccgggctcgtgccgttcccgcactacagcggctcggtttcgtcggtcgggttcacccaccacgaggattgggac

SEQ ID NO: 39778 - DNA, 339 bp, Zea mays
  Clone ID: LIB3062-036-Q1-K1-F8
ccattttcccactcctcctcttcgctttcatccactatctcaactcactcatgcatgtttcatctaacatggtcgcctagcacttaactcccacttcattccactctactatatccatctattgactacttcactcacacttcaatttttcacttcaaccatacattatcactcttccataatactctatattacacaacccgctgatcttcatacattcattcacaactactatacctttcacaacttccatttcaactaatcccatcactataacactattgactaataccttaaatacccctttaatcatacataccttcctctatattactataa

SEQ ID NO: 39779 - DNA, 236 bp, Zea mays
  Clone ID: LIB3062-036-Q1-K1-F9
gcttacgtacactagtaccacacactacgccagaatgggataggtcgaggttccgagggatagagacagagacgaggacagggagggccaggccacggactcctcactccgctcttctccgctgatctgcctgaacgacgcaactgcagctgcacatgcactactcgccattccaaccacctattcactgcgcatatatctcagcacccacaacattgaagcactccctacacgtc

SEQ ID NO: 39780 - DNA, 440 bp, Zea mays
  Clone ID: LIB3062-036-Q1-K1-G10
ggccagcggcggcggccaaggcgcgatgggagcggctcccctggcggcgtggtgggcgcagggccggcggctgtgggtgctgccccggcgtcccatggcgcgctaccctgagccccgtccccggtggcggcgccccctagccgcggccctggcggcacgggcatggcggctccggcccagtgccggcgcatggcgcagccgctgcccttgcagcgcgggcggccaggccctcggtggcgcgcgggcagcctgggcgctgccggccctagccacggcccggcggcccggccccggtggctccccgtggagcggcggctatggccccgtccctggctcgccagcgggcggccccggcgcggtacaagcgcgcggcccggccacggctcggcgcgacacgggcgctctatggccgtgcggcctatgccaagcacgcgggcgcg

SEQ ID NO: 39781 - DNA, 439 bp, Zea mays
  Clone ID: LIB3062-036-Q1-K1-G11
agattacacatactttgctaaggtgtgctttgataacttcggcgacaaggtgaagaattgggggacctttaatgagccccagacatttacttccttttcctacggaactggggtctttgccccaggtcggtgctcacctggactagactgtgcctacccaactgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttc

SEQ ID NO: 39782 - DNA, 463 bp, Zea mays
  Clone ID: LIB3062-036-Q1-K1-E4
gcgacactaacgaacgaactcttgctccgatcacgagctagctgaggtcgacgatggcggctgtggtgagcagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtaca

SEQ ID NO: 39783 - DNA, 428 bp, Zea mays
  unsure at all n locations
  Clone ID: LIB3062-036-Q1-K1-D10
atcgacatggctgccgccaccatggctatcacctcccgcgcgctcgtcggcaagccggcggcgggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggngctgtcggcggacccggagaccttcgccaagaaccgcgacctggaggtgatccactgccgctgggccatgctcggcgcgctcgggtgcgtgttcccgaactgctcgcccgcacggcgtcaggtcggcgaaggcgggtgggtcaaggcgggcctccagatcttcagcgagggccggct

SEQ ID NO: 39784 - DNA, 436 bp, Zea mays
  Clone ID: LIB3062-036-Q1-K1-D11
caaaagacaaaattccccagtttctcttccgatggaaacttttaaatgccatctccgaagagagcctattggggtagttgggctgataactccttggaactatcctctcctgatggctacatggaaggtagctcctgctctggctgctggttgtgcatctgtgctaaagccatctgaattggcttctgtgacttgcttagagcttgctgatatctgtaaagaagtcggtcttccttccggtgtcttaaacattgtgacaggattaagtcctgatgctggtgctcctttgtcagcacacccaaatgttgacagggcgcttttaactgggaggtttgaacttgtaggaagattatgcggctgcagctcctatggttaagcctgttacactggaacttggtggaaaaagtcctatagtagtatttgatgatgttgacat

SEQ ID NO: 39785 - DNA, 56 bp, Zea mays
  Clone ID: LIB3062-036-Q1-K1-D12
ataaagacaacttacactaccatctctataaattaaaaatctcataatctatatcc

SEQ ID NO: 39786 - DNA, 444 bp, Zea mays
  Clone ID: LIB3062-036-Q1-K1-D2
ctgacctccaatccacgataaggcaagataagctagctaggaaggcaagggatccgatggacgagtaggagcccgttcgcgagagcggggcgggcaacttcggggtggccaagctgatgaggaacaaggacacgagggagctggtggccatgaagttcatagagcgaggaaacaggatcgacgagaacgtgttccgcgagatcgtgaaccaccgctccctccggcaccccaacatcatccggttcaaggaggtggtgctgactcccacgcacctcgcgatcgtgatggagtacgctgcgggcggggagctgttcgagcgcatctgcgacgccgggcggttccacgaggacgaggcgcgctacttcttccagcagctggtttgcggcgtcagcttctgccacgccatgaacatctgccaccgggacctcaaactggagaacacgc

SEQ ID NO: 39787 - DNA, 460 bp, Zea mays
  unsure at all n locations
  Clone ID: LIB3062-036-Q1-K1-D4
ggtgggctggcttctcctccccctcttaccaagtcctcttcgggttagggttacttagggttgtgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcngtggcggctacggcggtcggcgcgagggtggtggcc

SEQ ID NO: 39788 - DNA, 415 bp, Zea mays
  Clone ID: LIB3062-036-Q1-K1-D5
ggcaaggatttggaaggatgtaatataaaattctgtgcaaggacaactttgagtgacagggcggtaacaaatgccatagagatacacagatcgacaagtggaagcttgcgcattacggtatctaataacgattgcggtgttcgtgaatacgatatggagagatttcagctcttgaaccactaccgatataactggccagttaatcacacatctgtgagcccggataagaaacttttggctgtggttggagatgatcgggatgctcttcttgtggattcacggaatggaaaggtaacctctaccctagttggccatctggactactcatttgctacggcatggcacccggatagccggacctttgcgaccgggaaccaggacaaaacctgccgtatctgggacacccgcaacttgt

SEQ ID NO: 39789 - DNA, 471 bp, Zea mays
  Clone ID: LIB3062-036-Q1-K1-D6
cccggggattctgttgatcatccttgtggcactgctcacagaggcatccatcgacatgcttgtaaggtgcagccaccagggcaagattacatcatatgggtggttgatgggcgaggttttcgggcagtgggggagaattgcgctgcaggcctccgtcatcataaacaatgtcggcgtgctaattgtttacatgattatcattggtgatgtattatctggaacaacatcaggcgatgttcatcatcgtggtatattggagggctggtttggagctcatttgtggaattctcgtgccattgttcttcttgccacagctcttttggtgtttgctccgttggtgagctttaagcgcttggattcattaagatacacatctgcgctatcagttgccctggcagtagtttttgtcgtaattactgctgggattgccatcatcaaactcttcaatggaactgtagcgatgcccaaact

SEQ ID NO: 39790 - DNA, 452 bp, Zea mays
  Clone ID: LIB3062-036-Q1-K1-D7
gataaactatgtcgaaggtgacatgttcagtttcattccacctgctcaaactgtcgtgctaaagcttgtgctgcaccacctgaccgatgaggagtgcgtcaagctcctggctcaatgccggaaggcgattcctccacggaaggacggcgggaaagttataatcggtgatattatgattgaccactctgggcttatgctggaaactcacctcctgatggacatcggcatgatgaccatgacaaaaggacggcagagagatgaaaaagaatggagcgagctcttcaccaaagcagggttcagcgaatacaagatcctgaaggaatttggagctcgtgttgccttcgaagtctatccgtgagatatatatatatatttacatacatatatgtatgtgtgtgggtgccttgcgtggcttggcgtgatgatgtcataaataaagagggtgggtgtgc

SEQ ID NO: 39791 - DNA, 443 bp, Zea mays
  Clone ID: LIB3062-036-Q1-K1-D9
gcagcgccgccagacactccgtagtctgtaccccaagcaccggcgcggcggcggcgggtgccggggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcaaggtgacgaggatcaggcttacaggaaaatcaggctccgtgctgaagatgtgcaaggcatgaatgtgctcacaaacttctggggcatgaattttaccaccgataagctcagatctctagtaaagaagtggcagacattgattgaagcccatgttgatgtc

SEQ ID NO: 39792 - DNA, 206 bp, Zea mays
  Clone ID: LIB3062-036-Q1-K1-E1
cacagacacacagacaagtggtgtccaaagccaagtgtgtgtactagcatccagctagctcgggcggcagcaggcagccatcatgtctaaggagaagcacggccacttcttcaaccaccacaagaaggacgaggagcagcccgccggcgagtacgggtactccgagaccaaggggtgaaccgcacccgccaaggccaattccaaaa

SEQ ID NO: 39793 - DNA, 443 bp, Zea mays
  Clone ID: LIB3062-036-Q1-K1-E11
ctcaactttcccagattgagactgaaaagctgctagcccagttagttgagactgagatgaacggacgtttgaaggagggcacttacaaaggaaagaagtttaatgcaatctgtcacttctttggctaccaagctaggggagcactgccttcaaagtttgattgcgattatgcctacgttttggggcatgtgtgctaccacatcatagctgccggattgaacggttacatggctacggtgacaaatcttaagaatccagtgaacaagtggcgatgcggcgcgactcctatttcgtctatgatgactgtgaagcgatggtcgcgtggcccttcagccacccaaattggaaagcccgctgttcacatggctagcgttgacttgaaaggaaaagcatacgatgtgttgagacagaattcttccagctttttgttggaagatgtctac

SEQ ID NO: 39794 - DNA, 458 bp, Zea mays
  Clone ID: LIB3062-036-Q1-K1-E12
ctagctaggcacatatatattcagaaaagctcgtccatttgcctcattgctattttgtcaatgactacaagcagaaaggtcgagactgtctgactccagtatgtccacacaaaagatctgattatggattacctgaggataaatttatttttgcttgcttcaatcagctttacaaaatggaccctgagatatttgacacatggtgcaatattctcaaacgtgttcccaacagcgcattatggcttttaagattcccggcagctggtgaaactagagtgagagcatatgctgctgccagaggagtaagatcagatcaaattgtattcacagacgttgccatgaaaaaatgagcatatacgacgcaatgcccttgcaaaacttttcctggacaactccctcttgaatgcacacacaacaagcactgacatactgggggctggtcttgcaatgatcaccct

SEQ ID NO: 39795 - DNA, 464 bp, Zea mays
  Clone ID: LIB3062-036-Q1-K1-E2
ctaagagcgcaagcaagcccggagcaggtcgaaacgtacctgaaccaatagagatcgaagaggcgagacatgctgcagaggttgttggaccagtgccgcgagattcaggttaccgttgacgtctacctcatcgaaagtgatcagattgctaacgctatcatcgagcttgttcctgttcttcgcataagtcaactggtactaggcgtctcaaagtcaaatgtgcggaagctgaagaaaggaaccacgatagcaggacaggtacacaagggcgcacctctctactgcgaagtcaagatcgtctgcgacggcaaagaggtgacgactgttgacccaacgccaccgctgtcaccttcccctgttaacaacaacagcagcagcagcagatccaacaacccgacaccaccgtcgtctacgccgaatcatgatacaacagctgcaaacggtgacaggaaagacagagaaag

SEQ ID NO: 39796 - DNA, 434 bp, Zea mays
  Clone ID: LIB3062-036-Q1-K1-E3
taatgactttgatgtcctagtacttaacacaggccatcactggaacagagggaaattcaatggggatgactgggaattgcatgctgatgggaagcctgtaggcaatggtagtagacttgcagacctaaaccgtgcaaaaaatcttacattgcatagcattgctagatggatggattcagaactcgcacggcatcctaagatgaaagttttcctcaggacaatttcaccaaggcactttgtaaatggtgactggaacacaggtggaacatgtggaaataccgtcccctttactaatggaagtgaagtcttgcaagatcattcaattgatatacccgcagaaaatgctgtgaaaggaactcgggttaagcttttggatatcactgctatctcaaaactacgggatgaggggcatatctcaaactctagtttcaaaa

SEQ ID NO: 39797 - DNA, 416 bp, Zea mays
  Clone ID: LIB3062-036-Q1-K1-D1
gattaagctggtcaccaagcagtttgtgcctttggggggaacattcatttttaatggaatcgagctcgaatctcaagttttggtgctataacatggatgtggagcgttggatttgagttggtccagattttgtgccagggcaccgcgctgcccaacgagtacccaagtctcgcagaaaatatcaatacttgcttcgtatgattttttgccaaatgactagcaaattcctagctaacgcggctgttatgcgtaaaaccagaagagctgctgcttttagattacgtctgttatatattaataggcgagaagtaatatgtcagtgggggcgtggggctgatgtggtaagatggatggtgttaaagactagcatgtgcccgatttgacgaaaacgactacaaaagcgggatgagcattga

SEQ ID NO: 39798 - DNA, 397 bp, Zea mays
  Clone ID: LIB3062-036-Q1-K1-B11
gatccatctgcacacaactgacatgagctgcacctgctcatgggcctgccgtacagggataaggtctcatctatgaataggagggttatatatgggatataccatctgactaatatggttatggttcgcttcatctggttagtgaacctacacgtccccaaccttcggtccttcgaccaatgcccatggcttgaaatcggaaaggcgcacatatattgcacacctttagctgagagaagctttaatgcgcactgtaacgattaactaacactctttattggagactgtgcccatcctatgacactgttagaatatctcacggacactcatgttgaatatgcattgagcatcgctgcactggtcatacgtatggtcatctagattgggaacattaagc

SEQ ID NO: 39799 - DNA, 441 bp, Zea mays
  Clone ID: LIB3062-036-Q1-K1-B12
ctcaggtcggaaagtttctgtgccgagcgagaacgagaagacaagaggaagccaaaaggagaggcgagttcgggagggagcggatggcaatggctctgcttccgctattgctctcggccctcatcgtctcctgcgtcgcgcagtcgccggcctcgtcgccgtccgcgtcgaatgctcctccggtcaccgcctcggctccgcggagctctgtcgcgccaccgacaacggcggtctcggcgccgcagggctctgtcgcagcaccgacgacaactgcggcctcggcgccgcaggcttctgtagcgccaccgatgacaacggcggcctcggcgccgaaggcctctgtcgcggcaccgacaacggcaacctcggcgccgctggcctctgcagcgccaccgacgacaacggcggcctcggcgccaacggtctctgtcgctgcaccgc

SEQ ID NO: 39800 - DNA, 248 bp, Zea mays
  Clone ID: LIB3062-036-Q1-K1-B2
ttaactcacttcaattacctacctcactgcttacattctacaaaatattctctaattaaatgtttcgatcatattgcaaatgtgctacgctaaacttctatctcattatcatttcaacctatctacacacattattcaatatttttatttctctttattatattttaaaatttatattttttatatacacatatattcatctccttattatttactctatcttctctatttttctatcattatatttt

SEQ ID NO: 39801 - DNA, 450 bp, Zea mays
  Clone ID: LIB3062-036-Q1-K1-B3
gcggcgccggcgtgcttgtgatctcaacccaagtcgtgcctccgctccggtcacccgtcgctgcacggaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaagcttcgtgccaccggaggcaacaagaccaagaccccaggacctggtgcccagtctggcctcatggcgcttgctcgttcccggatgaaaatcgga

SEQ ID NO: 39802 - DNA, 409 bp, Zea mays
  Clone ID: LIB3062-036-Q1-K1-B7
cattatctgtgtcccctagagtgatgcacgggcattgcgtgttgtgctgagtctgactggagtgaaggagggtctaagaggccatgttgttgtagagatgagtgatcttgataatgaacctttagtgaaactggttggtggtgaactaattgaaacagttgttgcccatgacgtgattggacgtctgaatatacaaatgtccctccaaccttgccttgccccaattttggaaggccatattgggaatttgaaaatccaaagtttatttttaaccattgcccaaaattgaatgcctgcggtttggggatgtgttgatctcatttcctgatgccgtaccttgtggagtcaaggttgcttcaaaatctggaaagatcttgatgaatcctgatgattgttatgttttaagaga

SEQ ID NO: 39803 - DNA, 337 bp, Zea mays
  Clone ID: LIB3062-036-Q1-K1-B8
cagtactatatatctatccccagttccatagttcttccagctctacacatacacatacgcgcggcacgctagctctagctctcacatcgattgagatcatcagagaggtggaagaagaaggagctaagataccagatcgaggaagagaggcggtgcggtcggtagatgatggagagggtcgaggacttagggctcaagcctaacctcagctcgtccctcgcgtctcctcgaactcaccatgtcgacaccatgctgctacgcgctccaaaaaagaagttcctggagatgccactggtgctgcccgcgaaaccgaacgaagtcaccggccaagaaggcc

SEQ ID NO: 39804 - DNA, 370 bp, Zea mays
  Clone ID: LIB3062-036-Q1-K1-C1
cggacgcgtggggctagcacaagcatagtgcatgggcttggcacctaagtaaggcctgagaggcatggcatccaaggccggcctgttcttggctctcaacctcctgttcttcacggtggccaacgcctgcggcagctgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccgtgctgtaccctcatcaaaggccttgcggacttcaaggccgccgtctgcctttgcacggccatcaaggcc

SEQ ID NO: 39805 - DNA, 461 bp, Zea mays
  unsure at all n locations
  Clone ID: LIB3062-036-Q1-K1-C11
ctcgccgacctcgtctggctctcaggggctcacacgatcggcatctcccaatgcaactccttcagcgagcgcctgtacagcttcacggggcgcggcgggcccgacgacgcggacccgtcgctggacccgctgtacgccgcgaagttgcggctcaagtgcaagacgctgacggacaacacgacgatcgtggagatggaccccggcagcttccgcaccttcgacctgagctactaccgcggcgtgctcaagcggcggggcctgttccagtccgacgccgcgctcatcaccgacgccgcctccaaggccgacatcctcagcgtgatcaacgcgccgnccgaggtgttcttccaggtcttcgccggcctcaatgtcaagatgggcgccatcgaggtcaagaccggctccgagggcgagatcaggaagcactgcgccctcgtcaacaagcactaggcggcggaatt

SEQ ID NO: 39806 - DNA, 428 bp, Zea mays
  Clone ID: LIB3062-036-Q1-K1-C12
ccaacgccgcctcctacgggttcacggtgaccaacgccgggtgctgcggggtgggcaggagcaacgggcaggtgacgtgcctgccgtaccaggcgccgtgcgccaacagggaccagcacatcttctgggacgccttccacccgtcggaggcggccaacatcatcgtcggccgccggtcctaccgcgccgagtcgcccaacgacgtctacccgatggacatcagcacgctcgtcttcatctgattctgattctcatccttccattaatataaacataaaaatatatgatataatccacccaacaattcgcaaaggctggcatattaaacaaggctccaagaagaagtagccgtgccattctttactggggaccagctcgggccttatctggaatttttcatgctttcatacatttgcatcgggtactta

SEQ ID NO: 39807 - DNA, 462 bp, Zea mays
  Clone ID: LIB3062-036-Q1-K1-C2
gcgaaagcttctgaggatcagaagctttctgattcacctccaagcttagatgactacccagagaggatgcgaccttctcccaagaaaccaaggatagatgcattatcaccagattcagagcgcgatacaacacaacctgaattcgaatcccatttgatcggtccgtgggatcacggcattgcattcccagtggaggagttcaaagcagaccctgctatgagcaagtcataaggcaaacttcaccttgacagaaaattttcagagttgacctctccacgagatgatcattctcatgtgaatatatattatcttaacaacagaatgttgtacgggtttttgaccctgcacctgatcccttcagccacgtccagttattcttatcactgtagtatccatcaacaagtcctgtaattatgaggatggtgttacagagtttctagcaagcattttcatcgagggaat

SEQ ID NO: 39808 - DNA, 454 bp, Zea mays
  Clone ID: LIB3062-036-Q1-K1-C4
gtactatgactttggacccaaggttgtgccacctcttgtttgtatcccaggaattgcaggaacggctgatgtatactataaacagattatgtccctttgtatgaagggttatcgagtaatatctattgacgttcctcaagtttggaatcaccatgaatggattcattcatttgaaaaatttttggactccatgaatatccatcatgttcacatttatggtacatctcttggtggattcctggcacaaatatttgctgaacaccgtccaaggagagtaaagtcattggtcctatcaaatacttttcttgagacgcacaagtttgctgctgccatgccttggtctccagttgttaattggaccccttcttttttgctgaagcggtacctcttgacaggaatccgagatggtccccatgaaccattcatcgcagactcagtagattttggtgtgggt

SEQ ID NO: 39809 - DNA, 382 bp, Zea mays
  Clone ID: LIB3062-036-Q1-K1-C5
gtgcggattcaagcacaccaaccagtaccccttcatgtccatgggctcctgcggcaacgagcgattgttcaaggacggcaagggctgcggctcctgctacaagattcggtgcaggaaggacccgtcctgctccgggcggacggagacggtgatcatcaccgacatgaactactacccggtgtccaagtaccacttcgacctcagcggcactgcgttcggcaggctggccaagcccggcctcaacgacaagctccgccactccggcatcatcgacatcgagttcaccagggtgccgtgcgagttcccgggcctgaagatcgggttccacgtggaggagtactcgaaccccgtctacttcgcggtgctggtggagtacgaggac

SEQ ID NO: 39810 - DNA, 376 bp, Zea mays
  Clone ID: LIB3062-036-Q1-K1-C6
gtgcgtattcacgcacaccaaccagttctgcttcatgtccatgggctactactgcagccagcgattgttcaaagacggcgggggcgtttactcctgctacaagattctattcaagaatgacccgtcctgcttcatgcatacagagaccgtgatcatcaccgacataaactactacccggtagtccaagtaccacttcgacctcagcatcacttgcattcgacttagctgtctcaaacgactgacctcaaccactagctccgccactccatcatcataaacatcaagttcaccacattgccaatcgagtttccgggcctgaagatcgttttccacgtgcaagagtactcgaacacgatatacctcgcgatactattc

SEQ ID NO: 39811 - DNA, 335 bp, Zea mays
  Clone ID: LIB3062-036-Q1-K1-C7
ctggaggccctgcatcctcagagttcgattggggaaccagtgatactcccagacgctcagcacgcttgagcgagaagggcaaggcaactgagagcccagagggtgagaagacccctaaacggggaagatcaagttctaagagaggcaaaaaggaggaaaaagaagacacagaagctgcaaatgaggctggagaagatggtgcttcggaggaaggtaaaggtacagatgtggagatgaaagatgctgaaaacgctgaagacgaaaggaaagaggcccaaatgcagatgctgcagagaagactgaggaaggtgaagataggaaagaggaggcccctg

SEQ ID NO: 39812 - DNA, 403 bp, Zea mays
  Clone ID: LIB3062-036-Q1-K1-C8
ctggcaggagcagcagcagcatggccaccaccagcacgcctcgcctctccaccctcctggtgctcctggcggcggcgtgaccgctgctgagcgcaggtcaggaaggccgccccgaaggctccggcggcggcgaatgcggcgccagggccggcggcgtcgtcgtcgaacggcgcgggcgctgctgacgctgcccctcccacagacttgaacaaggcgctcaaggacgaccagttcagccagcttaagcaactgctgcaccacacgctcgttgacactcttattaacactcatctgacgttcagctactacggtctgaccattatggcgccgaccaatgccgacttccagccgatgaatgccggcctgcttaacatgcttttgccgcaggtgcagatccagctca

SEQ ID NO: 39813 - DNA, 440 bp, Zea mays
  Clone ID: LIB3062-036-Q1-K1-B10
gcgaggagggcaggaagaccgaagaccgagccgtgcgggggctcgggacgggaacgggacaggaccccaaaatctgagatccttgctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaagcacaccggagcatccggcgaggacctgcacgcttgaaaccgaccaccaggccatatgctggggaattgcatattgggtcaagggtggtccagaaaaagagctaaaagcaatacagtacttggaga

SEQ ID NO: 39814 - DNA, 440 bp, Zea mays
  unsure at all n locations
  Clone ID: LIB3062-051-Q1-K1-D5
gacgactcttggccaacagaagtgtttgagcttgtcactggagagaaatcgaagacattggaaaggcttgaccctggtgccactgcttcgcacacatatgtcctggagaccaaaacacagggcaggttccagggttcaccagctattattacataccgtgttcccacaaagacagctcttcaggaggcatactcaactcccatcttcccactggatattctcgctgagagacctccagagaagaagtttgaatgggctaagaggcttgtgatgaaatacgggtcacttgtgtctgttgtctcttttgttggactgtttatctaccttgtcgcgagcccgtcgaagagcagctcanaggcaagcaagaagagacgctgatctacttataggtcgcagttgacggtgtagctggtggttttgcctggaggaactctnggtag

SEQ ID NO: 39815 - DNA, 447 bp, Zea mays
  Clone ID: LIB3062-051-Q1-K1-D6
atgcccggcactgcagcgaggcaagagggctacctgaatttcccatctctccttctcaggattggtttcaggatttcgcctgctggttcccatcgatcagagggcccggcgctgttgcctttcgcattcgattcctttcgggtcggatttgtggcggagctcttgatttgctccgtccctgccagaggaggagggcttgctggatcagggatcgagcaaggaagcagccatgagcggcggcggaagcgtgagtttcctcgagatccagccgtcggagctcgcattcccctttgagataatgaggcaaagctcgtgctccatgcaactgaccaataggactgaccattatgtaacattcaatgtcaaaacaaccaacccaaaacagtactgtgtgcgtcctaaaattggtgttgaattaacctgctcaacttgcgatgttacagtgac

SEQ ID NO: 39816 - DNA, 299 bp, Zea mays
  Clone ID: LIB3062-051-Q1-K1-D7
acgcgtgggcgcagacgccttgtttactttggtgttcgaaaccgacaggctaaggggggccacactcgtcgtggggggaatggtcacggatgggtcatacgaatgggcgatctacggcggaaccggggtgttcgccatggtcaccggtgtcatgaagagaagaaaccttgccgccggtagcaacgacgggaactctgacgagcttgccctggaagttttctgcccggtgtttggcgcattacagcaaccaattagcaagcagcaggacttcatctccttcgtcaccaagatcggactat

SEQ ID NO: 39817 - DNA, 439 bp, Zea mays
  Clone ID: LIB3062-051-Q1-K1-D8
ccgccctcgtatcctcacgcccacaaaacacccgaagaaaagaagagactgaacgccgcgagttcacgtgacgatggagaacgccgcctccgccatcgctaagccgtcgctgtccaagaagccctcgccgtcgttccgcctccggaacggcagcctcaacgcactgcgcctgcgccgcgtgttcgacctcttcgaccgcaacggcgacggcgagatcaccctcgacgagatggcctcggcgctcgacgcgctcggcctcggcgccgaccgctccggcctggaggccgcggttggcgggtacatcccggccggcgccgcggggctccgcttcgacgacttcgaatccctccaccgcgcgctcggggacgcgctgttcggccccatgccggtggctgtgaccgaggacgacgacgacgagggggacatgaaggaggcgttc

SEQ ID NO: 39818 - DNA, 427 bp, Zea mays
  Clone ID: LIB3062-051-Q1-K1-E1
aggataacaaattttgctgaggataagtttggaagggatggtattgatgtgaaaactggatataaagttgtgaaggtttctaaggatgatattaccatgcaaaatcctgccaccggggatatttcagtcccttatgggatggctgtctggtcgactggtattggaactcgtccattcgttgtggaatttatgaaacaaattggccaggccaatcgccgtgtcttggctactgatgaatggctaagggtccgtgaatgtgatggtgtctatgcaataggtgactgtgctacaataaaccagaggaaagtaatggaagacatttcagaaatattcagagtcgcagataaagataagtctggaaccttgactgtgaaagaaattcaagatatccttgatgatatctacgtgaggtacccgcaagtacagc

SEQ ID NO: 39819 - DNA, 345 bp, Zea mays
  Clone ID: LIB3062-051-Q1-K1-E10
cggacgcgtgggcggacgcgtgggcgacggcatcgtgctcgagaacctcgcgtccggcttcatgtccgacgtgcaggtcgccgaggcgcgggccttctacggcttccagatcgccatcgagaacatccactcggagatgtactcgctgctgctcgagacctacatccgcgacgacgtcgagaaggaccgcctcttccgcgccatcgatacggtgcccgcggtccggcgcaaggcggactgggccatgcgctggatcgacggcggggagcgcttcgccgagcgcctcgttgccttcgcctgcgtcgagggcatcttcttctcgggctccttctgcgccatcttttg

SEQ ID NO: 39820 - DNA, 332 bp, Zea mays
  Clone ID: LIB3062-051-Q1-K1-E11
gacccggactccgtggaggcggcggagatggcgcagacgctgcacgactgcgaggcgcccgcggccaggggcgagaggaaggcgtgcgccacgtcgctggaatccatggtggactttgccaccgccagcctcgggaccagccacgtgagggccgcgtcgacggtcgtggggagggagggctcgccgaggcaggagtacaccgtgacaggcgtgaagcgggcgggcggcgggcgcctggtggcctgccacgcggagccgtacgcgtacgccgtgttcgcgtgccacttgacgcagcagacgcgggcgtactcggtgtcgatgcttggcaagga

SEQ ID NO: 39821 - DNA, 330 bp, Zea mays
  Clone ID: LIB3062-051-Q1-K1-E12
ggacgcgccgctgcacgccctcgggttcgagatggaggagctctccccgtcgcggggcaccggccgactcccgatcactcccatctgctgccagccgttcaaggtgctgcacggcggcgtgtcggcgctggtggcggaggcgctggcgagcatgggcgcgcacatggcgtcggggtaccgccgcgtcgccggcgtgcagctcagcatcaaccacttccgcagcgccgccctcggcgacaccgtcctcgcgcaagccgtccccgtccacgtcggacgctccacacaggtttgggaggtgaagctctggaagatggatccgtccacgggagc

SEQ ID NO: 39822 - DNA, 345 bp, Zea mays
  Clone ID: LIB3062-051-Q1-K1-E2
atccacactaacgaacgaactcttgctccgatcacgagctagctgaggtcgacgatggcggctgtgctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctgaacagcgcggcgcggaccagcgcggaccggcaggcggcgtgccgctgcctcaagagcctcgccaacagcgtcaagagcgtcaacatgggcacc

SEQ ID NO: 39823 - DNA, 267 bp, Zea mays
  Clone ID: LIB3062-051-Q1-K1-E3
gggagatgcccgccgagatggagcgcaccggggccaaggtggacatgtccgatcaggtcgggatgacgcttcgccggacgcagaaactttaccttgttcctagaattcccaaatgagtgtcgtcgtcgtcgtacaaatggcatgcatcttattgtaagttttggagtttgttgttgcacacgcaacgatggaccgcctgtgatatctttaataaatgtaaccgcagataataatgaaataaaaagaacgcatggctattgtattatt

SEQ ID NO: 39824 - DNA, 442 bp, Zea mays
  Clone ID: LIB3062-051-Q1-K1-E4
gccggcctgcaggtttccacgtcgtccatggcgcttgtcgtgatgtgtgggcagccgtgcagcggtaaaacagcagccgccacttgccttgctgtggcgctgcactcctcctcgcctgacctcactgtccgaatcatcgatgagtcatccctccatctcaggcgcaacgatagctacaaagatatggttgtggagaaaaacttgagagggcttcttagatcagaagttgacaggtctgtgtcacgcgacagcataattattgtcgactcgttgaataatattaaggggtaccgctatgagttgtggtgtcttgcgcgtgcatctggtgtaagatattgtgtgaagtggaccattgtaaggaatggaacagcaaccgccaggagaaaggagaaccagcatatgatactaatatatttgaagatcttgtaagtagatttgagaa

SEQ ID NO: 39825 - DNA, 242 bp, Zea mays
  unsure at all n locations
  Clone ID: LIB3062-051-Q1-K1-E6
gtactcggttccggaattcgccggcgtcgacgccacgtcgnntccggggttggggcttnnctcctcccccttccggtttcnngggttcgtggttcgtgaggggttctccgggggtgtcggtttcgtaggggtgagccggatcnngagatggcngtngcgtcggatgggttgagtacctcgctgcntttcgtcggtcggcccttcgcctggggcccacgtgacccgaccactttcccttccac

SEQ ID NO: 39826 - DNA, 321 bp, Zea mays
  Clone ID: LIB3062-051-Q1-K1-E7
tcagatacctagctacattcaacatctagttagcgtacagaacatcaactatcagtgtggggaccaattctaaggatgggccgcaccaacaccacagcacgagtattgcgcttcgtcagtggcgttccccctctcaattgctacagaatgcctactactgtcagacggcatgccctcgcctctcacagatcatgacccttcgaagcttagcctacagtactactccaagacttgccccatcgtgcaacaccacgtccatactgatatagactacgctgaacgctcctacacgctctacaccatactcattctcctactcca

SEQ ID NO: 39827 - DNA, 342 bp, Zea mays
  Clone ID: LIB3062-051-Q1-K1-E8
gagcactgaagcagagcgagctagctgtccggccaaaccctcacggccgccggcacgatgccgtgccatctcgcgctgctcctgcccctgctactgctggccttgccggcggccacgcgcctggcgtccgacgcctgcgcggtcgataagttcccggcggagcgtgcgtacgcgtcgtgcgaggacctgccgaagctggacacgtcgctgcactggacgtacgacgcgttcaagagctccctgtcggtggcttacgtggcagatcccgctagatgccgtcggatgggtggcgtgaggcctgaacccatctgccgaatgcatggccggcactcacgctctggt

SEQ ID NO: 39828 - DNA, 369 bp, Zea mays
  Clone ID: LIB3062-051-Q1-K1-E9
gcacccaccagaggaaaagggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggaaggcacgcccaagaggctgacctacgacgagatccagagcaaaacgtacatggaagtgaaaggcacg

SEQ ID NO: 39829 - DNA, 444 bp, Zea mays
  unsure at all n locations
  Clone ID: LIB3062-051-Q1-K1-F1
atcagctagctagctgctgccaagagctagccaggggacagagcagcagcttgaagttggtgaccaatgctaaggatgggccgcgccagcgccacagcaggtgtgttgcgcttcgtcagggcgttcgccctctgcgtggctacggcatgcctcctcctggcggccggcatgccctcgcctgtggcggcgcaggacccgtcgaagctgagcctgcagtactactccaagacgtgccccaacgtggagcacgtcgtccggacggagatggagtgcgcggtgcgcgccgacacgcgcaacgccgcgctcatgctccgnctccatttccatgactgcttcgtgcagggctgcgacgggtcggtgctgctcgacgacacggcaaccatgatcggagagaagcaggcggagcagaacgtcaactcgctgaaagggttcgatctggttgac

SEQ ID NO: 39830 - DNA, 279 bp, Zea mays
  Clone ID: LIB3062-051-Q1-K1-F10
gcgacgctggtatcgagatacgtacatgggcccgtgtcgcgtcgctgctgctcagccgcatcgtggctgcggcggcgtcactgctgctgctgcttgcgccgtcggcggcggagctgacgcgggtggagcacccgcccaagaacgaaggctcgctcgccattcttgcagttggcgactgggggcgccgggggcagttcaaccagaccctcgtggcccagcagatgggagtggtggcggagaagttggacatcgacttcgtcatctccacgggcgacaaca

SEQ ID NO: 39831 - DNA, 395 bp, Zea mays
  Clone ID: LIB3062-051-Q1-K1-D4
ggaaaaatcctgcagtctacaaatttcttggtgagacgatccatgtagatggtcatgacctgtatgaatcagcaaagaggctcaaactacgagagctttcagcttttgctctggaacacttgccaaatcggaattccttgatatatggtgacctttatggtatctacaaagaagcatccaccatatatagggctactcttcgttacgaacgttttagtgagataatggtaacccttttcaaaactgggttctctgatgctgcaaatcatccactgctgcaagatactagtcgttcaacatatcatggtttccttgatgaactactgaataatatctgcacaattaacacggacttagatattgaagcctctgctggatacgatgatgacctgatt

SEQ ID NO: 39832 - DNA, 96 bp, Zea mays
  Clone ID: LIB3062-051-Q1-K1-F11
ctttttatcctggcagattaaagcatgagtttatggtgtttttgacacgtatttttgccccgaccagacccagttttagtcaatgtttttcttttc

SEQ ID NO: 39833 - DNA, 330 bp, Zea mays
  unsure at all n locations
  Clone ID: LIB3062-051-Q1-K1-C10
gaatcagggtgggtaggcggaggaaggaaggggaaaggcgacgagctggtgacgacgaggagcaactagcgtcgcgaagccgtcgagccccaggcgaagtcacaggccgncgcagcggtgccggcgcccacccgatccgccgccgccgccgacctcgtgctcgcgcctccggtcggaaggagggggtgtcaaacccatggagcagcctgccgctcccgatcggagcgattttcccgccggggagtgcgaatggcgggaggagctgcggcagcagcagtctcaggtggacgcgctgcgggagcggctcgtggaggcgaaggtcgggttgcg

SEQ ID NO: 39834 - DNA, 324 bp, Zea mays
  Clone ID: LIB3062-051-Q1-K1-C11
cccagcttccctttcgttcctcctcgtcccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatta

SEQ ID NO: 39835 - DNA, 302 bp, Zea mays
  unsure at all n locations
  Clone ID: LIB3062-051-Q1-K1-C12
cggacgcgtgggctcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgncacctgcaagaactgcgtccccgtgtccacggacaaaggcaccaccaagtacagatgc

SEQ ID NO: 39836 - DNA, 386 bp, Zea mays
  unsure at all n locations
  Clone ID: LIB3062-051-Q1-K1-C2
cttcccactcccgccgctgcctcctcgcagcttccgccactctactcgtcgccttatgcggcgccgtgcatgaccggccagatgggcctgaaccagctcggcccggcccagatccagcagatccaggcccagttcatgttccagcagcagcagcagcagaggggcctgcacgcggcgttcctgggcccgcgggcgcagccgatgaagcagtccgggtcgccgccgccgctggcgccggcgccggcgcagtcgaagctgtaccgcggcgtgcggcagcgccactggggcaagtgggtggcggagatccgtctcccgaagaaccgcacgcggctgtggctcggcaccttcgacaccgncgaggacgcggcgctcgcctacgacaaggc

SEQ ID NO: 39837 - DNA, 438 bp, Zea mays
  Clone ID: LIB3062-051-Q1-K1-C3
tcctaaaaggatggtaacctttgggcggttaaatggccatgttggttgttgaaggtaccactgggccaacggcactctaagggtctaacttggcctactttggagaggcccatgcttacaactaatatcatagagcgagcaaagacgattgcatttaagtggaagtccaagttagataatcttgacattgatgctagcaatgggaactgtcttgaagctcatgcgtttcttcaacttctggcaacctttggtatctctgctgaattcaatgaagatgacttgtgcaaattgcttccatatgtcagtcgtcgtcgtcagacacctgaactctgtcgattgcttgggttgtcgcagaataagccaggtgtcattgaagttctggtggaaagttgaagacctattgatgcaattaatttggcttatgtgtatgaacttact

SEQ ID NO: 39838 - DNA, 416 bp, Zea mays
  Clone ID: LIB3062-051-Q1-K1-C4
gctacgctggccactacgttccacagttagcccagcgcatggttgagttcaacaagaaggagaagctattcaacctgaaaggcattgctcttggcaaccctgtgctggagttctccaccgacttcaactcgcgggccgagttcttctggtcgcacggcctgatatcggactccacctacaacatcttcacgacggtgtgcaactactcgcggtacgtgagcgagtactaccgcggctccctgagcacggcctgcgacagggtgatgagccaggtggcgagggagacgagccggttcgtcgacaagtacgacgtcaccctggacgtctgcatctcgtcggtgctcatgcagtcccaggtcctcgtccctcagcaagggagcagggagctggacgtgtgcgtggaggacgagacgatg

SEQ ID NO: 39839 - DNA, 453 bp, Zea mays
  Clone ID: LIB3062-051-Q1-K1-C6
gacaaattgagtcgacggggaaggaaataaagaaggggaagagcacgcgccgccgccagcaccgcgggcgccatggccgcctcctcccgccgcgcgtctcaattgctggggtccgcggcctcccgcctcctcctcgggcggggcttcgccgcggcagccgccgcggcgccctcgccggcggtcttcgtcgacaagagcacccgtgtgatctgccagggcatcacggggaagaacggcaccttccacaccgagcaggccatcgagtacggcaccaacatggttggtggagtgactcccaagaaaggtggaactgaacatttaaggctcccagtgtttaactctgtagcagaagctaaggctgaaacaaaagccaatgcatctgttatatatgttccaccaccatttgctgccgccgctataatggaagcaatggaggctgagctcgaccttgtg

SEQ ID NO: 39840 - DNA, 429 bp, Zea mays
  Clone ID: LIB3062-051-Q1-K1-C7
ctagttctagatcgcgagcgccgccctttttttttttttttaaagaatctacgaagtagtttacatttccacaagtgaccatgattggtcatttcgttttcaagcttctgcctgaattcacacagaatgaacctaacacgtacactccacctaattccatatcataatagtagtctggtcgagttataatagattttcgctgctctgcctagttccaaatttctgacatcttacatgtcctatcttgggccaacaaatatatttacaaatgaaaaaatattgcacaagtctaccgtccctcaacctgaacaagatttgaggacacatggcagcagtcaatgcctctggctctgcatctgacagagcctggtgttgagagcttcaatgtatgtgcgaagtcgatgccgatcggatcttgtcagagtcaaa

SEQ ID NO: 39841 - DNA, 429 bp, Zea mays
  Clone ID: LIB3062-051-Q1-K1-C8
ctaacactagcgtacaagcgggtgccggatagagtggaggcaactaggaaggcagtgcttcgtgccctcaagctgttctgccttggtcttgttctccaaggtggatttttccatggcgtccacagtctcacgtttggtgttgacctaacgaagattcggttgatgggcatacttcagaggattgcaatagcctatctcctggctgcagtatgtgaaatctggctcaagggagacgatgatgtagattctgggtatggtttgctgaggagataccgttaccaactgtttgtaggattggtcctctctatagcgtactctattcttctgtacggcatatacgttccagactgggagtaccagatagcaggccctggttccagttccacagagaagtcgttctctgtgaaatgcggagtgagaggagacacc

SEQ ID NO: 39842 - DNA, 443 bp, Zea mays
  Clone ID: LIB3062-051-Q1-K1-D1
cgcttgtcggcggtgaagcaaagcttagttcttgacgcccaacctccccgttgcatattcgcctcaggaatttgggaattatgtctctttgaggggaatcaagggacttgcttttacttgtctaggctccatgtctaagtgggagccagtcacgtttcaggaatctcttagctttgttaagaaagtaaaggcacgtgactacatgctatacatatcattgctcgatgtgctcaaccggaatgatcaaatccctctgcaagcttacagcgagctctcgcttctgtttcagcatcacgaagatctgttagcggagctgtcgaagttcaggcccctcccatgcccaaacaacgtttatacacacggctcgatttggatgatcatattcctcatgccttttctgctcctgagccttgtcctcgccttgagaagccattgaagtgctt

SEQ ID NO: 39843 - DNA, 361 bp, Zea mays
  Clone ID: LIB3062-051-Q1-K1-D10
ctggaggagaagcatcaagctatggaggaagagaagattcagttggaggctaagttgaagaaagagcaggaggaggcactgaagcagctgaggaagagcctgaccttcaaagccaaccccatgccgagcttctaccacgaggcgacgccgtccccgaaggccgagttcaagaagctgcccacgacccggcccaagtcgcccaagctgggcaggaggaagacggcctcgacctccatggagacgtccaactcgtcgtcggagagcgagggcacgaggccgtgctgccgcgccagccgcgacggcctcgacagcagctgcagatgcggcggcaggagcaagccgcaggccgcgaacgccaagc

SEQ ID NO: 39844 - DNA, 440 bp, Zea mays
  Clone ID: LIB3062-051-Q1-K1-D11
gttgaaccttatgttgcatatgggtacccgaacttgaagagtgtcagggagttgatctacaagaggggctacggaaaactgaacaagcagaggatccctctgtctaacaaccaagtcatcgaggagggcttgggcaagcacaacatcatctgtattgaggatcttgttcacgagatcatgactgttggcccacacttcaaggaggcgaacaacttcctttggccttttaagctgaaagccccgctgggaggtctgaagaagaagaggaaccactatgtggaaggtggtgatgccggtaaccgtgagaattacatcaacgagctcaataaaaggatgaattaggttcacgaccaaactcaatgtggtctaaaaaaactttctgggctctccaattttacaataataggaaatggatgaatatgccatcaagtttggtggtt

SEQ ID NO: 39845 - DNA, 367 bp, Zea mays
  Clone ID: LIB3062-051-Q1-K1-D2
cttccggaattccccctgctgggttcccatcgatcaaagggcccggcgcttgttccatttcgcattcaatccctttcgggtcgaatttgtggcgaacctctggattggctccgtccttgccaaaggagaagggctggctggatcagggatcgagcaaggaaccagccatgagcggcagcagaagcgtgagtttcctcgagatccacccgtcggagctcgcattccactttgagataatgaggcagatctcgtgctccatgcaactgaccaatacgactgaccattatgtagcattcaaggtcaaaacaaccaacccagaacagtactgtgtgcgtcctaatattggtgttgaattccctggctcaac

SEQ ID NO: 39846 - DNA, 431 bp, Zea mays
  Clone ID: LIB3062-051-Q1-K1-D3
cggacgcgtgggcgcagacgccttgttcaccatggtgttcgaaaccgacaggctagagggctccacgctcgtcatcaacggaatggtcacggatgggtcagacgaatgggcgatctacggcggaaccggggtgttcgccatggccaccggtgtcatgaagagaagaaaccttgccgccggtagcaacgacgggaactctgacgagcttgccctggaagttttctgcccggtgtttggcgcatcacagcaaccaattagcaagcagcaggactccatctcctccgtcaccaagatcggactatggggcggacagggaaggtcggcacaggacatcacggcagagcagccaccacggcgtctgcacagcatcaccgtccgcgctggcgttgccgtcgactccatcgagttcacctacaccgacgacgctgggc

SEQ ID NO: 39847 - DNA, 297 bp, Zea mays
  Clone ID: LIB3062-051-Q1-K1-B9
cggtccggactgcccgccgcaagccacacgtccggcgaatcacagacgcgtctttctcattttgctgcgctgcactaccctgcggtgccagtatatattacgggagccctggcgagcgagagctatggataggcatggctgctccgaagctcgcgacgctggcgctggccgtgctcctggcggcgaccgtggtggctcccccggccgctgtgctcgcggcgatgtcgtgttccaccgtgtacagtacgctgatgccgtgcctgccgttcgtccaaatgggctgggccatgccgtccc

SEQ ID NO: 39848 - DNA, 340 bp, Zea mays
  Clone ID: LIB3062-051-Q1-K1-A2
ggttaaatgagcacgggctatttgaacttgcacatggcgacaagaccgccgatgattctataccgatggtgctgaaaataccgcgcatgtttgatccatgtcgtggatacagcatcattggctttggtgatatccttcttcctggtcttttagctgctttctgagctaaaatacgatttttctgcaaagaatggcttacggactgcttacagccagtgggcaaaggtggcctatggctctggactactaatcacatatgtagccctgaacctaatggatgggcatggacaacgtgcccttttgtacatcgtgcccttcactcttggcacattgatcgcgc

SEQ ID NO: 39849 - DNA, 424 bp, Zea mays
  unsure at all n locations
  Clone ID: LIB3062-051-Q1-K1-A3
ctagggtttttgattttagccgcctccgttgcaatttacatacctcgagaaaacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagctgangatgatgatgaccttgatctttttggtgatgaaactgangaggacaagaaggcagctgatgagcgtg

SEQ ID NO: 39850 - DNA, 93 bp, Zea mays; identical to SEQ ID NO: 39326
  Clone ID: LIB3062-051-Q1-K1-A4

SEQ ID NO: 39851 - DNA, 440 bp, Zea mays
  Clone ID: LIB3062-051-Q1-K1-A5
ggaagcggcagcgcccgctgccgagacagaagcagaaccggcagccgctgagcccgaggctgctgctgctgctgaggagcccgcggcggctgagccggccgctgaggagcccgagaaggccgagccggccgctgaggtggccgagaaggccagcgagtgaggccgtgcgccgtacgcgcactgcggcggcggacagcgggtcgggagatcgatgtctcagcgtgcgcgcgtggcgtgccagtcgcgtcgcgcgcgctggcgcctactgttcagtacaacgcgaacgcgacggtttctctccatctctccgtgtgtgacagtgtgtgtgtcgtagctatagcagtgcccggtgcggactgcgagtgacatgggctaaataaagtgtgcgtcgtctggtctggtggtggtagtggggcgcggtgccccatgtgtgccgctgc

SEQ ID NO: 39852 - DNA, 442 bp, Zea mays
  unsure at all n locations
  Clone ID: LIB3062-051-Q1-K1-A6
ggattcgggaaggtgtacaagggcaagatcaacggacagatggtggcagtgaagcagctcgctcgagacggcgtgcaggggaggaacgagttcttggtcgaggtgctcatgcttacagtgctcaaccatcgcaaccttgtcagcttggtcgggttctgcgcgcagggggacgagaggctgctggtctacgagtacatgccgttcggaagcctggagagccatctgtttgacgtgcctctcggcaagaaaccactcgactggaacacgcgcgtgaggatagccgtgggagtcgcggaaggggtttcctacctgcacaacgtagccgacccgcctgtgatctaccgcgacatgaaggccgncaacattctgctgggcgaggacttcagcccgaggctctccgacttcgggctcgcgaaggtcgggccggttggagacaggactc

SEQ ID NO: 39853 - DNA, 443 bp, Zea mays
  unsure at all n locations
  Clone ID: LIB3062-051-Q1-K1-A8
ccctccgccatctgcgctgcgctgctctgctctcggtgccaggctgccagccagtgccggcgcgcgcccgctgccgccccgacgggcccaccgttctcttctctccgcgctgcgcgccggctgggctgcaggtcagttaatgcgcccgtgacaggcggcgtcggggaggccaagggcggtgccgggttaatcccgccgtctctcgaggcggcgcccgcggaggaccaggcgggagggggagacggtgaggcgcggccatggggggcgccaaggcggaggacaaaccggccgncgctgcagaagattggtgctaccaatttggaaacaaggatgcatttgacttgaagcccccgaaaaaatcaccgatcgcgttgagaacggttgtctttgctatgactatgttatgcgggatatctatttgctcaatgtgcatgaagcaacta

SEQ ID NO: 39854 - DNA, 390 bp, Zea mays
  Clone ID: LIB3062-051-Q1-K1-A9
ctgttggtaagggacttatcacttcacatgcccttatgagtttagaagctcgtgggatcctctttgtatcccctggaatggaggcatatgaagggatgatagttggtgagcactcacgtgacagtgatcttgaggtgaatcctgtgagaactaaagaacttacaaatatccgagcccctggaaaggatgaaaatgtccgtttgtctccaccccgattggtatgatattttctgcttttaatgagatcatgagagatggtgtttcttttctgtaaaagaaacacaatactacaattcctaatcaattggttaattgcccactgtaacttggatcagcaatgcaaattctagaacccattattggcatatgatattatgttcacacattggg

SEQ ID NO: 39855 - DNA, 349 bp, Zea mays
  unsure at all n locations
  Clone ID: LIB3062-051-Q1-K1-B10
gccaaccgcatccagtccaccccattcccctcgaccccgacaaccccgagtcccgagccgatggcgcccaagggcgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctnctccaaggccatgtccatcatgaactccttcatcaacgacatcttcgagaagc

SEQ ID NO: 39856 - DNA, 346 bp, Zea mays
  Clone ID: LIB3062-051-Q1-K1-B12
catcacaaccgatcacatctcacctgccggaaacattcacccagacagcccagctgcaaaatatctgaaggagcgtggcgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggcttgaaaaggcccaatg

SEQ ID NO: 39857 - DNA, 444 bp, Zea mays
  Clone ID: LIB3062-051-Q1-K1-B2
cgagaatgactgccgatacgcgatctatgatttcgactttgttactgcagaagatgtccagaagagcaggatcttctatatcctatggtccccatcctccgccaaggtgaagagcaagatgctttatgcaagctcaaaccaaaaattcaagagtgggctcaatggcattcaggtggaactgcaggctactgatgcaagtgaaatcagccttgatgagatcaaggatcgggctcgctaggcatcatgatcatgcatcatggactcggcctactactgtggatttgtatgccattatagacttggtgctgtgaaagactgcttgatgatttgcggggtttgtgctgtgtaaaaaaaagtcccatggcttccagaagaccatgaaggttcggatctatcatgtaattccttggtatctgccaattatgtatggactatggacatgtg

SEQ ID NO: 39858 - DNA, 328 bp, Zea mays
  Clone ID: LIB3062-051-Q1-K1-B3
gaggattcgaaagttcagtacctggcgtctagtgaagcacgctcccggcgccccgtggtgcgcagcgcaaagtcggcgggacactcgctctttggcggcggcggcataaaggaggtgcgaacgattttttttataggaggtgcgattgatatctggaagactgaaacgaagcccgagcatgactgtccgaggaatcgagaaaaactaatacgtaagattttaatggcccaacattagagtctcccgtgatatcacctaaattccatctttaaattcgttttttatggttttctctaaaaaattttttatttatatctcatttctcttt

SEQ ID NO: 39859 - DNA, 446 bp, Zea mays
  unsure at all n locations
  Clone ID: LIB3062-051-Q1-K1-B4
gcccacgcggacacgctctgcaccaccacctgccggccgttgccgggctcccggctcgccgccgccgttgcgccctcgcgctcacacctccgccagcccaggtccatcgagcggagaaacccatggccccctcgccgatcctcgtccggccgccggcgctggcgaattcaccccttccgcctccccgatgcgtggccgcggtagcagcggcgccggcggttcggacggctccggcggccccattctctaggctccgtaccaagtgtaggttcgccgcatcggatgtgagagaagactactcttctactccgatagatattgtcgctgatgttaagacggagaagattgtggtgttaggaggaagtggattcgttggttctgcaatttgcagagctgctgtatctaaaggcatngaggttgtgagcttcagcaggtcaggaagacca

SEQ ID NO: 39860 - DNA, 440 bp, Zea mays
  Clone ID: LIB3062-051-Q1-K1-B5
cacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggc

SEQ ID NO: 39861 - DNA, 436 bp, Zea mays
  Clone ID: LIB3062-051-Q1-K1-B6
aattgcttgcctgatcaagtggtggttcagcgcattgatgagaggttatctgccctgggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatcctcatacatccgttgaagaccttgacgagctctccacgctcctccaagttcctcttgtcgcaagaactgtgaacagaagaagcgaggtcattgctgcaagcatgacagtgaacgactggactgccttttgtggctcggacacgacagccaccgagctctcagtcatcgaaagcgtcttcaagctgagagaagggcagtccactg

SEQ ID NO: 39862 - DNA, 437 bp, Zea mays
  unsure at all n locations
  Clone ID: LIB3062-051-Q1-K1-B7
agcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgngtcgtctgagccagcagcacgggctgtcaagcaagggcgccaacgaggtgctcctcgtcatcgaggcctacaagacgctgcgcg

SEQ ID NO: 39863 - DNA, 380 bp, Zea mays
  Clone ID: LIB3062-051-Q1-K1-A12
atttcacaccttcgatatccccgtaactaccggccaactcctccagccggttgtaagggtgtaggtgggtgctcagactcaaacaagtgtgcatgtgcagtgaaaaatggtggagaaatccctttcaatgataaaggccgtattgtagaagcaaaacctctcgtttatgagtgtggtccttcttgcaagtgccctcctacatgtcacaacagagttggccaacatgggctcaagtttcggctgcaaatcttcaaaacaaaatcaatgggttggggtgtgagaactcttgaattcataccatctggaaagcttgtgtgtgaatatataggtgaagtgttggaggatgaagaagcacaaaaaaagacgaatgatgagtattt

SEQ ID NO: 39864 - DNA, 167 bp, Zea mays
  Clone ID: LIB3062-045-Q1-K1-A10
acgcactgacatcgtggccaggtcaaccaagctgatcgctactcgcactcgcaattgtggccttgccagcatgcaactgtaactcagcccatgcatcatactcctaatcttgacaagtacctagcaaggaggtcctaaggcaaggcaatgacaggccatggcgctat

SEQ ID NO: 39865 - DNA, 443 bp, Zea mays
  unsure at all n locations
  Clone ID: LIB3062-045-Q1-K1-A12
cccacgcgtccgcgccacgaaacccgcaatcccagccgaagccggacgatgaagagggagggatggcagcacggcgccgtccgggccagccgcagcaaggtgcttaggacggccgccggcgacgacaactccgacgccgacgcggtcgtggcggcggcggcagcggcggcggcgaggaagccgacgaacgcgtcccggagcacgggcaagtgccggcgggcccggtgcgcgggctgccacgcgcacccggtctccaaggcgcgcgacaaggccaagggcgcgcgcaagctgcgcgcctgcgatgtcgcgctcaaccaccgactcgtgtcctggcgcgtcgtcgaccagggccccgggtacagcggcgcgtncgcctcctccctgctggcgtacctggccggtggcagcagctggcacgaggaggatgaggacgacgacgaggg

SEQ ID NO: 39866 - DNA, 235 bp, Zea mays
  Clone ID: LIB3062-045-Q1-K1-A2
agaaaacaataacgccaaacttaataacccagtagcaaaggggaggaataaagtcgtacaacgtaagttgtaaaccacacaacgacagatagataagaaccgacagaaacataacacgataggagccactcagggcagatcacaggatagcattgaccacaagttcgacctcatgtactccaagagcgccttcatgcactggtacgtcggtcaaggtatggacgaaggcaacttc

SEQ ID NO: 39867 - DNA, 379 bp, Zea mays
  unsure at all n locations
  Clone ID: LIB3062-045-Q1-K1-A5
cagggacaatatagtggcatcagaacaaaggagtcatgtgagcataactctaggggtgtggagattttctcaaaatgctggtttccggagaatcgtcgaatgagagcaattgtttgtctttgccatggttatggagacacatgtaccttttttcttgatggagttgcgaggaagattgcttcagctggatatggagtatttgcactggactaccctggctttggtctttcagaaggacttcatggatatattccaagttttgatacacttgttgatgatgtagctgaacacttctctaangtcaaaggaaatcctgaatatagaggcctaccgagctttcttgttggcaatctatggtggagcagttgcatgaaggtca

SEQ ID NO: 39868 - DNA, 437 bp, Zea mays
  Clone ID: LIB3062-045-Q1-K1-A6
ctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggtcgaaccggccgccgaggcggaggctgctgctcctgctggtcccgaggagactcctgcggtcgagcaggaggcagccgccgaggaggaggct

SEQ ID NO: 39869 - DNA, 425 bp, Zea mays
  Clone ID: LIB3062-045-Q1-K1-A7
ctgggacctgcccgacctagagcacgacgccatgccgcccatctccgcggcttccgccgcggcggcgtcgggcattgccgccgtagctgccgcgccttcccccacgacggcgcgagccgggcggagtgctccgtcgacctcaagctcagcgggctaggcgagttcggggcggcagacgacacgcctcgacagccgcgcggtcgctgcgcctgatgcccaccccttccgagatcggcaccgtcacccggcccccatcctccgactcactcagttgtcgcgcattctgccgcaacatgatccctctgcgcgccacgcaatgccggccggccagccgcacgcgcacgaggttgtcgacgacggcgccgcgaacctctcgtcctctccaactgtcgacaaccggtccacttgccatagccgctccccgc

SEQ ID NO: 39870 - DNA, 411 bp, Zea mays
  Clone ID: LIB3062-045-Q1-K1-A8
ctgggacctgaccgacctagatcactactccattccgcccatctccgctacttccggcgggttgtctttggccatggccgtcgtatctgccgcgccttcccccactactgcgcgagccgggcagagtgctccgtcgacctcaagctcagcgggctaggcgagttcggggcggcagacgacacgcctcgacagccgctcgttctctgcgcctgatgcccaccccttccgagatcggcaccgtcacctggtcctcatcctgcgactcactcagttgtcgcgcattctgcctcaacatgatccctctgcgcgccacgcaatgccggtcggccagccgcactcgcacgaggctgtctactacggcaccgcgaacctatcgttctctccaactgtccacacacttccactttccat

SEQ ID NO: 39871 - DNA, 401 bp, Zea mays
  Clone ID: LIB3062-045-Q1-K1-B1
actggggcagcaaaggctgttggaaaagtcctgcctgagctgaatggaaaactcactggtatggccttgggagggggaacaccaaatgtgtctgttgtggatttgacatgccggattgagaaaagcgccttctatgatgatgtgaaagcagccatcaagacggcatcagagggtgcactcaaaggtattcttggctacacagacgaggatgttgtttccaatgattttgttggtgattcaaggtcaagcatctttgatgccaatgctggtattggactgagctcttacttcatgaagctcgtgtcttggtatgacaacgagtggggctacagtaaccgggttctggatctgatcgctcacatggctcttgtgagcgccaagcactgatgttcgtactcgtt

SEQ ID NO: 39872 - DNA, 223 bp, Zea mays
  Clone ID: LIB3062-045-Q1-K1-B10
tccctgttctaccctctcttcctcttactctttttctacccacacatcttcattttcgttcactgactcttatccagtagcatagttagctttaatgggcagactgagaactcctttaccattctattcctaactacttatatctctacataatcaactacaacatactcattctttaaacactttcacaaattatactcaataatattaactacatatacta

SEQ ID NO: 39873 - DNA, 437 bp, Zea mays
  Clone ID: LIB3062-045-Q1-K1-B12
ctataacgaactccgtgttgcgcctgaagagcaccctgtgctgctgaccgaagccccactgaacccaaaggctaacagggagaagatgacccaaatcatgtttgagactttcaatgttcctgccatgtatgtcgccatccaggctgtgctttccctgtacgccagtggacgtacaactggtattgtattggactctggtgatggtgtcagccacacagtgcccaatctatgaaggttatgcccttcctcatgccatcctgcgccttgaccttgctgggcgtgacctgactgacagcctgatgaagatcctcactgagagaggttactccttcaccacctctgctgaacgcgaaattgtaagagacatcaaggaaaagcttgcatatgtggctcttgaatacgaccaggagctcgagaatgccaagagcagctcatct

SEQ ID NO: 39874 - DNA, 441 bp, Zea mays
  Clone ID: LIB3062-045-Q1-K1-B2
gatttttaccctagcttggtctcctctcctcctagtgtttttgttccagaatctgtagcaggtgggtgacggcgaggacatgcagccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatggagaagatctggcaccacaccttctataacgaactccgtgttgcgcctgaagagcaccctgtgctgctgaccgaagccccactcaacccaaaggctaacagggagaagatgacccaaatcatgtttga

SEQ ID NO: 39875 - DNA, 427 bp, Zea mays
  unsure at all n locations
  Clone ID: LIB3062-045-Q1-K1-B3
ctctagggtttttgattttagccgccgccgctgctcatctcacatccctcgagaagacgcgtgctcgctcgccgatcgatacgatggccgtcttctccgacctccacaccgtcgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggcttgtggtgtaaatctgcctgcgggatcagctcctgcggcagctgctcctgcggatgaagctgangatgatgatgaccctgatctttttggtgatgaaactgangaggacaagaaggcagctgatgagcg

SEQ ID NO: 39876 - DNA, 435 bp, Zea mays
  unsure at all n locations
  Clone ID: LIB3062-045-Q1-K1-B4
gcagcctccatgtcttcttctccatcgcgcagcatgcatcccacggcagcagcagcagggagccgtgctcctctccatggcgcccaggcctgctccctcccctgctccatgggcgcgagctcctcccctcggccagccatggtgccccctgctccttcttcctccagcaacaagaagccagcgcccctccatttttcgccagcgtttccctctgctgtccgtgatgtgggcaagctctgatccatggcgccctnctccccttcttcttcctcaagccagcaggcgtctccctctactccctgtgcgcagcagccccctcccttccagacgcccctgctcttcctccttggcgcccagaaattacagcagcagctcggcccctttcctcctgcgcccagcttttctctccactgcgcagcagcaccccttcccatg

SEQ ID NO: 39877 - DNA, 475 bp, Zea mays
  Clone ID: LIB3062-045-Q1-K1-B6
gtgttctcgtcggtgtctatatttgatgaatacacaaatgatgttcttgacatggcgcctggttcttgttttccaagatttaaatatcggaagggcaaagatgagtcttcacacgggcacagtgttccattatccagaccagcctcattcaacagggagaagcaagaagggaaaaggcctccgtctcgtgttacttcatttaagaacagcattgatgatttcaatccattcaagctgctggaccacctatttgccgaatgcaggaaccagggggaggatttggttaacagaggagtgataacaatgaaggacattgaagaaacgaagtctggcaaagttggcagcggtgttcttaatgttggtctaccagcgtatgttattcttaatgcactccttcggtctgcgaaagctgattctgtcgggctaatcttaagtgacggctctgagattacatctgacaatagacctaaaaaca

SEQ ID NO: 39878 - DNA, 162 bp, Zea mays
  Clone ID: LIB3062-045-Q1-K1-B9
acaaaccaaacttttattttacctaactgcaccatcacaaaaggacagtttcattttcatccttacactggccatcttatccccaattcctactccaataaataacaacctctccaacttttaacacctacacaagctaactacatttcccctttcttttac

SEQ ID NO: 39879 - DNA, 347 bp, Zea mays
  Clone ID: LIB3062-045-Q1-K1-A1
atctgttcttcacctcactaacaccagctagcaactctttctctcctgcaataatggccgggcgctcgttctcctgccagccgcagctggtcgcggcggcggcggtcctggcagctgcgctgctgctgctggcggcggtggcctggacggcgtcggcggtcgtgagctgcggcgaggtgacgacgtctgtggcgccgtgcctcatgttcgcgatggtcagcgcggcgtcgccctacgtggtgatctgcagcggtgtgcgctagatcaacagcctcgcgtcgttcgcgacctaccggcaggtcacctgcaactgccttacgagcatgacggggcgcttcgggggccgc

SEQ ID NO: 39880 - DNA, 445 bp, Zea mays
  Clone ID: LIB3062-044-Q1-K1-G3
atcaggtatatgcctcgtaagagagacttctggttaagtgtactccctttgattcaagttggttggatcctaacttcctaggaaggcatctgaaaggatataatccaggtgactaggtcttgagcaatattgcaattatcttaaaaaggatcaactgtagtattctaccagtgtacttgaattgcttcatgcatgtacggtggcagattttagttggatttttcaattcttatggccttgcatggtgctgacagcaagcaaatattgacaggaacacctttttattgtcactgaactactgcgagcaaatctatacgagtttcagaaatataatcaagaatctggtggtgaggtgtattttactttgcctaagatacaagtatgttctgtgtccttcactgagatgttctccccgggaccatgactgctacttataatgatatca

SEQ ID NO: 39881 - DNA, 356 bp, Zea mays
  Clone ID: LIB3062-044-Q1-K1-G4
gtcaggctctggctgaggaacttgctcgtcggcttggtaaagaaagatgttggagagtcggttggccgaagaagaatgatacagatacttgcaaagatgcaaatgaggttctaatgtttttaggtccacaagcattgagaaaggttatagaagatgcagaactgtatcctataagaggccttttttcattcaaacagttcttcccagagattgacaattactttcttggaatacatggtgatgagcttggtattcatactggatggaaatctatggatgatctttacaaggttgttcctggggaattgactgtcgttactggagtaccaaattctggtaaaagcgagtggatagat

SEQ ID NO: 39882 - DNA, 246 bp, Zea mays
  Clone ID: LIB3062-044-Q1-K1-G5
acgcactgatgtctatggagttctcaattggatgttcaaatcatctgaaccacaagctttggttcaattgcattcaactctgtggtgaatacacagaatggtaatacaagaacatatccactcgctctctctaaaagacttcgtctagaagcacaaagggatctgtaagatcgtgctcaggtcatttcacattggacaggcatcatgctgagatctcgtcatgttagagaatgtgaaagtcacatc

SEQ ID NO: 39883 - DNA, 382 bp, Zea mays
  Clone ID: LIB3062-044-Q1-K1-G6
gttcctgtggctgagatgtcatcacaactgtctccgtgggcagctgctctgttccagttcttgccacccttgatcaggagagagctgctgctccaccaagaatcagataactctgcgcagttgtcccaaattgacacggagcaactgctggcccatctagtagaaacagaaatgataaagagaacgaaagaaggaaggtacaagggaaggaagttcagttcagtatgtcatttctttggatatcaggctcgaggatctacaccatcaaatttcgactgtgactatgcttatgctcttggacgtatctccctgcatatgattgcagttggattgactggctacatggcaactgtggctaatctgaaagaccctgttgacaaat

SEQ ID NO: 39884 - DNA, 367 bp, Zea mays
  Clone ID: LIB3062-044-Q1-K1-G7
cgtcttcctcgcagcgccggcgcgccatctcggtacgaaggcgacggcagcggcgacggcggcgttcaggatcgggatctcagcgacgacgtcagaggcttcccatcccgacccccgccagtcgcctcgcgccctcgactccggactccggtcctccgcacaccggccggtgaccctgcgtttgaacctgctatagaaatttataaaatggccgcggttgatgcgacaaccaaggagatggatgcactgcatgttggacaaaatgatgaaacaaaagagactctgattaaagaagacaaagctgcaaacagcaatcattctgttgttgcagctcagtccttgccaccagaggacgacgatgatgatg

SEQ ID NO: 39885 - DNA, 389 bp, Zea mays
  Clone ID: LIB3062-044-Q1-K1-G9
ctagacgttataaaagtgatcgggaaaggtagcagcggaaatgtgcaattggtccgccacagattgaccggccagttttttgctctgaaggttattcaactaaatattgatgagagtatacgcaaacagattgcaaaggagttgaagataaacttatcaacacagtgccaatatgttgttgtgttctatcagtgtttctatttcaatggcgccatttctattgttttggaatacatggatggtggctcccttgcagatttcctgaagactgttaaaaccattccagaggcctacctcgctgctatctgtacgcagatgctaaaaggactgatctacttgcataacgagaagcgcgttatacaccgagatcttgaaccctcaaatatatt

SEQ ID NO: 39886 - DNA, 327 bp, Zea mays
  Clone ID: LIB3062-044-Q1-K1-H1
ctacgatccaacagttctagagcaagagagaggaagacacaccgcagagttagcaggctagtaactggcaggagcagcaggaatggcggcgacgcgtcgcctctcttgctttctcctcgccgtgcttctggcaggagtggccgctgccaccgccttcgacgaagcggctgctgccggcttcgggcttggccacggcgcgcgtttcgcgcgcaagcatggacgtgctgccgctgagatgccccagccggagccacaacctaaaactaagccggagccccatatgcagtcactgtcccagccagaacctaaaccgaaacctatgccaca

SEQ ID NO: 39887 - DNA, 446 bp, Zea mays
  unsure at all n locations
  Clone ID: LIB3062-044-Q1-K1-H10
ctctgcttcacctcactaacaccagctagcaactctntctctcctgcaataatggccgctcgctccgcctcctcccagccgcagctggtcgcggcggcggcggtcctggcagcggcgctgctgctgctggcgggcggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatcccccgcaagtgcggcgtctccgtccgcgtgcccatcagccccaccgtcgactgcaccaagatcaactgatcgat

SEQ ID NO: 39888 - DNA, 350 bp, Zea mays
  Clone ID: LIB3062-044-Q1-K1-H11
cacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaagcacaagatcacggaag

SEQ ID NO: 39889 - DNA, 387 bp, Zea mays
  unsure at all n locations
  Clone ID: LIB3062-044-Q1-K1-H2
caaggttgtccatgaggaatttggcatcgtggagggccttatgacaactgttcatgcaacggcaggtacccagaagaccgtcgatggtccttcgatgaaggattggagaggaggacgtggtgctgcccaaaacataattcccagctccactggtgcagcaaaggctgttggaaaagtcctgcctgagctgaatggaaaactcactggtatggccttccgagttccaacaccaaatgtctctggtgtggatttgacatgccggattgagaaaagcgcctnctatgatgatgtgaaagcagccatcaagacggcatcagagggtgcactcaagggtattcttggctacacagacgaggattgtgtttccaatgatttgtggtgattcaa

SEQ ID NO: 39890 - DNA, 447 bp, Zea mays
  unsure at all n locations
  Clone ID: LIB3062-044-Q1-K1-H3
cttcgacggcgtgcccgtctccccgggctcattcgccatgcattcctcagcctccgcgagaggaggacgagggctcctcttgccggcggcggttgtggtgctactgttgggtgcagtggcgccagcggcgggttgctatccgcgcgtgttcaacttcggggactctctggcggacacgggcaactacccgttcgtctatggcaacggctcagccaagctccgtccaccatacggcgagaccttcttccaccgcgccaccgggcgcgcctncaacgggcgcctagtggtggacttcatcgcggacacactcggcctnccgttcgtgcgaccgtatctgagcggacggagcgcggaggacttcgcgggcggggccaacttcgccgtgggcggcgccacggcgctcagcccggacttcttcccggcagggggttccacaacatgggaaac

SEQ ID NO: 39891 - DNA, 453 bp, Zea mays
  unsure at all n locations
  Clone ID: LIB3062-044-Q1-K1-H5
gtcggaatgcagcttacaaggctgttgacaaaataatccagattccaacattctccgagaatacagtatgacatcaggcacagaaggcattgacgcgatcgcggcaactcgggttgttgtcactagagatgtgagcaacaacgccaaacatgccctgactggccagtctttctatcgctccttcagcgggagcggggcatccatggacattgtggtgtccagtgtcagagcttacctgagcgccctgaacaagatctgcagtttcgctggcgccgtgaaagccaacagcgatgtagctgagaccgcaagcgtcccgagcacagaatgagctcccgtttggttcagagtgacatgttcaaaaatttctggaaggatcgtccattgagcttangacaggcaggaagtcttggggcttatgtagtgtacaatttctgtatctcatataccgtgctc

SEQ ID NO: 39892 - DNA, 434 bp, Zea mays
  Clone ID: LIB3062-044-Q1-K1-H7
cggacgcgtgggctccctgaaatggtggaaagggttgcgagcatgcttaattactggctcgggcaacttgctggtccccagaggaaatctttgactgtaaaggatccggagaagtacgagttcaagccgaagcagcttttgaaacagattgccaccatctatgtccatatctcaaggggcgacaaggaatctgtcttctcagctgcaatctcgaaagatggcagagcatacaatgatcagttgttttctagtgcagctaatattctgtggaagattgggggtgatcccaaaatcatacaggagtctgtgcaacttgctggtagggcaaaagctgctgcttctgaagctatggatgctgacgcaatccttgcggacataccagatgaattcctcgatccaattcagtatactctaatgaaagatcctgtgacact

SEQ ID NO: 39893 - DNA, 361 bp, Zea mays
  Clone ID: LIB3062-044-Q1-K1-H8
gcagaccacccagtacgtggccgagagacgatggtgcagcaggggcaggcaaagtgacaaggcctctcagagagtcacaagtctctggacttttgcttctaaacgccgctgtctctgtgtatctcgttccttttcgaaaattttgaatccgatcgatccgcgtgttttcacacactaagctagcaagatcgacgctatcacgctactgcgtgccctgtatctgttgaagttgtgcctgtaggctgcaggttggctgggtgtgtgtggcttcaaaattcggcggcgacaggcggcatcctggacgagcaaaacgcgcattcgatctggctgattttttcggttggtcgtcttggtccaatgc

SEQ ID NO: 39894 - DNA, 306 bp, Zea mays
  Clone ID: LIB3062-044-Q1-K1-H9
ggagtgggggcagccaaagtcgcggatcacgcacctggtgttctgcaccacgtccggggtggacatgccgggcgccgactaccagctgaccaaggcgctgggcctgcgccccttcgtgaaccgcctcatgatgtaccagcaggggtgcttcgcgggcggcacggtgctgcgcgtggccaaggaccttgcggagaacaaccgcggcgcgcgggtgctggtggtgtgctccgagatcacggccgtcacgttccgcggcccctccgagtcgcacctcgactcgctcgctgtccatgcgctgttcggcga

SEQ ID NO: 39895 - DNA, 311 bp, Zea mays
  Clone ID: LIB3062-044-Q1-K1-G2
acgcccacgcgtacgcccacgcgtacgcatagaagtgctcatgtccaaaatagatgctttaacggctggactctatgatgaaatggcgctgccatcacgacgacttacttaaatactgagatctttaggacacaatgtaaatttctgaaatcactaggagttcaatgcttatggatagacacccagacaccatgtctaagcaagataaagagatatgttctgcaatagaaaaactttcagactgtcaggaaaccatattgattcttatccgtcagatgacttctatacctgctccaattcaattactcggc

SEQ ID NO: 39896 - DNA, 436 bp, Zea mays
  Clone ID: LIB3062-044-Q1-K1-E7
gtgatcaagactgtgagtgattggatcagtcaaagatcttctgatgccctgggagactttggtttgtggtgtatagatagcatcatgtctgaattgtcaggtccatcagctggccctaagggttcaaagaaggttgcacaacagtctccaagggcccaggttgcaatctttgttgatcttgccatgactttaagaagaaagcctgatgtactggtaaatgttatgccaaagataatgggaaacaattaatatctgggacaggaaaagcttcccatcattgtctgggttattgctcaggcctctcaaggtgacctagtgtctggcatgttttgctgggctcattctctatttcccacattatgtgcgaagtcaagtgggaatccacttgcaagagatttggttttgcagctgcttgaaagaattttgtctgtcacca

SEQ ID NO: 39897 - DNA, 295 bp, Zea mays
  Clone ID: LIB3062-044-Q1-K1-E8
cctggatttactttgacggctcgcacagtcgcagctggtcattcctgggaggaactgcagaaggaccttgatggcttgctatctacatggaaaggaataactgagcatgctcaatctgctgccttggctgctgatgagggtgtggaaggtgctgttcctgtaatgttgcacagagcgaagggtcatactttatctgttgttcaagacgattttaatgaataggtcaagaggctggttgtggattctactggaacatatcatgaggttacaagctatcttgaagaagtcgcacctg

SEQ ID NO: 39898 - DNA, 427 bp, Zea mays
  unsure at all n locations
  Clone ID: LIB3062-044-Q1-K1-E9
gcaggcgtgaagctgatatcagaaataagtacagcgcttgtatcgttaatgaaatctcctggaatggagggaaattatgttcatttacaaaattcataattccagtttcctaacccgttgctactgaaggttaaaattttaagctactatcttataccatattgtagatcgttgatacatttatgcggagcattgcagtagcttcaacatcagaatgttgcaaaaaaacaatcccattttcttttatcttgagatgttctgtaactgagctgattgttcatgcatgatgattgctccacctctgtcaaaccttgaaggtttaatgtcattagacgactttgacgatgctgaaggcggctccaagctggaacgattctcacgggagacgnctgatccatcattgtcatggaaagacgtggagtggctc

SEQ ID NO: 39899 - DNA, 427 bp, Zea mays
  unsure at all n locations
  Clone ID: LIB3062-044-Q1-K1-F1
gtccatcgtgtcccgcgagatgacccgtcgctacatgacggacatgatcacctacgccgacgaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtncacggtcatgagccgnctnctggcgcgccccaacgtgaagctgttcaacgccgtggccgtggaggacctcatcgtcaggggagggcgccgtcgcggcgtcgtcaccaactgggc

SEQ ID NO: 39900 - DNA, 454 bp, Zea mays
  Clone ID: LIB3062-044-Q1-K1-F10
cgcgttgataaaatcggcttcagcaaggaccaacttcaagtataacagtgaagttttgccagagcctgacatgaagtgcatgaatgtggctagccttgtggagatcagtgatgcatattcacttgaccgtgctatagctacaccagagagagcattgcatactgcaaacctgtgtgtgaggcttttattatctaaggagagcattgtgattaggagacttattatgacagcgaatgcaaaatctcttgcccgtgatctgatctccagagatgctttgatgttccgggtgctccttagtaaggttattgcggatgttgtctaccaatggatgttgagtgccacaggcttgaaacgagttatggagaccaagatccagacgcccatgaccacaggaaagaacgagggacatctggtgctggctgaagaaccatcgaccctgatggtactccaagcg

SEQ ID NO: 39901 - DNA, 286 bp, Zea mays
  Clone ID: LIB3062-044-Q1-K1-F11
cttctgctccccctccggttcgggttcgagttcgtgaggttctccggggttcggtttcgtgggtgagctgatcgagatggcgtgcctctgatgttgagtaccgctgcttcgtcggctgcctcaactggaccacggacgaccactccttgcacaactccttcatcacctactgctaggtaacttagtccaagatcatcctatatcgagtgacacagatgtccctcatcttctgcttcgtcaccttatccacagatgatgcgttgcggtacgccttctacgtcatgaa

SEQ ID NO: 39902 - DNA, 388 bp, Zea mays
  Clone ID: LIB3062-044-Q1-K1-F12
ctctctcatcaacgagacgagctggttccagaacgtttcgaagcctctggacccctcacacgtccatgagcctaagaatcatgggcaaatccatctttccttcgggaaatcgggtcacaactcttgccgcctaagcacaacgactccgtcgacgtcgcggtcagcctggtgccgcacatcatcgacaccatccgttcggccctgaccgtcatgatcgatgccggtgcgaggacagtggtgatcacggggatgctaccgatcggctgtgagccgcagcagctggcccagttcgcatgcggcccggccggcgactacgaccctaccaccggctgcatcacgcggttcaaccagctcgccgagcaccacaaccacatgctgaggatgatgc

SEQ ID NO: 39903 - DNA, 443 bp, Zea mays
  Clone ID: LIB3062-044-Q1-K1-F3
ctccacgcacgtcctcgacgagtaccctgcccttcccaaccgaactcggcacaatggtggacgtgttgagcgccttcggcttcggcaacctgtgtctggccttcaccttcctccatatctccaccttcccggacccgcagctcgctgcggacagcaccgctgaagccccactgctccacgtcgcggccgaggttctgccgtcattagcttctgcggcggtcctcttcctcgccgccgtccccgtggccggcgcgggcaacgggcggcggcggcgctcgatctcggggcttctcatcttcgtgctatgcgtcttcgacggcacgctcgagctcatcgtgttcgggaaggccgccgttggtggtactgcggaggctcgcgcgctcggcctgcctgatctcccagcgttgcctgccgcggcgacggccacgttctttttcgggatg

SEQ ID NO: 39904 - DNA, 441 bp, Zea mays
  Clone ID: LIB3062-044-Q1-K1-F5
agctcttgttggtgacaagacaattgcattctggttgatggataaggatatgtatgatttgatggctctggacaggccttcaacgcctcgcatcgatcgtgggatagcattacataaaatgattaggcttgtcacaatgggtttaggaggtgaaggctatctaaatttcatgggaaatgagtttgggcatcctgaatggatagattttccaagaggtcctcaaagtcttccaaatggctccgtcattcctgggaataacaatagctttgataaatgccgccgtagatttgaccttggagatgcagattatcttagatatcgcggtatgcaagagtttgaccaggcaatgcagcaccttgagggaaaatatgaattcatgacatctgatcactcatatgtatcacggaagcatgaggaggataaggtgatcatctttgagag

SEQ ID NO: 39905 - DNA, 326 bp, Zea mays
  Clone ID: LIB3062-044-Q1-K1-F6
gtcataggcgaaatcagcagatcttttttgatgttaacgatcaatatgatccagaggtttgtttgggtcatctaaagcggtatgctttcaaggagcttcgtgcagctactaataattttaactcaaataacatcttatgtgaaggtggatatggcatagtatacaagggttatttgcgtgatggctctattgttgctgttaaaaggcttaaggattataatgccgtctgtggggaagtccaattccaaactgaagttttagtcataagcttggctgtgcatcggaatcttctccgtcttattgtgttctgcactactgatagcgag

SEQ ID NO: 39906 - DNA, 399 bp, Zea mays
  Clone ID: LIB3062-044-Q1-K1-F7
atctgttgctaaatacacgacactttcattatgcttactagatatagatatcactggtttggtggctctatacaagccttcagcccctcacatcgatcacggcatagacttacatataatgctcaagcttcacacaatgggtttaagagactaccgctatctaaatttcatactaaatcagtatatccatactgaatggatagattctccaagaagtcctcacaatcttccaaatagctccgtcattactgggaataacattccctttgataaataccctcataaatttgaccttgtagatgcagattatattagatattacggtatgcacaacttttaccacacaatgcaaaaccttgagggagaatactaattcatgacatctgatcactcatatgt

SEQ ID NO: 39907 - DNA, 437 bp, Zea mays
  Clone ID: LIB3062-044-Q1-K1-F9
aactactttgagatcgatctcgatgtccatcggttcagcttcatatcacggaaagggctcgagacgttccaggagcggctcaagcatggcgttcttgatcttggtctaactatccaggcacagaaggctgaggagttgccagagcatgtcctgtgctgcatgaggctgaacaagatcgacttcgccaacaacgggcagataccgacgctgataactgcagctgatgagtaaatctgtcctgttactgtaaggcactaactttctggaaaaagcaaaagagactgttgcttttcgagatgctgttgtatagatcggcagatagttgtagggactaactcaagtttgtgagctaagaaacacctaatcactgaggaaggaaaagaagatattgcagcaatctgcattctgaactctgaagacgatgcatatacatgtct

SEQ ID NO: 39908 - DNA, 449 bp, Zea mays
  Clone ID: LIB3062-044-Q1-K1-G1
cccacgcgtccgcccacgcgtccggatagaagtgctaaggtccaaaatagatgctttaacagctgaactctctgatgaaaggcaaagtcatcaggacgacttagttaaatacagagatctcgaggagaagatggaaaggtatgagatggagaggagttcaatgcttgtggatggggacccagacaccaagtcaaagcaggataaagagataggggctgcagcagagaaactggcagagtgccaggagaccatattgattcttggccgtcagctgcaagctatgcgtcctccagccgagtcactcggctcttcacctaatcggcaaggcacggagaactttctacaggacgtggtaggaacaaccgcaggagaatattcccagaagccttcaggccaacctgatacagaccaggatatgcttgggacaggaaatgtctcttcggtcaatg

SEQ ID NO: 39909 - DNA, 428 bp, Zea mays
  Clone ID: LIB3062-044-Q1-K1-G10
cagcggtcgcactacaggtattgtgctcgattctggtgatggtgtgacccacaccgtgccaatctacgagggatacgcgctccctcatgccattcttaggctggatcttgctggccgtgatctgactgactgcctaatgaagatcctcacggaaaggggttattccttcaccacgacggcagaacgggaaatcgtgagagacataaaggagaagctggcctttgtggccctagactacgagcaggagctggagaccgctaagagcagctcctccgtcgagaagagctacgagctgcccgatgggcaggtcatcacgatcggcgcggagaggttcagatgcccagaggtgcttttgcagccgtcgctgatcgggatggaagctcccggcatccacgagaccacctacaactcgatcatgaaatgtgacg

SEQ ID NO: 39910 - DNA, 390 bp, Zea mays
  unsure at all n locations
  Clone ID: LIB3062-044-Q1-K1-G11
cggacgcgtgggtgactatggcaagaagtccaagctcggtttcaccgtgtacccatccccggaggtgtccacatccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtgtcccaggtcatctcatccctgactgcttccctgaggttcgatggtgctctgaacgttgatgtgaaacgagttccagaccaacctggtgccctaccctaggatccacttcatgctntcgtcctacgctncagtcatttctgctgagaatgcctaccacgagc

SEQ ID NO: 39911 - DNA, 182 bp, Zea mays
  Clone ID: LIB3062-044-Q1-K1-G12
cacactctttcgtcatctcttctcccactaataacttcctttcattcaccaaatcacctattacagatctgttcacattcctcgctgagccattccacaatgacccattctctcactctcttctatatcacacttatcctaatgaacttcccgacacataagtcatctatcacatctaccac

SEQ ID NO: 39912 - DNA, 444 bp, Zea mays
  Clone ID: LIB3062-044-Q1-K1-E6
ccgaaacctgcagtcgggtcatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccaccttcccgaagaatacgatggactccgtgaaggacgtgctcggcaagatgggggagaggtttggcgaggcggcccgcaggaccgagaccatcaccggcaatttctggcagcacttgaaaactggaccaagcattactgatg

SEQ ID NO: 39913 - DNA, 400 bp, Zea mays
  Clone ID: LIB3062-050-Q1-K1-B9
ctccgtccttctacccgcacgttgccgtgccgccctccccggagctgcccatcggcctcattgcctcgccaggggagccggagccgcccttcgcgccgccgatgccggccgcgttccaggactacccgccgggcgccgtggccgtgggggtgggagcgccgttcgggggggccagcgtgcacgggcaggcgatcgacgcgatgggcggaggcgacgggcagcgcgagcagagcatggcaatggcggaggacggggaggagccgccgccgcggcggcggcagccggcgggaggcgccgccgtcgccgacgtcgagagcagccgcgggttccggcacatgatgcgggagcggcagcggcgcgagaagctgagccagagctacgccgacctgcacgcgctggt

SEQ ID NO: 39914 - DNA, 370 bp, Zea mays
  Clone ID: LIB3062-050-Q1-K1-C1
gcgttctacgcgaaggccggccagaccacggcgaagtgatcaaggaagggcagatgacgcgcgtgctcgagacggccgaagccgggttgatcgtgctgcccgagcacgactatcaggtgttacggcgcaggggcgacgatcaatacggattttgatccacggggaggaaaggtcgatgtcgatattcgagattgcgagttggattgccttggggacagtgccgattacggcgctggttacggtcgtgcggtcgatctacaccgggaactggatatggacgcgattcctggtgctgcccgtcatcctgacggcattgcttctatgttttgacatgacgcgcccacaacccgtgacaatagtcaacctgatc

SEQ ID NO: 39915 - DNA, 455 bp, Zea mays
  unsure at all n locations
  Clone ID: LIB3062-050-Q1-K1-C10
agctcatgttcagtgggaaattgaactacttgggtttgaaatgcccaaggattggactggcttaactttcgaagaaatcatggatgaggcagacaaaataaagaacacgggtaacagactgtttaaagaaggaaagttcgaacttgcaaaggcgaaatatgataaggtgcttagggaatataaccacgtgcatcctcatgatgatgaagaggggaaaatctttgctaattcaagaaattccctacatctaaatgtagctttttgctaccagaagatgggtgaatacagaaaatccattgaaacatgcaataaggtgctggacacaaatcctgtgcacgcgaaagctctttaccgccgaggaatgtcctacatgttactcagggaatttgatgatgcgaggaatgattntgagaagatgatttaccgtgacaagtcatcagaaccggacgctacag

SEQ ID NO: 39916 - DNA, 449 bp, Zea mays
  unsure at all n locations
  Clone ID: LIB3062-050-Q1-K1-C11
ctctctcgtcgcgcaacatcagagcacaagcgaggaacccagtccagtcccgggaatggagtgcgtattgggcgtggttggccgcgacttcgcgctggtggcggccgacacttccgccgtgcagagtattctcgtccacaagaccgacgaggacaaggtgatggtgctcgactcgcaaaagctgatgggcgcttcaggggagcctggtgatcgggtgcaatttacggagttcatacagaagaacctncacctgtaccagttccggaacaccatcccgctctcaaccgccgccgccgccaacttcacacgcggcgaactcgccacagcccttcgcaagaatccatatatggtcaatattattcttggtggttatgataaggatgttggtgcttccctctactacatcgactacattgcaaccttgcacaagattgacaagggtgcttttg

SEQ ID NO: 39917 - DNA, 434 bp, Zea mays
  unsure at all n locations
  Clone ID: LIB3062-050-Q1-K1-C12
cgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaaggccaagccctactacctctttgatggctacgcccacctttcgtccgggcttgcctgtggtctcgctgggcttgcagctggcatggccatcggcattgtcggtgatgctggagtcagggcaaatgcgcaacagccaaagcttttcgttggcatgatcctcatcctcattttcgcagaagcgcttgctctctatggtctaattgttggaattatcctttcgtctcgcgctggtcaatcccgggcggattaagtgcaccaccattctgtgattaccgnacccgttattatgctattctgag

SEQ ID NO: 39918 - DNA, 390 bp, Zea mays
  Clone ID: LIB3062-050-Q1-K1-C2
cgcggagctggagcgcaagccggagaaggtgttcgtgcgcaccatcaccagccagttccaggccctcgtcggcatctggctggtggagatcctgtccagccactcctacgacgaggtgtacctcggccagcgcgacaccaaggagtggacgtccgacgccaaggcgcaagaggcgttcaagcgcttcggcgcgcgggtgaccgagatcgataaacgcgtcgttaccatgaacgcggaccctggtctcaagaaccgcaacggccctgccgagtgccactacacgctgctataccgcaacatgtgctgcacctagggcgatacctccggaatcaccgccaagggcatttcaaacagcatctccattagagtgctgtctgatctgaagacgta

SEQ ID NO: 39919 - DNA, 418 bp, Zea mays
  Clone ID: LIB3062-050-Q1-K1-C3
cggttccggttcgagcacgcgtacgccaccaattcacttcgacagctaaaaagtttgccgtcgatggggtcgtcagtgaagaaggcggtagtggcggactccactgtacttcctggtaccatacggtggcctacttgctcattggcgctgctctagctcgaacctacctcgtgcactgagcaccttgcgatgaacaccagtgccaattctgatacattctacggaaaggatgacagacacgctggagatgacgtactatgattgaatcgcagccgaggattcgactatctacggtcgccaccgtacttcttatcgagctcaaccaaacccgtcgttattgtgaaacagatgtactacagatcttctattacgaacagtgctcatgacggcaaacatgtcatgcactcatgctccagga

SEQ ID NO: 39920 - DNA, 335 bp, Zea mays
  Clone ID: LIB3062-050-Q1-K1-C4
ctgacaattttgaatctccggagctcctagtgccaacggcgtcagggactgataaaaatggcgcgtattgtctaccactcgatgacgcttcctcctattcgcctcgcgaaatcctgacgctcaacctgacagacaacaccttctcataaactgccatgccaaatgctgtacaaagccacaagctgaaactattccacctggaaagaacgctccatttattgttgacacattccgatggatctatcattatagtgtcacatatttggttatcgagacttatctcgtgaagactgagtccacttgcggactattatccccctgacgcatctgaacat

SEQ ID NO: 39921 - DNA, 173 bp, Zea mays
  Clone ID: LIB3062-050-Q1-K1-C5
ctagttctgtcgcgagcgccgacctttttttttttttttgaattccaacctaaacgggatggcgaattaaagcaaattaactctggtactgatacattcgactacaatataatccaaaaatacttacggcaatattacttgccacacaaagcacacatatagctatgcaaaaa

SEQ ID NO: 39922 - DNA, 465 bp, Zea mays
  Clone ID: LIB3062-050-Q1-K1-C6
aaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgcgatgaaactgttacctacaatcgtaatgtaatgtgctggtattctcgaatgccatagcccatagtcagccatggcttggaataacgtagtggctgaccgatatgccagtaggcaccttatctagtacttacagaactacaaaaagtttgtactatacatatatggaca

SEQ ID NO: 39923 - DNA, 293 bp, Zea mays
  Clone ID: LIB3062-050-Q1-K1-C7
attacgcgtccacaggtaacaaggtttccgatcaatggagtcgtgattgcatacgggggtagtggtgtactccagtgtgacttcctgctattctcatggtggcctatctgcacactggcgctgctctagtccagacttacctgaagcactgaccaccttgcgaccaaacaccagagtgcattctgatagactactatggagacgctgaccataacggtgcagatgacagactctgaattaatcgcagacgtaaatgcgcttatctacatgccccacctgactccatatctagc

SEQ ID NO: 39924 - DNA, 469 bp, Zea mays
  Clone ID: LIB3062-050-Q1-K1-C8
ggcgcaccgtcgtggaggacaatacatgaatctgcagagctcctagtggcaacgaaggcagtcattgttaaagatggcatgtattggctacttctcgatgaggcttcctcctattcgtctcgagaaatcctgacgctcaacctgacagacgagaggttctcaaaaattgccatcccagatgctgtaaaaagccacaagttggaactattcgagggggaaggaaagctccgtttattgtcgacacattccgatggatctagcaatatagtgtcagatatttgggtagcggacttggctcgtgaagactgggtccacttgcagactatcatccccctgacgcatctgggcataagcccgtttttccagctcaagacgaaggtcttcttcggcaaccagaagagactcctctgcgtagatcttcaggacggtacggtttcatacatcaacatgccttccggtgagactttga

SEQ ID NO: 39925 - DNA, 428 bp, Zea mays
  Clone ID: LIB3062-050-Q1-K1-C9
cagtgaaagcaataaaaatttcaggtttgtctgcttaatccttacagtatatggtgtcattacttaccaagaacaagaagttgggtgtgttgaattctgcatgcagtcatttttcaggaaccttaatgttccattgaattaccagtatttacatgctaggtgtcaatggctatctaaatggacataatgttcaaatattacttgtgaaagactgatactacaaatgcatgcagatctgcaaaggaattcatctctaacaaggccttacattggttcgatattcggtccaccaggcatggattctaccatggaaccaaacggaagggacactcacatgcacacagtttcatctggtgacccaatgattccctaaccttcagtgacgtctggtctcagcaaatttacgaactaaatcagcatgcgaaacg

SEQ ID NO: 39926 - DNA, 285 bp, Zea mays
  unsure at all n locations
  Clone ID: LIB3062-050-Q1-K1-D1
ggggctcatcccgttcatctacaaggccatcaaggagcggcgggcccggagctactactactcgcggtgcaactccaccggctcgtcgcgcggccggctcggggcccgcgtggaggacagcgcgtgggacctgcagcagaagcagtgggagtccgccgccggcggtggcaaggcggcggcggagcgggagatggcgcaggcgcaccgccgccaccgctccctcgacgagctggcgggggaggtgggcgcctcggcacggtggcgtcgacgncacccggccgcgcc

SEQ ID NO: 39927 - DNA, 428 bp, Zea mays
  unsure at all n locations
  Clone ID: LIB3062-050-Q1-K1-D10
cccacgcgtccgcccacgcgtccggctacgacccttttggcctgggcaagaagccagaggacttcgccaagtaccaggcctacgagctgatccatgccagatgggccatgctcggtgccgctggcgctgtcatcccagaggcgtgcaacaagttcggcgctaactgcggccccgaggccgtctggttcaagaccggcgccctgctcctggacggcaacaccctcagctatttcggcaacagcatccccatcaacctggtggtcgccgtgatcgcggaggtggtcctcgtcggcggcgccgagtactaccggatcatcaacggactggacctcgaggacaagctgcaccccggtggccccttcgaccccctgggcttggccagcgaccccgaccaggccgncatgctcaaggtgaaggagatcaagaac

SEQ ID NO: 39928 - DNA, 467 bp, Zea mays
  unsure at all n locations
  Clone ID: LIB3062-050-Q1-K1-B6
ccgtgctgcacctgcctgccagccgcagctgtcctgcctttgccttcccatagcatagccatggacatttggaagtccaaggtgttgcccaagatcaagctcgtcttcgtcaagagcgccggcaagaaggccgccgccgctgccgagctcgtcaagtccttcgacgagtccaaggaggggatcgatggcgagttccaggagaagaaggctgatctccagcccaaggtcgtcgagatctacgagtctgcccctgcaccactcaaggtcctgatcaaggagaggagcaaggtgtccgggatcaagaagaactccgccgcaatcaccaagttcttcgaggagctggccaagatcgaattccctggagccaagcaagtgagcgacggcatctccaaggccggcccggccctgctgtccggccccatcttcgccacgttcgagaaggtctncacgctgctccctgtcgtcgc

SEQ ID NO: 39929 - DNA, 440 bp, Zea mays
  Clone ID: LIB3062-050-Q1-K1-A2
ggcgatgcggaacgccatcgagggcatgaacggcaaggagctggacggccgcaacatcaccggcaacgaggcccagtcccgcggcggccgtggaggcggcggcggcggcgggtaccgtggtggccgtggaggcggcggctacggcggttgcgggcgccgtgatggcggcggcggctactgcggtggcggcggctacggtggtggctgcggcggctacggtggtggtggcggctgctactgcggtggcaaccgtggcggctgctacggcaactcctacgggaactggaagaactgagcggtggggcccgcgcggccaagttatcctgttcgctaccgtgttgtttaccctagttcagagtggttatcttcgttcgtctcgtgtttgttggtgcccatctgtgttattgattgaaagtcgctctgtgtcagttgttagtgct

SEQ ID NO: 39930 - DNA, 400 bp, Zea mays
  Clone ID: LIB3062-050-Q1-K1-A3
tcggtgaagacaaccaacagctgaattacctggagaacatgatggttaagacagagcagggatctgaagcaggtgaagaatgattgggcggtggtacccagaagctacgtgagactattgaagaaagtatatccgttaggagtgaagcacaagagaagcacatggagtaccaggaagagatgaagtcccaggaggaaattcttcatggtctaattgaggatattcacatggccacagaggatcaagaaaagcagtttgagaagttgttgcaggacgagcgctcaaaggccagacgctttgatgttgattctggaactatgaaagatcgtcagctaagggaggaatatgtgcagaagttcattgattgccaagtcaaggttgtggcaaagtttgaagttga

SEQ ID NO: 39931 - DNA, 272 bp, Zea mays
  Clone ID: LIB3062-050-Q1-K1-A5
catctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggca

SEQ ID NO: 39932 - DNA, 408 bp, Zea mays
  unsure at all n locations
  Clone ID: LIB3062-050-Q1-K1-A6
gcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttccagctctacaaccgtaggaccgncgccaagccgncttcgttctccgtctcccagcagcaggccggtgccgncaccttcaagaccgacgccgncattcctgacgccgncggccggaccgtcgtctgtgacgtgcacg

SEQ ID NO: 39933 - DNA, 464 bp, Zea mays
  Clone ID: LIB3062-050-Q1-K1-A8
cgagcagcctaaaaaccctagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggccccgacagcttcaagctcctccaagatgcggaagccaagctggaggaggcactgcaaattgatcccaacaagtctgatgcactctggtgcttgggaaatgctcagacttctcatggattcttcactccagacactgcaattgcaaatgagttctttgcgaaggcaactgaatgtttccagaaggctgctgatgtggaacctgcaaatgagctgtacaggaagtcattagacttgtcagcga

SEQ ID NO: 39934 - DNA, 437 bp, Zea mays
  Clone ID: LIB3062-050-Q1-K1-B1
aagaaggttggatacaaccctgacaagatccactttgttcccatctctggtttcgaaggtgacaacatgattgagaggtccaccaaccttgactggtacaagggcccaaccctacttgaggctttggacttgatcaatgagccgaagaggccttcagacaagcccctgcgtctccccctacaggatgtgtacaagattggtggtattggaactgttcctgttgggcgtgttgagactggtatcatcaagcctggtatggttgttacctttggtcctagtggccttactactgaggtgaagtctgttgaaatgcaccatgaggctctccaggaggccctttctggtgacaatgttggcttcaatgttaagaatgttgctgtgaaggatctgaagcgtgggtatgtggcctccaactccaaggatgacccttccaagga

SEQ ID NO: 39935 - DNA, 422 bp, Zea mays
  unsure at all n locations
  Clone ID: LIB3062-050-Q1-K1-B10
ctgacgcctggtacatgaaacacggaacgagattgtgggcagacatagacaaagagagaatggacggtcaacaggagactgatcggctgttgcggcctgagtatgcgtgcctgagccaaaaagatccatggcgtgcccgagacgactgtaacgtgggagcgctcgtatatccacaccaggcagcacctgctagagaggtacatgacgttcgggatcaacatgcaggactagctgaacgcgctaactaagcgcgccgacgaggatgcccgggcgacgtgcacagtgtcgaaggaactcgacaacgacaacaacgagttcagcgacaagtaccagcagtggataatgcagaagcgaagcgcangcacgtgctagcgccagagcactgaactagctgctggctgtgcttagattagccatgatgc

SEQ ID NO: 39936 - DNA, 446 bp, Zea mays
  Clone ID: LIB3062-050-Q1-K1-B11
cagggagctaacgtctggcggttccttcaggcaattagcaggcggtatgacttaacggaatcgctgaagaagctcaagtgccggacgctgatctttgttggagaaaactcacagttccatgcggacgctgtccacatgaccacaaagctggaccggagatactgcgctctagtcgaggttcaggcttgtggttcacttgtcacagaagagcagccccatgcgatggtgatcccgatggaatacttcctcatggggtacgggctctacaggccatcgcagcaggaaagcagcccccggagcacactgagcccgttctgcatatcacccgagcttctgtcaccggagagcatgggagtgaagctgaagcccatcaagacgcgcatctcgcttaacgtttagcatgggtggatctcggatggccatggcttgacaaccacagctcagct

SEQ ID NO: 39937 - DNA, 435 bp, Zea mays
  Clone ID: LIB3062-050-Q1-K1-B12
gaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtctgcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcac

SEQ ID NO: 39938 - DNA, 464 bp, Zea mays
  Clone ID: LIB3062-050-Q1-K1-B2
ctaacatgattctcaccattatatctcaggttggcagtatcaaccatcaattccaacaatacaatattttctagaggatgcgctgatatgcatcactaagctggatcggaagaaactatgcttagtcggtgcaggcaggactgatacaggtgttcatgcatggggtcaggtttaataaacatactgcataactgtatactgaagcttaaattgatatctatcatctggtttgcgtatcctgcactgttaaatgtcaatattatgttttatatgaaatactgggggattacatacaatatttgttggtttcaggtggcacattttactacacccttcagttacagttgcctcagtagtattcattctgcaatgaatggactccttcctcctgagattcgagtcagggaaattagtgcagcacgtcctgaattccatgctcgctcatccacaaagagcaaagtcta

SEQ ID NO: 39939 - DNA, 463 bp, Zea mays
  Clone ID: LIB3062-050-Q1-K1-B4
caccgcaccctttcatcagcctgcctgtccactgttggcttggtgacttcctccgctccgctgccctgcggttccgaaccggcgaaccttgcattgcaacaacaactggctccaaggggcgggcgatcgctggaagcttcctcagccgggttcttaaccgcaagggcggcttggccaggaaggccctgcacgccttggcgtaccacaagaacctggaagacacatgcgcccccggtgtcttcccgacaaaatgatactcgaagccccgagagcccacacaagctctggagcccacaccaaaagaccggcgtgttcgcccccgcggcggtggaccccaatctgacacctggtggcgcgccgcacgccggcgcgaatgctccaaaaggcacggtgctggaccacaaggtgtggttccgcccgctcgaggacgtcgagaagccgccccccgccgcgtgagccgcgc

SEQ ID NO: 39940 - DNA, 395 bp, Zea mays
  unsure at all n locations
  Clone ID: LIB3062-050-Q1-K1-B5
ctataacctaccttcagagtgcagctcgcttatttggatcttctatctcttccagtgacctgatcagtgtttcaggggttatccctgaagatgttgtcaagtcactgcttgcagcctgcagatctggtgaatttgacgtggcaaacaaggaagttagcaacattatagcagatggatatccggtctcacagctgatggcacagtttctagatgcgattgttagcgcggatgatattccagatgatcaaaaggcaaggatatgtaaaaagcttggggaaactgataagtgcttggttgatggggcagatgagtatctacagctgctggatgtcgccagcgagactattcgcgctcttttcaacatgnccgcgacgctggtcttctaagagttcata

SEQ ID NO: 39941 - DNA, 443 bp, Zea mays
  Clone ID: LIB3062-050-Q1-K1-A11
caagaacaagtacaatacacccaaataccgatttgttgtgcgatttaccaacaaggacatgattgcacaaatcgtatctgcaagtatcacgggtgatattattcttgctgctgcatattcccgtgagctgccacgatacggtctagaagttggtctgaccaactatgctgcagcctactgcactggtcttcttttggctcgtcgtgttctcaagatccgtgatttggatcaggagtatgagggcaatgttgaggccactggtgaggacttctctgtcgagccagcggaagagaggaggcctttccgtgccctcttagatgtcggccttattaggactactactggaaaccgtgtctttggtgccctcaagggagctttggatggtggtctagatattcctcacagcgataagaggtttgctggcttcaagaaggatgataagc

SEQ ID NO: 39942 - DNA, 444 bp, Zea mays
  unsure at all n locations
  Clone ID: LIB3062-049-Q1-K1-G12
ggagcagagctgaaggacaccgataaaaaaacggttgctcgctgccaccaccatgtcctatgatcagatgctctcgccgcttttcggtgccggcgggcgatcggcgtggagagcggcccagcacggcggcggcggcgacgcggtgacgaggcagatactcaagtgcacgaggtggcagctcgaggagaccaccgacttcgtcacctgcccctaccactactactgcgacagctcctacccgggcgactaccccgccgccgtcggcgccctcgtcgccgccttcgccgcctactgctttctctccactctcgcgttcaccgtcctcgacctcgtgcggngcaacggtagcagcgccttctcgtcgtcgtcggccggcgtcaggggcatcaagaggaagtacctgctcccctcgggcccgttcctgctccctctggtgctgctcgc

SEQ ID NO: 39943 - DNA, 225 bp, Zea mays
  Clone ID: LIB3062-049-Q1-K1-G2
gcaaatttggaaagaaagcattcggtaaagtgacaatccagatcgacagggttgtcatgttggggtgagtcgcaggtgagtacaccctgctacccgagagcaaaagcggccccaatagaaacctggaaattgagttccagtggtcaaacaaataactgcatacctacataatttaggcgccctctgtaagttgaagatcgatgagtttgaatggtttcttggttt

SEQ ID NO: 39944 - DNA, 450 bp, Zea mays
  Clone ID: LIB3062-049-Q1-K1-G3
gggatatcccctcgatccgtaacccacgccggaatctctggcgtccgccgccccatggccctgcccaggcacacataagatggcccctgcgacctcctctatgccatcgacgagtagagaaaaacagtgagcgccatcagtaccaagccatggttgtgagaagctagcatgctccgcgacgccatctcccacctctgacccctgtggactccctcaagcccaagcgcgggacaccttcgcgtgctccatggtcgcgcgcgccaggccttctccatcggtggagcccggcgtagctcccttggccgcggtctgccgtggagctcgccctggcttccgcgacgttctttaccttcggtaacccgctgacgcctactgtgtacgcggcggcaaatggactccatgcgggcgggggcgaaggatctgcgcgaggacacatgtcatccgaaaagc

SEQ ID NO: 39945 - DNA, 362 bp, Zea mays
  Clone ID: LIB3062-049-Q1-K1-G4
cccaaggtcccttttttttctcgatctggaagcgccgcagtagcagccatggacgtgagcggagcaggcgggaaggcgaagaagggcgcggccgggcgcaaggccggcgggccgacgaagaagtcggtgtcgcggtcctccaaggccgggctgcagttccccgtcagccgcgtcgggcggtacctcaaaaagggccggtacgcgcagcgtgtatgcacgggtgcccccgtctacctcgccgtcgtcctggagtacctcgcggccgaggtgctcgagctcgccggcaacgcggcaagggacaacaagaagacgcgcattattccgcgccacgtgcttctcgccattcgcaacgacgaggagct

SEQ ID NO: 39946 - DNA, 333 bp, Zea mays
  Clone ID: LIB3062-049-Q1-K1-G7
ctattttaattcttcatacctgtaccaatatgcaggcaaagcaatactgtcgttgacagaaatgagcgtgataccgacgactatgatgtgtatgatattttagtttgactcttgagttatgcatgaatttaaccccaagctatctagaaaagttttttttccctttgaaattcttctttgctctccttcctactggatcaaattactttttatgacaacaaactgcagctttctctttccttttcttttcctgcttcaccgcgacgataattgtgaaaatattttagctacgtggacatcaattatccacaacatctttgatatttataatat

SEQ ID NO: 39947 - DNA, 360 bp, Zea mays
  unsure at all n locations
  Clone ID: LIB3062-049-Q1-K1-G9
ctcccaagccagtaccgagtcctacgagcagtcgcacgcaagtgtcaagagacgaaacggtggacatggctcgcacgcaatctgccgtagcggtcgccgtggtggccgcggtgctgctgctggcagcggcggcgacgacctcggaggccgccatcacctgcgggcaggtgagctccgccatcgcgccctgcctatcctacgcccgcggcacggggtccggcccctccgcgtcctgctgtagcggcgtcaggaacctcaagagcgccgccagcaccgncgccgacaggcgcgccgactgcaactgcctcaagaacgccgccaggggcgtcagcggcctcaacgccggcaactccgtcagca

SEQ ID NO: 39948 - DNA, 402 bp, Zea mays
  unsure at all n locations
  Clone ID: LIB3062-049-Q1-K1-H1
gacgaggtcgagtacagcccgttccctgtgcccaagcacggcttgcctgtcagattatggagacaggacaatccggtcgtcgacagaaaggggcgtgagaccgacgacgatgatgtggaggatattttagtttgactcttgagttaggcatgaatttaaccccaagctagctagagaagttttttttccctttgaaattcttctttgctcgccttcctcctggatcaaattacgttggaggacaagaaacggcagctttctctttcgttttctttgcctgcttcaccgcgacgataatggtgaaaatatgtaagctacgtggacatcaatgatccacagcatcgttgatatatataatatagagagaaaattctctgcacggtcaatgcagntctatccggt

SEQ ID NO: 39949 - DNA, 436 bp, Zea mays
  Clone ID: LIB3062-049-Q1-K1-H10
cgattctgtgctgtttgatcatgatctggagagctatgcactctatgacactaatggacgtgaagtaccacaggagttggtagaaaagattgggaaggtgtttgagaccatactggaagagactggcaaattgagggaaggaaccaatgaagatatgtctatcgcaaaggccattgcaattgttatggatagaaatccacagttgaggcaagaagggattgctcatgaagttcttcagtggtatttgtgccgtatggagggttggtttgccactgacgcagattcaatttcactacagggctgggatcaggaggtgctgcttccaggtggccatggcctcatggttcgtggatatcgtccagttataaatactcttgcaaaaggcttaaatatacgccttaaccataaggttgtggaaattgttcgccaccggaac

SEQ ID NO: 39950 - DNA, 375 bp, Zea mays
  Clone ID: LIB3062-049-Q1-K1-H12
ggcaatattcctgcaagagcatgataacattagcgcttttagctatgacaatgttacacctggacgtgcacatgagttagatgaaaagatttggaaggtgtttgacaccatactgtgagacactgacatattgagggaaagcaccaatgaaaatatttctattgcaaaggccatcgcaattgatatggatataaatccacaattgaagcaagaacggattgcttatgaaactcttcagtacgattcgtgccgtatggaaggatggtttgccactgacgcacattcaatttcactacagggctgggatcaagaagtgctgctttcatatggccatggccttatggttcgtggatatcgtgcagttataaatactct

SEQ ID NO: 39951 - DNA, 344 bp, Zea mays
  Clone ID: LIB3062-049-Q1-K1-H3
acgtgagtcctccttttccgttaaaggcaccagccaggaccagccaggaggcgccaaaagccgagcgtgggaaatctccgccgccatggagacgctggccagcgccatgcggcgcgagaaccgccggtccaaggccccgcccttctcctgtgcttcctccgccctcgcctcgggcagggtccctctcgtcatggccttcctctgctgcctcgcctggctctacgtcgccggccgtttgtggcacgacgcgcagacccgggcgatcctgtccggcctcctcgagaagagctctaccagcgtccagaaagtgctctcggtggaagacatgcttaagaaccttgggt

SEQ ID NO: 39952 - DNA, 457 bp, Zea mays
  unsure at all n locations
  Clone ID: LIB3062-049-Q1-K1-H4
gagcacgcgtacggccgcaaggatgatcaccatcatgtggaatcagtgctgcattcaacaaagcatgagtatgggtcagaggcagatgtccatgaaccagagatatttgttgatcatgatgtatacctgccacctgccccaagccatcatgatgctcatggccagttttgctctggaggtattgtattggcttctcgagatggaaagattgtgtttgagagtacacttgacgcaagactagaagttgttttccgcaagaaattgccagagatccggaagcttctttttggccagactgcagcctaatcgactcatctgccgatggtacggctgcttctatgtaatggttgccggctgcacgcctgcactgcagccataaggaactccgcctgtttttgtcaaattgattgtttaaggtattcatcccctatgtacaaactacctnatggttcattat

SEQ ID NO: 39953 - DNA, 295 bp, Zea mays
  Clone ID: LIB3062-049-Q1-K1-H5
ggagtggcggttgccatagtaatagctgctacatgcttgactgttatagttctaaggtctgtgtattttaaagtctcccgaatgaagtatttagatcgaaacggtgctcaaacctttgatccaggaactaacactgctactttaaagcttcaaccccagcctcagtcagggtacctttggaaaggtcctgactttcctgcatatcctgtttctccgtcaactactgcctttgaaagtactcacaaacccgtttgaaattgcccgatctcattttgagaagttgttccattttccc

SEQ ID NO: 39954 - DNA, 447 bp, Zea mays
  unsure at all n locations
  Clone ID: LIB3062-049-Q1-K1-H8
actcgccgctgtcggatcgttctcgcttggggcgatcaagctaacgggatttgaggagaggtaggccagccgcgggcagcagccatcagccatgagcgaggtgttcgagggctacgagcggcagtactgcgaggcctncgcctcgctctcccgcaagtgcaccgctgcatccgccctcgatggagagaggaagaagcagaagctctccgagatccagtccggcgttgaggaagctgaatcgctgattcggaagatggacctggaggcaaggagcctacagcctagcattaaggctggtttgcttgcaaagctgnaggagtataaatctgacctcaacaacgtcaagagtgagctcaagaggatatctgcgcccaatgccaggcatnngctacccggaggaggctctggagtctggaatggctgatactctcgcggtgtctactgatc

SEQ ID NO: 39955 - DNA, 399 bp, Zea mays
  unsure at all n locations
  Clone ID: LIB3062-049-Q1-K1-H9
gaagatggtgaggatgcttcaaatggaagtggtgatgtgtgggacgaatcacttgaggctcgattctgaatggcgtcttgctgcatgaatttggttggacatggatgattatggttgtgaagcggaaggattgtaaatttggtggctaccctgttgaggccattgtaggctcacagcagattcagtaacatcaaaggctactgaaaagttttactgtgcagatctgattcaatatttgtcagttatcttgttgggcaaacatttttgctttgctggaaaattggggagggaggttggtgggggcgccctgcagtttcaaggcaacaacctcagcagtcatcaacggtcgactccatttgtgttctgattgatccttatggggatatctgntattcaatt

SEQ ID NO: 39956 - DNA, 269 bp, Zea mays
  Clone ID: LIB3062-050-Q1-K1-A1
accagcctgaataatctgttgcaacacctaagaggttgaaaattaaccaggccaacggcttgagtcggaccctgtcaacacagggtggtcgatgttagagacatggcacaatctcgatcgtgacgtatgagaacccatctacacagggttgtgcttggcgtccatggaatgtttgtttgacttcaccgatagaattgctgatatgtaccatgatttcccagttcatagaatcaactatcaaagaggacaaacagggttggtgatgagag

SEQ ID NO: 39957 - DNA, 314 bp, Zea mays
  Clone ID: LIB3062-050-Q1-K1-A10
ccgggccgacccacgcgtacgatctgttcacctcactaacacatctatcaactctgtctctcctgcaataatgggctctgtgtcctcctcctccaagacgaacatggtcgcagcagcaacagtcctggaagacatgctgctactactggcggcagggcccaatacagacatcccagcggcgagctacgcatacggaacgtccgtaagtggcactaatccaaggcaacgctacgggcagcgaggtatactattccaacaatgtctacaatggagtgaactacttcaacaaaacaaatctctttggatacatacca

SEQ ID NO: 39958 - DNA, 415 bp, Zea mays
  Clone ID: LIB3062-049-Q1-K1-G1
cacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaagaggtcgctgccgcggcggccgtcggcgccggcggctacgtattccacgagcaccacgaggagaag

SEQ ID NO: 39959 - DNA, 271 bp, Zea mays
  Clone ID: LIB3062-049-Q1-K1-E2
cggacgcgtgggtccccaacaacgtcaagtccagtgtttgtgatatccctacgcgtgaccgttccatggcctccaccttcattggcaactccacgtccatccaggagatgttccggcgagtgagcgagcaactcactgctatgttcaggaggaaggctttcttgcattggttcactggtgagggcatggatgagatggagttcaccgaagctgagagcaacatgaacgatctggtgtccgagtaccactcctaccatgatgccactgctga

SEQ ID NO: 39960 - DNA, 336 bp, Zea mays
  Clone ID: LIB3062-049-Q1-K1-E3
acgcccgcgggcgccacccctacgctatcgagggtggtgtccttggacctatcaccacaatgcgagaacgctcgcctcggacttcttggggtctttcgctggtgctcgtacgatgttggggctctgaacgtagcagctgctgagttggtgggtcgaccgacgacatgaggtcttcggaggaaactctgcttggttggtaccaggcgagcggtgacgacttttagatgtcgactatccttcttgaaggcgcggcccagaagacctctagtctgtgtgttcgtcggcgttgtggaggctctatgtcactccgattgtctcggacgtgtcggcgtcatt

SEQ ID NO: 39961 - DNA, 322 bp, Zea mays
  Clone ID: LIB3062-049-Q1-K1-E4
ggccggtccagcgaggacatgctcaggccgtcctgatccggtccagcgaggacatgctcaggccgggatcagcttgctttcttgatgtttggtctggatcggtggagatggaggccgtcgatggatcggagtcagggagaggcttaaattcttgttgtgtttttttaacaagggactggccttgttacaactctgctactaggctggagcctggagggagggacgatgatccatcagatgggctatgttactctgtagatcatctagatgttaattaggtctcttgtgcaatgcagctcatccaattagcatcttatttcac

SEQ ID NO: 39962 - DNA, 459 bp, Zea mays
  Clone ID: LIB3062-049-Q1-K1-E6
cggacgcgtgggtccgaatccaatcgccggagggaggaagccaccggtggacgcagtgagggcggcggaggtagaggcaaagggatgacgcgcgggaagcagaagatcgacgcgcagcggcgtaacgcggagcgaaaccagaaatccaaggggtctcagctcgaggcccgcgccgtcggcctcaagatcgtctgctccatctgcaaggtacaattggcaaatgaaaaacagctgaccgatcactatggatcaaagcatccaaaggagaaacctccgagcacatcgagcaccgaataaccatggctggtcgtgacgcagaaatatagatcctgcttggctggtttgaggatctttaagtccgtctgatccatgcctgggacctcaacgtcagttatatactctctagtgtgtgcattttctcttgtttcaggtattgtgttgtcgtgctgccaatgtgtc

SEQ ID NO: 39963 - DNA, 469 bp, Zea mays
  Clone ID: LIB3062-049-Q1-K1-E7
cgagtacccaacgcgctagctagttctattgccgcaccccagatctccaggagggactcgttctttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgaggtcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgcccttccggaggacggcacgatcttggccatggacatcaaccgcgagaact

SEQ ID NO: 39964 - DNA, 387 bp, Zea mays
  Clone ID: LIB3062-049-Q1-K1-F1
cataactatgtcaaataacataaatggagaggaccaacttgatggcgctgatgaggttaaagaggttaaaaggcgtgggaagacaaaacttattaatgtttggaacattccaagaggccatagggttgtagttaattgtaatgagctgaatcagcctatcggagaagaggcaggagtccttgcaaaattccttggcatggttgctaagaatggctccttgtgtagcttaagcttcaaggattggagactacttataggaaagaaagataggaaccataaacaaatcaataaggaggccattcttaatcaagtaaagaagagatttctttacccttgccggacggaaacatgggtgctgcgaacaatttgagagagatggaggcaaca

SEQ ID NO: 39965 - DNA, 158 bp, Zea mays
  Clone ID: LIB3062-049-Q1-K1-F10
gactggactgcactcaaatacttaatcaaattgtactataacaagtctacaatccatcctggagatagtgacaatttgcatgatcttataactgctataacagatttcacatcactagccacttagcatttgcactgatttacacactaatcctaaac

SEQ ID NO: 39966 - DNA, 430 bp, Zea mays
  Clone ID: LIB3062-049-Q1-K1-F11
cccgatccagctacatccgttgaggcccgtgcgtttcttccctgttctcccatcaatcgacctagccttacgccgacgaggggcttcctctaatcgatctggtgtctgttctgtggtattggtctgggtgcactccagggccaggagcagctagccgtcttcgttcgatccgttcgcaccccccaacgcggttcgatttgcaggaaggagcgtgatggccaagacgagctcgttcaagctggagcaccccctcgagaagaggcaatctgaggctaaccgtatcagagagaagtaccctgacagaattccagtgattgttgagaaggctgagaggagtgatattcctgacatttacaagaaaaagtacctcgttcctgcagatcttacagtcgggcagttcgtgtatgttgctaggaagagaatcaagctc

SEQ ID NO: 39967 - DNA, 125 bp, Zea mays
  Clone ID: LIB3062-049-Q1-K1-F12
atgaagcttcatgcatggaagctcgagcatatctttcaagatttggcatctagctacctacacttactcctaggatcagactctattaatggatgtcgtatccgtcctgcgatctgtgtctaaat

SEQ ID NO: 39968 - DNA, 352 bp, Zea mays
  Clone ID: LIB3062-049-Q1-K1-F2
ctcttcttcacctcactaacaccagctagcaactctttctctcctgcaataatggccgctcgctcctgctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagca

SEQ ID NO: 39969 - DNA, 454 bp, Zea mays
  Clone ID: LIB3062-049-Q1-K1-F3
gcttcttgactgggtgaaaggactgctgaaggagaaaaaggtggagatgttggtggacccagatctacagaatgcctacgaggagatcgaggtggagaaccttatccaggtggcactcctctgcacgcagggctccccgttggagcgtccaaagatgtcggaggtggtgaggatgctggaaggtgacggcctggcagagcgttgggacgaatggcagaaagtagaggtggtgaggcaggaggctgagtcggcaccgttccgcaatgactggatcgtcgattccacgtacaaccttcgtgccgtgagagctgtccggtccaaggtagtagccactccatgactccgaagaaagaattcaacactgaatggcctagattcagtctaatcgctgcttgtgtatatgaaaggtagcttttggaattgttagcgacagtcaatatgaagggatgttttt

SEQ ID NO: 39970 - DNA, 189 bp, Zea mays
  Clone ID: LIB3062-049-Q1-K1-F4
gaccgcacgcttactccaaattttaaaaaactacattcatctaatttacattccagatctacatccttatcatgtgtatgtgttatcataagatcattcaccctgttaaactacatcataaccttccccaatattaacccttaaatccttttcctattcacaaacaaataactgtatacctacataatt

SEQ ID NO: 39971 - DNA, 419 bp, Zea mays
  unsure at all n locations
  Clone ID: LIB3062-049-Q1-K1-F5
caaggaaacaaccaagcacatacgctttcccatttgtcaaacatgatgcaagcaaatcctgtgagcactagtagcctattggcgtcaaatcaaaatcatccatctcttcatggcttagagtttgatttgccttatcttgaagcaaaatataacgcatgcacgactactaatcctagaccagccatatccatgcaggaggccctgaaagcaggggttttctccaacgctcggtctacgcagtctcttccaagtactagcattccgacggggcatcctctccctcagcaattagcacatcacccttactctcagccgactgtagcacccatcacacatttcccaaatatcgntggctatccgccgtatttgccacaaaactatgctgcttacctatcttcgggcacctttcagcangcata

SEQ ID NO: 39972 - DNA, 302 bp, Zea mays
  Clone ID: LIB3062-049-Q1-K1-F6
gcctctgcctcgaaaactcttactcgcggcgctgcagccaggggggcgaccggtgtgtgagccgctgccgctatggctgctgcttccgttccgccaacatcttcctccggtggctgggacttcacctgtaacctcgaagtcgattatgggtctgaagaacatgcatacatagtctacagaacgtatgcatgcgacaaggacttgaagcctgacaaggttaacacgctcatgacactctcatgcttcaagctgctagtatactgactagccatgcagtccctcatccatcaagccatcatcat

SEQ ID NO: 39973 - DNA, 421 bp, Zea mays
  unsure at all n locations
  Clone ID: LIB3062-049-Q1-K1-F7
caagaatttgataatgtgaaggatttccgtgctcaattgtgcaaatatgccattgggaaaggatttgcgtaccggttcattaaaaatgaaactactcgtgtcacggtaaaatgtgttgcagagggctgcacatggcgaatgcatgcatccgagtcatctcgtaacaagaaatttgtgatcaagaaaatgacagatgagcatacatgtggaggaggaaatggagaaggtcagcgtcgagcgacaagacaatggctgaccactgttattaaggagaagctgcatgataatccgatgttgaagccaaaggaccttgtcaaggaaatatatgaacaatatggagttacactgacttattcacaggtctggcgaggtaaagaagtagcacagaacgaactgtatcatgctatcanggagacttaca

SEQ ID NO: 39974 - DNA, 462 bp, Zea mays
  unsure at all n locations
  Clone ID: LIB3062-049-Q1-K1-F8
cagaagattcgacgttccacgggctccggcggcggcaggaacgcctcccgatttcgacggcagagcgagagagcgatggcgctgactaacttcatcgtgacggtggccgtggttggcgcgggggtgcttctcttcaccaccgacatccgcaggtctggcgccctcttccgccgcaacgcgcgccagctccggcagtggctcgaggaggacacggcctccgccgcgtccaagtctgcaaaagaagcagctcaaaagaaactcgactcgacggtccccaaggagaagcaaaaggaagatagccactgattggagctgtttatatgaacggtataacccctatttgaagtcgttcaagttctgttttctacagttgctgcgatacaaacttgtagctctcaagtaaggtgcacggcaggattatgtntcccgtttaacatcngnctctgtggaacagctagctaa

SEQ ID NO: 39975 - DNA, 396 bp, Zea mays
  unsure at all n locations
  Clone ID: LIB3062-049-Q1-K1-F9
gcactttcactctatcatcacttaccaggctactagcataacaagtcgccaatccctcctcgagagagtcagaaatggcatcacctcatagctgctttcgcggctggcagagcacgagccacgtcgcagttgcgctggtgtccgtgctgatcctgagctcggcacgtctctccgcgggcggcaggagcctgctggagctgtacaagccgccggccagcgcgctcctgacgtaccacaacggcgccgttctgcagggccgcatcccggtgtccatcatctggtacggccgcttcacgccggcgcagaaggccgtggtcaccgacttcctccggtccctcaccaccgccgccgnctcgccgncggcaccgtccccgtccgtgtcgcagtggtggagca

SEQ ID NO: 39976 - DNA, 165 bp, Zea mays
  Clone ID: LIB3062-049-Q1-K1-C4
gttctagatcgcgagctgtcgcccttgtttttttttttttttgtgtacatttttcaaaaatgaatggcacaagccatcgatagattgattcatccactgatgacgatacatgcttctgggcttagtttacatcgaccgttttcagcaggcagccattgacattga

SEQ ID NO: 39977 - DNA, 470 bp, Zea mays
  unsure at all n locations
  Clone ID: LIB3062-049-Q1-K1-C5
ggagctcctgcgatgcccccatctcccctcccctccccatctcgctctcgcggagatcgaagagaagctgaggcctagcgccgcacccgccgccgcatcagccatcagccatggcgctggccgctcgcctcgtctcacgctcccgtcagctacattcggttcaagcagcttttgcgaatggaggtgtcactcaagttcgctcctttgccaaggatgcagctccagctgaccgtcctcctgttagtggggatgatctcctgaagggcatattctttgaggtaaagaagaagtttgagacagctcttggcgtccttaaaaaggaaaagatcactattgatccagacgacccagcggcagtttctcaatatgcccaagtcatgaagactgtaagggaaaaggcggatcttctntctgattctcaaaggattaaatataccattgagaccttcacaggggcatncctgatgcac

SEQ ID NO: 39978 - DNA, 248 bp, Zea mays
  Clone ID: LIB3062-049-Q1-K1-C6
ggagctcctgcaatgcccccatcttacgtttcctacccatctcgctctcgcatagagcgaggagaagctgaggcctagcgccggacccgccgccgcatcagtcatcagctatggcgctggccgctcgcctcaggctcacgctaccgacagctacatacggttcatgcagctatcgcgaatggaggtgtcactcaagtccggtcctttgccaacgatgcagctccagctgaccggcctcctgttagtgg

SEQ ID NO: 39979 - DNA, 222 bp, Zea mays
  Clone ID: LIB3062-049-Q1-K1-C7
gtgaaaccactgataaagaaggctattaattcaatgcaaactcaatcagccaagcggaaacgctacattcccaacggtcacgttgctataaacatgatccaccacttctctatcgactagaacatcgacactattcacatgtagcttgagaacaataactacttctacctttgccataaactgctcgactaccagactatgctcttcaaagaatgcatcatc

SEQ ID NO: 39980 - DNA, 219 bp, Zea mays
  Clone ID: LIB3062-049-Q1-K1-C8
gatagttctagatgcgagcggcccctttttttttttgtgtacatttatatatcttgggaggcggtgtgtaaagattaaggggggtggaataatcggttgataggcagctggaggaaattttgtaggcagctggtactggcaaatatgctttgtagcacggcatcatatgatcaaacgggtcactaagaagagtgcagtgccatttatatcattgtatgt

SEQ ID NO: 39981 - DNA, 410 bp, Zea mays
  Clone ID: LIB3062-049-Q1-K1-D1
ctcgttgacatccccatcatcggccgcgtcaagatcccgatccagaaggacggcgagatcgccatcgcttacaagcccgacgtcgacgtggagaagatcaagttccaccacttctccttcgaggagaccaccgccacgctccacctcaagctcgagaacaagaacgacttcgacctcggcctcaacctgctcgagtacgagatgtggctcggcgacgacagcatcgcctccgccgagctcacacagaccgccaagatcgagaagcaggggatcaccaggatgcaggtgcccttcagcttcaggcccaaggacttcggatccgctgtctgggacatgatcaggggaaggggcacgggatacaccatcaagggaaagatcgatgtcgacactcccttcggcaacatgaagct

SEQ ID NO: 39982 - DNA, 434 bp, Zea mays
  Clone ID: LIB3062-049-Q1-K1-D10
ggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgt

SEQ ID NO: 39983 - DNA, 347 bp, Zea mays
  Clone ID: LIB3062-049-Q1-K1-D11
ggcagggtgaggctccaatcgattgagactcttctaaccgagtatgaccaccctgacaaaggagatgcgctgtacgctattttgctcactctggccctggaaaagctgctcaatgaaaagctgcacaacctacatggtgtggcaacaaggtgcaatgatcctcagctgacagacttcatcgagagtgagttcctcgaagagcaggcggaagccataaacaagatctccaagtatgtcgcccagctgaagagagtgagcaaggcgcacggggagtggcacttcgatcagatgctgcttgaccaagatgcctaaaaagaagaacggacagatgaatgaaggaaacaagt

SEQ ID NO: 39984 - DNA, 437 bp, Zea mays
  unsure at all n locations
  Clone ID: LIB3062-049-Q1-K1-D12
gagatgagcaaggaaatcgatgtccagcttagtccagaggagaaagaaagtttagatgagatcatcaaggaagctgagagcgacttggagtctgaggaagtcctggatcaatcccttgccattgttgccaagaatgaaggtttggacaaggacacaactacaaaactcacaatttacactgtaggtggtgttttgaagaatctgacagagggccccttgagtgttatggataagcacatatatgcaggacacactgtcaaaccatttcccagcctgattgaagctggaaagactggttgtttcatcatctcaaatatatttgctaaaggtgttgaggctggagtggtgtacaccggcaacaacaaaaataaagttccatgtgcatggctactttgcttcatcgaanacaaggctaacgtgaggatttatggagagtg

SEQ ID NO: 39985 - DNA, 254 bp, Zea mays
  Clone ID: LIB3062-049-Q1-K1-D2
caaacacaccaatgtccatctgacctttctatagctcttatttctacatctatataatttgtaactgtaacattctaacttacacttgatcgaataatactttgataccaacataaactcaatacattatacaacctttactaccaaatatcctttgttatactttctcatattatcatactaatcactatcaatattacaccaccattcttataaaattacgcatgctttatacttaatccaactcttcttct

SEQ ID NO: 39986 - DNA, 224 bp, Zea mays
  Clone ID: LIB3062-049-Q1-K1-D3
gccagcccgcccgcctgcgcgcatctctctacacttctactgcttcataccctcgtagagggatcccgcgcggcccaataaaaacccgactcgctagctacgctacacactcgcagatggccggcctcaggatgaagttcgtcgccgtcgccgccatggccgccgcgctcgtggcgtccgccgcagccgccgaggcccccgccccggcccccgcctccgacgcc

SEQ ID NO: 39987 - DNA, 455 bp, Zea mays
  Clone ID: LIB3062-049-Q1-K1-D4
ctaaaccagaggaaggtgatgtagatcatcattctgatacttttgatcataacgagaagactgtagaaactgtgttcgataaagatagtactaacctgcatgaagatgacaagagaaacactgagagttcagaagcggaaggacaagtcaacagtggagatagtaatacataagctaataataataagaatgaagatgaaaccaccagtcttgtagaaggacgcatgcatgatactgaatccaactctgctgctgagagtaaaagtgaagtcaattcaactggagatgaattgtatcaaaacaatcatgcacaggaggacaacactagggaggcaagtgtaatgtctcatgatgaattagcgcatggtgacgaatcaaccagtgcatgtggaacttggaatggatcatatggagaaggttagaaaagggggcagttgatactcaaactgattatg

SEQ ID NO: 39988 - DNA, 437 bp, Zea mays
  Clone ID: LIB3062-049-Q1-K1-D5
ctgaccaatagaaattgatttcacacctgccttcagaaggattgatatgattaaagatttggaggctatggcgcaatcgtcaatataccaaaagatctagcaagtgatgaagcgaatcgttacttgatagaagcatgtgctaagtatgatgtgaaatgtccacctccccaaacgacatcacggttgcttgacaagttagttggtcatttcttggaggagacatgtgtgaatccaacatttatcatcaatcatccagagataatgagtccattggcaaagtggcatacgtctcgacctggattgactgagaggtttgagctattcgttaacaaacatgaggtgtgcaatgcatacacagagttaaacgatcctgttgtgcagagacaacggtttgaggagcaactaaaggatcgataatctggtgatgatgaagctat

SEQ ID NO: 39989 - DNA, 253 bp, Zea mays
  Clone ID: LIB3062-049-Q1-K1-D6
aaaccaaatgtaggtgatgtatatcatcatttggatacttttgatcataacgagaatacggtagagactgttttcgatagagataggactaacctgcatgaatatgacctgagaaacactgagagttcagaatcagaaggacaagtcaacagtggagatagttatacagaagctaataataataagaatgaatatgaaaccaccagtctttttgaatgacgcatgcatgatactgaatccaactcttctgctt

SEQ ID NO: 39990 - DNA, 199 bp, Zea mays
  Clone ID: LIB3062-049-Q1-K1-D7
tcggtcttgaattcccgggctgaccaacacatagtgatttcacacttgccctcataagtattgattttcttcaagatacccacgctaagagcaatggctctataccataagatctaccctgtgatgaatacgcatcacaactttatataaccatctctctaaaaatatatttaatctacacctccataaaccacatcac

SEQ ID NO: 39991 - DNA, 316 bp, Zea mays
  Clone ID: LIB3062-049-Q1-K1-D8
cagcaaaacgcttggaggccacagagaggactacctgaaaattcagtctcgattgtccgggcttggctttttgaacatttccttcacccgtatccaaaagattctgaaaagctaatgttatcgagacaaactgggttgacaagaagtcagatttcaaactggttcatcaatgcccgtgtccggctgtggaagccaatgatcgaagacatgtacaaagaagagattggtgaagcggagctagactccaactcttcctccgacaacgggcagcgaaacaaggacaaagcaccatcttccgaggaaatgaggacctgca

SEQ ID NO: 39992 - DNA, 445 bp, Zea mays
  unsure at all n locations
  Clone ID: LIB3062-049-Q1-K1-D9
gtgcttcttcgtgaaaccttgaaagatgctgacctcgacaaatatcgtgttgttgtcatgggtgaaggacatgaaagatcactcaacactgatgttttgtttggtatactgaagaaggttgttgcacgtagacgggattttaaactaatcgttacatctgcaaccctaaatgctgacaagttctccaagttcttcggaggtgtgcctgtattccatattccgggtcggactttcccagttaacattatgttcagcaaaacaccatgtgaggactatgtggaagctgcagtgaagcaggccatgactatccacataaccagcggccttggtgatatcctaatcttcatgactgggcaggaagaaattgaggctacctgctatgcgcttgctgaacgcatggaacagntaatatcgtcattcaccaagactattcccaagctagaga

SEQ ID NO: 39993 - DNA, 423 bp, Zea mays
  Clone ID: LIB3062-049-Q1-K1-E1
aaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtg

SEQ ID NO: 39994 - DNA, 254 bp, Zea mays
  Clone ID: LIB3062-049-Q1-K1-E10
aacacaattattccttgtcgattgaacaatagtttacatcagtgtacaaaccgaaaaccagtgtgcgctcacatgcatccggacacctaaaggtcacctgcagcgccttcctcacttgccggcgacaaagttcgtggcatacgcccaaccgttactcttgacggggtacgttatgtggacacccaggtttttaagccggcgacttaccagttaccatagctttgacaaataagccaactctaggcgacatccca

SEQ ID NO: 39995 - DNA, 473 bp, Zea mays
  Clone ID: LIB3062-049-Q1-K1-C3
cccacgcgtccgcacgcggtggacttctacatctccgatttccagtccgggctgcgagcaggggtgagggcaggatccggcgcgcgcgtgaccccatacgtggacgagtccgtcgctatcgacgtaaacccagacaacaaggacatgtcgcctgagttcctccggtggctccgcggaaggaatctgtcgagcgacgaccggactatgcgcctcaaagaaggatacatcaaggagggcagcaccgtgagcgtgatgggcgtcgttcagaggaacgagaacgtgctgatgatcgttcctccagccgagcccatctccactggctgccagtggggcaagtgtgtcctcccgaccagcctcgagggccttgtcctgagatgcgaggacacgtctggcctggacgtgataccggtctagctagagagggtggttctggcgaatcctctggcgcggaaagggagtagaaaaaaaaagat

SEQ ID NO: 39996 - DNA, 468 bp, Zea mays
  unsure at all n locations
  Clone ID: LIB3062-049-Q1-K1-A7
cggctgcaggccatggaggcgtcgacggcgcggcattggctgaaaacatcaaagcgggcagggcggcggccgagcctgaactgcgctcgcctggcgacgcagctgggccgggtcacgccgtgccgtgcacagatagaatggtacaaggcgctgttcgacgcagagatggggtactacgacgcgttcaagcagcggcggtcgcccaggaagtacaccaaggtgaacttaaaccgcatcaagctgggccagttctgggaccgagtgctgagcatgctcgacgccggccagctcccccacgatttccaccgccgcgccaagtgggtcaacgcctcccgcttctaccagctcctcgtcgagcctcttgacattgccgactaccaccgncacggccaccacctgacgagcgggagctacatgactcacggccgggagaggaagtacgagctgttcgacaggtggtggcaggag

SEQ ID NO: 39997 - DNA, 381 bp, Zea mays
  unsure at all n locations
  Clone ID: LIB3062-049-Q1-K1-A9
aagagcccgcggaaggtgcgcatcaggttccgcgacgtcctggacacgcgcgacctcggctacacgtacgacgccgagtccgacaaggacctgccatggctgcgctgcaagatctcgtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggggaaggagcagctgctggtgatcgagggcatcgagtacgacccccaggcgaacaataagttcgacgtcgccatcaacctgcccgcggacaaagcgttgcangtaggcccacagtacaaggagtac

SEQ ID NO: 39998 - DNA, 293 bp, Zea mays
  Clone ID: LIB3062-049-Q1-K1-B1
tcgaccgacgcgtgcgctcactcttaatccgccagtcatttcttgttcctcgtatgtggagttgtcttgcgggtttggtagatccaggacaaagcctggaagaagcagtgagacgagaaacatgggaggaaactggtatcgaagttgggcaagtcgtttatcacagttctcaaccatggcctgtttggccaaatactatgccgtgtcaactgatggtgggcttctttgcttatgctaaatcattggagataaacgtggacaagcaagaacttgaaaatgcccattggcacaac

SEQ ID NO: 39999 - DNA, 431 bp, Zea mays
  Clone ID: LIB3062-049-Q1-K1-B10
caggtgctgaatatcaatccaaagatcttggtctactagttgaggatacaacagtggagcagcttggcatagctcggaaagttacaatctcaagttcctcgacgaccattatagcagatgctgctagcaaagacgatatccaggccagaatcgcgcagctgaagagagagctttctcagacggactcgacgtatgactctgagaagttggcagagagaattgcaaagctttctggtggagttgctgtggttaaggttggagcatcgaccgaggcagagctagaggaccgcaagctccgcatagaggacgcgaagaatgcgacttttgcagcaatagaggaaggtattgttccaggaggcggtgcagcgtatgttcatctatcgacattcgtgccggctatcaaggagacgttggatgatcctgaggagcgc

SEQ ID NO: 40000 - DNA, 279 bp, Zea mays
  Clone ID: LIB3062-049-Q1-K1-B11
atcccgaaggctaggcgttgaaacccttaactctattacacctcgaatcagcactaggagggagagtgttagttgactcaggaggcatctgacgtaatgaaacttaacttctagaccctgatggtcaccaactctatgatcaaggctagatcccatacctcaatagattacgttattaggctcactcaaactattgcatgtcagagtacctacacagaataccatcccatgctcatatactatgggtaaattctgatggatgataccacttagcaaagc

SEQ ID NO: 40001 - DNA, 180 bp, Zea mays
  Clone ID: LIB3062-049-Q1-K1-B12
tcgatcctgaatgacacgctttctaaccctaatttctcttatatctcgaagctgcccgaggagggggagtgttagcatactcactaggcggccttcgaaaataacctcaacgtcattaccctgatgggcaccaactccgatatcgaggcgaaccacgatccccttactgaaactttacaa

SEQ ID NO: 40002 - DNA, 154 bp, Zea mays
  Clone ID: LIB3062-049-Q1-K1-B2
caatatgctgactttccttcatccgcacattcacgagctcctgtgcaaccgaaccactaacacggagcacaagttcgttcttaactacacgaacaagccaatcatcttctccatttctcgcctcgaccatttcaacaacttgacttttcttttt

SEQ ID NO: 40003 - DNA, 348 bp, Zea mays
  Clone ID: LIB3062-049-Q1-K1-B4
cacacacacacacacagacaagtggtttccaaagccaagtgtgtgtactagcaaccagctagctcgggcggcagcaggcagccatcatgtctgatgataagcaccaccacttcttcaaccaccacaagattgacgaggagcagcccgccggctagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgatgcgaagaaggaccccgagcacgcgcacaagcacaagatca

SEQ ID NO: 40004 - DNA, 434 bp, Zea mays
  unsure at all n locations
  Clone ID: LIB3062-049-Q1-K1-B5
ggcactcttaagccgccagtcaagatttgtgcctcgtatgtggagttgtcttgctggtttgatagagccaggagaaagcctggaagaggcagtgagacgagaaacatgggaggaaactggtatcgaagttgggcaagtcgtttatcacagttctcaaccatggcctgttgggccaaatactatgccgtgtcaactgatggtgggcttctttgcttatgctaaatcattggagataaacgtggacaagcaggagcttgaagatgcccagtggcacaaccgcgaagatgtcaagaaagcgttaacgtttgctgaatacaagatagcccagagaacaagtgctgccaaggtcgatcagatctgcaagggcgctgagaaagggaagagcccctctgccgacttcaaagttggaagcngcgagcctgctccaatgtttg

SEQ ID NO: 40005 - DNA, 182 bp, Zea mays
  Clone ID: LIB3062-049-Q1-K1-B6
gtcactcttaagccgccagtcaagattagttcctcgtatgtggagatatcttgcgggtatggtagaaccagaagaaagcctggaatttattttttcactagaaacatgggattaaactagtatttatttagtacaagacatttattatatttctcaactatggttctgttaaccaaatacta

SEQ ID NO: 40006 - DNA, 464 bp, Zea mays
  unsure at all n locations
  Clone ID: LIB3062-049-Q1-K1-B7
ctagatcgcgcgcgtcctggacagcctcgtctgcccagcaggcccgcccccgaagcaggcgcaggcgcaggcacaggcacaggcgtcggagaagccgtccaccacggcgccgagctatgtcagcgagtacgtcggcctacgaggcggcggcggcggcagcgccctctcctgcaccaactcgtcgagcgcgtccgacgccgagctcttcatgaagtttggcgaggtgatctcgcggagcacggaatagtccaatagatggatcattttgtgttacagtttacaataggtgtctgccgccctgtgatgtgatgtgactcgctgtaaatatcctgctgccttctcgttgggactccactagggactagtagctattnttctccgttatgcacgtctctctctntnttttgctgggaaaatcgaactgtaactaaacgaatggatttatgtgcaggctgcgtttactg

SEQ ID NO: 40007 - DNA, 299 bp, Zea mays
  Clone ID: LIB3062-049-Q1-K1-B8
cgtctcgtgctgatagataggaatgggactcttcattagcggcctgccgatctattggggcaccatagggcaaccacgcttaaccgatgatgcggcattactcgttgctctgattattcagcattcgcctctgtcttatttctagtgctctactttgctgcgtatattaccatctttggtaggactgtcggattaaatccagaacctgtataacactcgggaaagtgtgcctaagacctgatgggtacctggaatggtaaaggtcgcgcgaagtggattccagcgcattggacattgct

SEQ ID NO: 40008 - DNA, 428 bp, Zea mays
  Clone ID: LIB3062-049-Q1-K1-B9
caaggaacatacaaccaaggaatgggttatatgcaacctcaggtgattgacaaaaaaattcttggtagttgttatttgttgtttatttgtgtttataagcacaatgtatagcttgggtccctgctgtatttgtttatttactaggctgaaaacttgaacatcttggattggcagattagcacccttaatttattgcaaatttgcaaatcagttcacagcatttgcctagctgtaatgagtattgattaggtgcccccacaacaacttgctccttgtgcttaccggtcgtgactattgaggtgcccccactaacaattttcagtattggttggttccacttccataatgctacctccatatgttaagttttttgttcatctatgactataaatggttttttaatcacactgtggttggcattcatatgt

SEQ ID NO: 40009 - DNA, 442 bp, Zea mays
  Clone ID: LIB3062-049-Q1-K1-C1
acgcgcacgccacgcaatgggccatgtgccgccaccgcccttcctacggctctcatgtcggcccgccgctatcggagcccggaccacttcgcatacctcctcaccgcgccacgcacccgcctgcccacggccgtcctcctacccacagcgtccgccgcccgccggctagcgcgtctccccgcgcgcggacgcggcgaccgggacgggggatgtggaggcgctcagggccggggtgtccgtgtacaagccgcggtcctacgacgtgctcgtcaccgacgcggctcgctccctcgcctgcgccatcgacgacggcaagacccggctcgagatcgaattcccgcctctgccaagcagcatctcttcttacaagggctcctcagatgagttcatcgatgccaacatccagcttgctctcgttgttgctaggaagctcaaagagctc

SEQ ID NO: 40010 - DNA, 430 bp, Zea mays
  Clone ID: LIB3062-049-Q1-K1-C10
cgatattggagaagaagactgatgaagagcgcaaactttgtagcagagtagaagatcttgaattgcaattgaacaaagagaaagatgatttccaaaggatgacctccaaaaccaaaaagctaatcaaagcacatgggcgttatataaaagcacaggaggatttaaagaggtctcaggctcgctttgagaggctagcagatttgcttgcttcagatattttgaagccttataccaaggagcagggttccatcggtattactgccaatgacgatccatataatgctaatgaaatgagcccaagcgaccaaagacaaaaccatgtttcagcatcgagaaagagacctatttccctcccaagaagtgaagaagcataaactggtaagagacagagagagaatggtgatgatatgattccaacaccagataacta

SEQ ID NO: 40011 - DNA, 284 bp, Zea mays
  Clone ID: LIB3062-049-Q1-K1-C11
gccacgcgtccgcagctcgctagctagcattctagctggtgcggctgactcttcgttcggagtcgccatggaggagaggcggaggccccgcgagagcgccatcgtctggaggcgcacgtcgtcgcgcgcgaactgtgctgcgctgcgaccaaaggtgccgcagctgcgccgtctcacgccctgcagctagtaggcgctcgaggggaccctgcttatccgcacggccgaatacatcgtatggatacgaactagggtggatcttctcagggcaataacatccgtct

SEQ ID NO: 40012 - DNA, 329 bp, Zea mays
  Clone ID: LIB3062-049-Q1-K1-C2
ggcgctcgcgcggacggagccatggcggacgacgattacaacgaaatcgacatgggctatggggatgagcctccaaaacctggaatggaggaaggggccgaaaaattttttgataacaacgaaaatgcccctgatgatgtcataggtggagagggtgaaaataaggaacaggaaaagaccaagcgtgagcgcaaaacaccaaaatatatgacgaagtatgaacgtgcgcgcattcttggtacacgagccttgcagataagcatgaatgctccagtcatggttgagcttgaagggaaaactgaccctcttgagattgcgatgaaggagct

SEQ ID NO: 40013 - DNA, 421 bp, Zea mays
  Clone ID: LIB3062-049-Q1-K1-A6
ctgtgtgcttcttcttcttgttcctccaagttctggtagctaattaaaggagttgggttgggctgtacagatctccgcgaccacagagcctacctcgccgaccatcctggagcttcagcagtcaccacggcgcagggtgaggaactgaggatgcagatcggcgctgcggcctacatcgagtgcagttccaaaacccagcagaacgtcaagtctgtcttcgatacggccatcaaagtggtccttcagcccccacggaggatggaggcagtgcctgccatgaagaagaacaggcgtggctccggatgctctataatgaaccttgtgtgtggcagcacatgtgctgcttatggagtctactagaacactgaaccggaagggaagtgaaggcgtgattcatggcgagtaatgcgctgtggcaact

SEQ ID NO: 40014 - DNA, 483 bp, Zea mays
  Clone ID: LIB3062-040-Q1-K1-C6
caagattggactcgttctccacctcacaaggaagtcctgtgtcaactgagagctctatattcgagatcagtaaaaacgtttggaggtccagtgcaccaacaactgtatcatccaattttctgactagtacagaggtgaaaatggctggcggagctgctggagaggatagagtccaagctgtgtgctcagagaaaaatggatggctgatttgtgggatatatgatgggtttaatgggagggatgcagctgattttcttgcagtaactctatatgataacatagtgtattacttgtacctgctggagaatcggataaagcaacaaaatggtctatacaattcatcagaaagctctctcgatggtcttaaaagtgagttaacactagccatgagaaactcagaaaatgaagacataaaattttctgaaacatttcgatctggcgtgctgaattgcctttctactgctgttgagcaagccgagaatg

SEQ ID NO: 40015 - DNA, 309 bp, Zea mays
  Clone ID: LIB3062-040-Q1-K1-C7
cggtcttgaattcccgggccggacgacactttctctcaacctcagatcaaacacctgcttcattttagagctctatcttcgctaacataggatccgtgtcaaggatcaatgctgcagggatctgatcattcaatctgattaccagtacagtgcagaaactgttttaagaactttatctagagcatagactatctaaatctgtactaaaagatacacggatgtcacatctgcggaatataacattatcgttcttttcacgcatcactatataatctcatagtgagtctatactagtacataacgtcttac

SEQ ID NO: 40016 - DNA, 450 bp, Zea mays
  Clone ID: LIB3062-040-Q1-K1-C8
gtcggatccggtattcccgacggagatccctgaagatgggaaacccacaccgccggtgcagactccgggaggagacgccacgccgccggtgatgccagtgcagaccccgttgccgttggacgggatgccgctgacggcaatggagtaccgttccttcttcgagaacccggacatgaagcctgaggcacaaatcatcatgaagctacaagatttggatgggtggaagtacttcggcaggaacatgttctggctgggtgtcatcggcggcggcctcatcctcctgcacctcctcaccctcctctacttcaagctgaggtacagagacagggagcggcggcggcatggctacgccgcactgcttctccccaggctggagatcatggtcgtcgtcctggcgatgccgtgcgtcgcccaagcggcggcggcgctcatcaggggcgggaccacgtg

SEQ ID NO: 40017 - DNA, 411 bp, Zea mays
  Clone ID: LIB3062-040-Q1-K1-D1
ctctgattggcaaggaccctacagcacagactgagattgataacttcatggttcaacaactggatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtg

SEQ ID NO: 40018 - DNA, 358 bp, Zea mays
  Clone ID: LIB3062-040-Q1-K1-D2
gaagagatttggccaatctgcagcttttgttgcgtccactctgatggaatatggtggtgttcctcagtctgcgactgcgataggtcttctgaaagaagctatccatgtcataagttgcggctaccaggacaagactgaatggggaactgagattgggtggatctatggttctgtgacggaagatattctcactgggttcaagatgcacgcacgaagctggcggtcgatctactgcatgcctaagcggccggccttcaagggatcggctcccatcaatctctcagaccgtctgaaccacgtgctccagtgggctctcggctcagtggaaatccttttcagccggcattgcccactatgg

SEQ ID NO: 40019 - DNA, 413 bp, Zea mays
  Clone ID: LIB3062-040-Q1-K1-D3
cgctcaagttcggcgtgtgcgtcaatgtgctcggcctcgtcaaaggcgaggctggcaaggtgccagctgagccatgctgcaacctcatcaaaggccttgcagacttcgaggccgccgtctgcctctgcacggccatcaagggcaacgtcctcggcgtcgtcttcgatgtccctatcaagttcaatgccctcgtcaactactgtggcaagtgcgtgcccaagggctacatgtgtgcgtaagctccgcgcggttacacgctcgtagccgttcgcgtgcgtaattaagcatgcacctgcatggcacacatgtattgtgcgcctgctgatctctcctgtctcatttgtgcaccttaggttctacagtcctagaaccatattccaggcaaattcttgtcagttcacatgtatgggctc

SEQ ID NO: 40020 - DNA, 461 bp, Zea mays
  Clone ID: LIB3062-040-Q1-K1-D5
ccccaaactgcaagtctgccaagagactgaaagcattggtggcgttcacttcggcgacaacgtgaacagaacaaagaagcggatcaaattgggatcaaaatgtatgcctgggacgatttcttgaaagtggggaaggataatcctcgtcaaccttgccctacgcaagcaagtgacatctgcactgtcatgtacacgagtgggacaagcggacagcccaaaggtgtgatgctgacccatgaaagccacgccatgtatgtgaaaggggtggacctcttcatggaccagtttgatgataagatgacaacagatgatgtcttcctgtcgtttctcccgcttgctcacatccttgaccgcatgatcgaagagtatttctttcacaaaggggcctcaattggctactaccacggagatctgaatgccttgagggacgacattgtggagctgaagccgactctactggt

SEQ ID NO: 40021 - DNA, 142 bp, Zea mays
  Clone ID: LIB3062-040-Q1-K1-D6
ccccaaactgcaagtccgccaagtttttgtatgcatagatggccttcacttcacctgcgaagattcacagcaaagaagcgtcgcaaacagagatcacaatgtatacctcaaaccatatctacgaaaatcattatcgataaac

SEQ ID NO: 40022 - DNA, 359 bp, Zea mays
  unsure at all n locations
  Clone ID: LIB3062-040-Q1-K1-D7
cagctcgcgccgttcctgcaagtgcgcacccatcgtcccgcctacgcactgccgcgcaacgatctacgagctgccatggctaactcagcggcaccgggaggaatgaggtcgttcctgcaggccgtgtctacggtcaccgaggaggcgccgacgccactccgcgtcgtccagatggagggcctggctgtactgaagatcatcaagcactgtgaggagtttgcgccagctttagttacaggtcaattgctaggctggatgtcggtagtgttctggaagtgaccaactggttttccgttcactatcagggaagacgatgatgaagcagatgcagatggtgccattatcagctngagatgatg

SEQ ID NO: 40023 - DNA, 300 bp, Zea mays
  Clone ID: LIB3062-040-Q1-K1-D8
aaattgattagtaagctcactgcaacactagctgttttcctagttttcattcatttttgggtctggttattgttatgaaccacggaaagaattttcggttttcgggtatgggtacctcagttatatttggtctggttatggtacttactggtggtgcatgtttgtgtgagtgcttagagtttaggctatggccatcagatcatgtatatgactatatgactgtgtaaaacactgttttttatctgattgtgtaaaacagtgtttttgtatcgtacactattgttttatagattgaagttt

SEQ ID NO: 40024 - DNA, 457 bp, Zea mays
  Clone ID: LIB3062-040-Q1-K1-E1
caagatgctctcataaataactttcaatcttctgaaagattcatttgcagcaaaagttgcacgatggaccacgataactattattgtcggtttctctgattcaattaagtgggaacccttggtagtgattcaattaagtgagaagtgagaaccctcattgtgctatttttttgtttcaggtgatcattcctttcacaaagtatccttacacatcttagttatcaactctgtaagttgaggtttttaggatggcgttacattcctgaaattgtttgaatcctttatgggatttcttcatccttaatcacttgcagatattctttagtgataaaaccattagcttagagtatggaagggttgtgtccagcaaggtttatgacggatagtcttcgctgttatgctgcgtactcgatgtgttgcctttcttctaccattctttggtacataactaacacat

SEQ ID NO: 40025 - DNA, 297 bp, Zea mays
  Clone ID: LIB3062-040-Q1-K1-E2
acgcccgcggccagcacttgcacctacccggtttactacctcatatcgtacggcttatcactatgtctagccttctatcggatctgtgcccaacgctggattataagttccctaaactatctacttcagtcatatattgactacctattgtgcatatcatcaacaacaacgtatttaactttcatcgaagtctacttattgtttttcgacttaacctattacacattaacttcattgatagttctttttaactacctgtataagatctaatgtatgaattactatctaatgaccctt

SEQ ID NO: 40026 - DNA, 234 bp, Zea mays
  Clone ID: LIB3062-040-Q1-K1-E4
ccaagaaggggacaagggcctctcttgagttttggtatgtcagcctcatcatattctcaatgactggactcaacgccaaaaaggggccacaaaaaggatataaaggactcacacccttaaagggccccctagaaaaaaacgcatctatagacacaccataaacaaaatttttctttcctataaacttgacatttaaaaagttctctttgcattgtatatcccacatgtttaaaa

SEQ ID NO: 40027 - DNA, 457 bp, Zea mays
  Clone ID: LIB3062-040-Q1-K1-E5
cactcatggcgaatgtccacctctacgcagtctcagcctgcgcaatcattctatcgctcgcgacctatgccttagccggtgacgccgacatgctgcaagacgtatgcccagctgactacacctcctcagtgaagctgaacggtgttcccgtgcaaagcaaacttttcatgcgcacgactgattcttctacggtctgaggaacccgtgcaacaccaacaacctctcgggctacttactctacggctgtcaacgaggacaagttcccaggcgtgaacacactacgcgtatgcatggcgcgcatcgactacgcgctgggaggacagaacacctcgtacacgcacacactcgccacctagatcatcttaggcactagacagcacgctcaaggtcagcttcatcaccatcggcaacacgcatttcaccaagaccgtaaccaaggacgacgtcttcgtattca

SEQ ID NO: 40028 - DNA, 305 bp, Zea mays
  Clone ID: LIB3062-040-Q1-K1-E6
ccaaaagctatgtaccttgcaagaggaaatcatgaaagcaagagcatgaacaaaatatatggctttgagggggaagtgaggtcaaagctgggtgagaagtttgttgaactttttgctgaagtcttttgttggttacctcttgcccatgtcatcaacaacaaggtctttgtggttcatggagggctatttagtgttgatggggttaagctttcagacattaggtccattgatcgtttttgtgaaccacctgaagaaggtctaatgtgtgaattactatggagtgacccttaacctcagcttggaag

SEQ ID NO: 40029 - DNA, 333 bp, Zea mays
  Clone ID: LIB3062-040-Q1-K1-E7
gaacgaactcttgctccgatcactatctagctgaggtcgacgatggcggctgtgctgaacagcatgaagacgccgcaggcggtggtggccgtgctggtggcggcggcgctgctggcttcgtccgcttcggcggcgatcacctgcgggcaggtggggtcgacgctggcgccgtgcatgccgtacgcgacggcgagggccagcgcgctccacgcgtcgtgctgcagcggcgtcaagagcctcaacagcgcggcgcggaccagcgcggaccgacacgctgcgtgccattgtctcaagagcctcgctaacagcggcaagagcgtaaacatgggcacc

SEQ ID NO: 40030 - DNA, 428 bp, Zea mays
  unsure at all n locations
  Clone ID: LIB3062-040-Q1-K1-C5
ctcatcctccgcgcagccacagccgcgattcccgccgccccgccgcgctcacctaccagccgggccgcggatccctgatgttgagatctgggagctgaagctgaagatctcgcggatgcgggtgcggctgacggagctggagcgggagcaggggctaatgaagcagcaggggaggatgcgcggcggtgacggcggcggcggcgagcacgaccgcgccttccttgcgtcgctctcgaggggcatcggcagcatcaccatgttcggcgggcccgcggcggccgacagacggcgcaagaattgtggcggccggagctcccagtgctccgacggcanggcccgcangcggcagaaggcatccttccctatgactgatgcttcgctgctagcgtcgacagtggaggcgcggcagggcgtgatcgtggatggat

SEQ ID NO: 40031 - DNA, 272 bp, Zea mays
  Clone ID: LIB3062-040-Q1-K1-E8
gctatgcagaggacaagacaggttggatgacagatgaggagtttggacgggagattctcgccggcgtgaaccccatgctcgtcaagcgtctcacggagttccctccgaggagcagtcttgacccgagcaagtacggcgaccacaccagcaccatcagggaggcggacctcgagaacaagctcgagggcctgacggtgcagcaggcgctgcacggcaaccggctctacatcctggaccaccacgacaacttcatgccgttcctggtcagggtg

SEQ ID NO: 40032 - DNA, 138 bp, Zea mays
  Clone ID: LIB3062-040-Q1-K1-F2
gccgcttttctgctgcgtacacagaaacagctctttgctcgctgtcgtggagttcttcccctgttcgatggtcaccgggaggtactgcgacgcgaggctttgcgtgccctccgattgctgcataacgttgcttgatcg

SEQ ID NO: 40033 - DNA, 402 bp, Zea mays
  Clone ID: LIB3062-040-Q1-K1-A4
cccacgcgtccgcggacgcgtgggcaagtactccaactggtgttgaaacacctgatgttatggaccgttctgaagctgcagaggaaggagactgacaagcaagcagaacggccgctgtaccaggttcttgaacaaaaggaagaaaggatagcccctgggactctatatgggtcaagccatacgtatgtgctgggaacacaagataaatcatcagctccgaaaagggtggatctgcttaagaatcaaaagtcagacaaggtggacgtcaccatccaacccgaggaactggaagccatggatgatgttctggcagccaagtatgaagaagctcgagaggaagagaagcttcggaaccaacaggaggacttcagtgacatggtggcagagaatgctcacaagagg

SEQ ID NO: 40034 - DNA, 420 bp, Zea mays
  Clone ID: LIB3062-040-Q1-K1-A5
ccaagatacagtttccattatggattgagttgggagaaggaagcaatcaatagccgggttgagaaggcaatatgtgaagctgacaagaaaggagctaaagttgttaccctcggactccttaaccaggcacataacctcaacagaaatggagaactttatcttcagaagtgcccaaagttgggagtaagactcgtagatggcaccagcttagctgctgcagtagttgtgaatagtgttcctcaaggcacagatcaagttgttctcgcagggaatatttccaaagttgctcgtgctgttgccgcagcattgtgtaggaagaatatcaaggtagtaatgaccaacaagcaggattaccattttcttaagcctaacatggcagaagatgcagctgagaaccttttggtttcaaagacaactact

SEQ ID NO: 40035 - DNA, 238 bp, Zea mays
  Clone ID: LIB3062-040-Q1-K1-A6
gaagaacaacccatgcgaatcagcctgcacttcaggggccgtgaactgagatggagggaacgctgctgcaagcggcagggatgcataaagtactatccacaatgaacattaccattccgatagccgtatcatctctgctctgagcacactctactctgatccgagctcatcccactattatgaatgtgattcacactttgactataactaactcgtctgacacatgcgagtaatattc

SEQ ID NO: 40036 - DNA, 454 bp, Zea mays
  unsure at all n locations
  Clone ID: LIB3062-040-Q1-K1-A7
ctttgcccttccctccctccctctccccgtttgccgacagaggcaatttcgccctggattgggccccgattcgtccgaccgcgaccgggattacctccggcaagcgcggatctgaacgctgcgctccgtgttctcgctcgaatccgccatgaatggggccaaattcaatggcgccgtcaaagccgatgccaagctggcggcgaaaagcaagggggcggagaaacccgccaagggcatgaaggggaaagccagcaaggaccccaacaagcctaaaagggctcccaccgctttctttgtgttcatggaggaatttcgcatggaagttcatggagaagaaccctaagaacaagtctgccgctgncgtgggaaagctgctggcgacaggcggaaatccctgagcgagtcggacaaggctccctatgtagccaaggctaacaagctcaagctagagtac

SEQ ID NO: 40037 - DNA, 474 bp, Zea mays
  unsure at all n locations
  Clone ID: LIB3062-040-Q1-K1-A8
ctagggtttttgattttagccgccgccgctgctcatctcacatccctcgagaagacgcctgctcctcgccgagcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgangaggacaagaaggcagctgatgagcgtgccgncgctgccaaggcctcttctaaaaagaaagaaagtggtaaatcct

SEQ ID NO: 40038 - DNA, 394 bp, Zea mays
  Clone ID: LIB3062-040-Q1-K1-B1
gttctgggtttgctactgccaccttgcgcgcccttcttccctgccgagccccactgaccttgatctggtcaaggatggcatccgtcccctctgggaggatcctgcaaaccagaatggtggcaagtggataattagattcaaaaaggcagtttcaggtcgattttgggaggatttggtgctagtggtagtaggcgaccagcttgagtatagcgatgatgtctgtggtgttgtgcttagtgtccgtttcaatgaagacattctgagcgtctggaaccggaacgcatcagaccatcaagctgtgatggcattgagggattctatcaagaggcacctcaagctgccgcacagctatctgatggagtacaaaccccatgatgcttcgcggcgtgacaac

SEQ ID NO: 40039 - DNA, 244 bp, Zea mays
  Clone ID: LIB3062-040-Q1-K1-B2
gtaggagttatgacagtgctgattccgacgatcattatcattgccaccaagaagtagcatgtgtgcggtacctactcggacaagcagcctgttgtactgatccaggtctacgagggttagaggacccgtacacgcgtcaacaacctgctgtgcaagttcgagctctccggcattcctgctgcaccccgtggtgtgccacatatcatcgtgtgcttatacatcgacgcctacggcatactgaacg

SEQ ID NO: 40040 - DNA, 225 bp, Zea mays
  Clone ID: LIB3062-040-Q1-K1-B3
acacttctggatttgctactgccaccttgcgctttcttcttccctgccaagccccactgacctggatcatggttaataatcacaatgcgtcccctatcgcaggatccttcaaaccagaatggtcgcaactggataattacattcacaaactcactttcaggtcgattctggcaagattcggtcctactaatagtacgcgaccagcttgagtatagcgatgatctc

SEQ ID NO: 40041 - DNA, 374 bp, Zea mays
  Clone ID: LIB3062-040-Q1-K1-B4
tcctgaattcccggcgccgaagccaggccccatctaccacccaccggcaaggcacgacgctgccactggcccgtagctcttcaagaggctgcgcccgggcttcaagaagtagcccttctttcctccttctgcgatggagagtcagcactagaatgtttggacagtgtatcttggcttttgcaggttatgcagttttctcggaataatttgtgacgttgattagttcagcatgaacgttgggtcagtttaagagtgtgtgttctacttccatctaatggaggcaatttcatgtcaaaaaaaaaaaccggaacgcattagaccatatagctgtgatggcattgagggattctatcaaaagagccctcaagctgaca

SEQ ID NO: 40042 - DNA, 401 bp, Zea mays
  unsure at all n locations
  Clone ID: LIB3062-040-Q1-K1-B5
gaaggcggcggccagcggcgagaggaggaggggtgggtcagccatgacggggaaggcgaaggcgaagaagcacacggcgaaggagatcgccgcgaagatcgacgcggcgacgacgaaccggggcggcggcaaggccgggctggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactcctcncgccccgctgctgctgttgccgncgacgncgncgncgncgncgctgccgaggccaccacctncaagcccaagcccggcgtccgcggcagcctcaagaagt

SEQ ID NO: 40043 - DNA, 396 bp, Zea mays
  Clone ID: LIB3062-040-Q1-K1-B6
gcttagagagttatacttatactagcttgcgggcgggcggacgctgttgcgatggagctggtgactatcgtgacgcggacgctactggcgtactcggcgacgatgctggcgcgggtgctggtggcgagcgcgcagcggcgtcggtgctacctgctggactacgtgtgctacaaggctacggacgaccgtaagctgccgacggacctgtgctgcgagatcatacagcggaacatgctgctgatgctggaggagtacaagctcctgctgaatgtgatcgcgaactcgggcataggctaggagacgtacggtccgcgcaacatgatcgaggtctgggaggcccggccggaccggctgcgctggccatggaagagatggacgagaccttccacgccttcc

SEQ ID NO: 40044 - DNA, 467 bp, Zea mays
  Clone ID: LIB3062-040-Q1-K1-B8
cccacgcgtccgcccacgcgtccgcccacgcgtccgcccacgcgtccgagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaaga

SEQ ID NO: 40045 - DNA, 352 bp, Zea mays
  Clone ID: LIB3062-040-Q1-K1-C1
aaactgcttgaactggaagcgaccctagtccaaaccaccgcaccgacaccgactccgagccgcgccgggccgcgctacctccgctcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtcgggttcggcggcgctagcaagggcgacgccgtcgttgacgtcccgctcgagaccatgggggactctcggagcaaggtgaaggagctctcgtcgtgggaatcagatctg

SEQ ID NO: 40046 - DNA, 460 bp, Zea mays
  Clone ID: LIB3062-040-Q1-K1-C2
aaactgcttgaactggaagcgaccctaggttataaccaccgcaccgacaccgactacgagccgcgccgggccgagctacctccggtcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtctggatcggcggctgctagcaagggcgacgccgtcgttgacgtcccgctcgagaccatgggggactctcggagcaaggtgaaggagctctcgtcgcgggaatcatatctgaagcagcgagaggcggatatcaagaggagggaagaggcgctgaaaaatgctggcgtgccaatggatgaaaaaaactgggcaccattctttctcatcatccaccatg

SEQ ID NO: 40047 - DNA, 407 bp, Zea mays
  Clone ID: LIB3062-040-Q1-K1-C3
atagtgctggaaccgggagcgacactagtgctaacgaccgaaccgacaccgactccgagcggggtcgggccacgctaccttcgctcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtcgggttcggcggcgctagcaggggcgacgccgtcgttgacgtcccgctcgagaccatgggggactctcggagcaaggtgaaggagctctcgtcgtgggaatcagatctgaagcggcgagaggcggatatcaagaggaaggaagaggcgctgaagaatgctggcg

SEQ ID NO: 40048 - DNA, 382 bp, Zea mays
  Clone ID: LIB3062-040-Q1-K1-A3
gtttgagaggctcaacaaaattaatgagggaacatatggtgttgtatacagagcaagggataagaagacaagtgagagtgttgcattgaagaaggtaaagatggagagggagcgagaaggtttcccattaacctctcttagggaaataaatatcctcttgtctttccaccatccttcaatcgtggatgttaaggaagtagtagttggaagtagtttagatagcatttttaatggtatggagtacatggaacatgatcttaaaagtgtcatggagaccatgaaacaaccatatacacaaagcgaggtcaaatgtttgatgcttcagctgctagagggtgtaaaatatctacatgacaattgggtactccatagggatctgaag

SEQ ID NO: 40049 - DNA, 431 bp, Zea mays
  Clone ID: LIB3062-039-Q1-K1-G6
caaagcgatactagctagtccctaccaaagcatacttcctgaaacactcttgcaggggcgctgagttctgtttgttgagacgcatagagctagagtcgacaatgtcgctcgtgaggcgcagcaacgtgttcgaccccttctcgatggatctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaagtcgaggacggcaacatgctggtcatcagcggccagcgcagcatggagaaggaggacaaggacgacaagtggcaccgcgtcgagcgcagcagcggccagttcgtcaggcgc

SEQ ID NO: 40050 - DNA, 424 bp, Zea mays
  Clone ID: LIB3062-039-Q1-K1-G7
ccattacaagctgagggggaatattgtcagctacaacctcggcgggatgggctgcggcgccgggcttctgtcgatggacctcgccaaggatctgctgcaggtgcaccccaactcttacgccctggtgatcagcatggagaacatcacactgaactggtactttgggaacaaccggtccatgcttgtgtcgaattgcctgttccggatgggtggcgcggccatcctgctctcgaacaggcggtctgacaggcggaggtccaagtatgagctggtgcacacggtgcgcacgcacaagggcgccaacgacaagtgctttggctgcgtgacacatgaggaagatgagattggcaagattggcgtgtcactgtccaaggacctcatggcagtggccggagacgcacttaagaccaacatcaccacgctg

SEQ ID NO: 40051 - DNA, 431 bp, Zea mays
  Clone ID: LIB3062-039-Q1-K1-G8
cgcagagataggcgtcttcgtactcgcctacctccgcggctcaaacctttcccggttcgcccaattcccgccgccggtccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggc

SEQ ID NO: 40052 - DNA, 407 bp, Zea mays
  Clone ID: LIB3062-039-Q1-K1-G9
aagatcataagctctaatacggatgatgctaaatatgttataaatgtaaaacaaattgcaaggtttgttgttggactgggggataaggtgtctccaactgacatcgaggaagggatgagggtcggtgttgatcgcaataagtaccagattcaaatccctcttccaccaaaaattgacccaagtgttaccatgatgactgtggaggaaaagccagatgtgacgtacaatgatgttggtggctgcaaggaacagattgagaaaatgcgtgaagttgttgaacttcctatgcttcacccagaaaagtttgttaagcttggtattgatcctccaaaaggcgtcctttgctatggcccacctggcactggcaagacacttcttgcaagagctgtagcaaatcggactgatgc

SEQ ID NO: 40053 - DNA, 425 bp, Zea mays
  Clone ID: LIB3062-039-Q1-K1-H1
cggacgcgtgggcggacgcgtgggtgcggatgtcagattgctaaaggaaataggcatgggcgggtacagattctcggtctgttggtccagaatactgccgaagggaacgctcgaaggaggtattaatcaggccggcatcaagtactacaaaaagctcatcaacttattgatagagaacggaatagagccatttgtaacaatttttcattgggacgtccctcaagcactggaagacaagtacggtggctttttaggcgacaggattgtaaaggattacacagacttcgctaaggtgtgctttgagaacttcggtgacaaggtgaagaattggttgacctttaacgagccacagacatttacaaccttttcgtacggaacgggagtttttgcccctggacagtgctcaccaggagaaaaatgtgctc

SEQ ID NO: 40054 - DNA, 392 bp, Zea mays
  Clone ID: LIB3062-039-Q1-K1-H10
gttgaagagctagagatgttgctggaggcatatttcatgcaagttgatggcacattaaacaggttgacaacgttgagagagtacatcgatgacacggaagattacatcaatatccagcttgataaccaccgtaatcagttgattcagctagagttattcttgagttctggtaccgtctgtctgtcgctgtactcattagttgctggagtctttggtatgaatattccgtatacctggaatgacggccacggatacatcttcaaatgggtggttcttgtatcagggcttttttgtgcctttatatttgtctccattgttgcttacgcacgacacaaggggctcgtcggatcctgaatagctgaaataaccgcgtacttgcttccctcaactgt

SEQ ID NO: 40055 - DNA, 426 bp, Zea mays
  Clone ID: LIB3062-039-Q1-K1-H11
gcaggctggtggtaaatggttttaaggtcgattatgtggagacattcagtcttctggtcaaagcatgggctatcaggatcattatgggatagagccagtgtgggaggctctcgcatgagtgtgttctagggaaggataaaccgaggaaaccctttcatcatcaaatgttgtacaaccacagcttaatcatttaatagatttcctgtgagacaatttttatttctaattccatggtgtggttcgaacttgtgaaaagtacaaagctcatattgcttaatgatggaaaaaacacaaccatgcttgagttgggtgctataaattcatgatatggtttaatgtcataggactggactggcagatagaagtaaatcgatatttatctcttgtacgagttgtgctaagaaaatcatttttgtgatcatttac

SEQ ID NO: 40056 - DNA, 429 bp, Zea mays
  Clone ID: LIB3062-039-Q1-K1-H12
ccccaacccgtcgtcggctgccggctgcggcactctgggaggaaggccccaagggcttgccgtctgagacgaaccgaaacgatggtgggcgccaatgaagtgggcggtctggagtgcgagcggaagccgctggcggaggtggtcggcgactgcgtccagcgctggttccaggacgcgtacatggaggcgcgcaaaggcgacgtcgccaaccaagtgcttgtagcgcagatgttcttctcgggttatggaacccccaagaacgagtataagggaaaacaatggatggatagggcgtcaaggttcaggtcttcagctatgaaggttggcatgaaacgtccaggatactatgcaagtgactcggactccgatgatgccaaccaatgacagtcagttacaaattgagttatgattagctaggagattcacatg

SEQ ID NO: 40057 - DNA, 429 bp, Zea mays
  Clone ID: LIB3062-039-Q1-K1-H2
ctgatgctttccaagcttcaaatactcatcggtactgcagacagggcagcgctggaggaggagttggaggaggcagcagctagcatcgaccagttggagacagagctggagcgccatctccaggagaaactagaggctgaaattcagtgtctgttgatgttgaaagcgaggcagaattggcaggtccgagcggtggaccaggtggccttggaggagcacagggcgctgtctgccggggacaagaccagaatgctgctcaagctacgagagacggagagcaagatcgtgatgctgaaagagcaggtggacaagctggaggtccgggagaaggagctcaaccggacgaccgaggtcctgaagatgcagagcaggaccttcagagcgtccctctttggcctcgtccagctggtaatgctatgcctgtccctg

SEQ ID NO: 40058 - DNA, 424 bp, Zea mays
  Clone ID: LIB3062-039-Q1-K1-H3
gtggaatcacattgaggcagcacattccaatatttaaccattggaaggaatacaagaagagagagaatgaacctataataagaaactacattggcaaagttactgctaatttcacggtggacagtgagagcaagacagtggaagatgcatgtctagacatgctaaagagtggacaacgccaaatgaggtatagactgaaacagaagtacttcaatgggatacctgctaatcaagtgaggactacatcacctattccaagcatgtctgacaacgactggagaaagttggtggagaagtggtctaccccaaatcacaaggaaagttgtgtgaagaacaaacttaatcgtgaaaaagtacagtatcaacaatgcacaggctctcagtcctacattgcaaaggcttttatattgaagcaagaaaaata

SEQ ID NO: 40059 - DNA, 439 bp, Zea mays
  unsure at all n locations
  Clone ID: LIB3062-039-Q1-K1-H4
cggacgcgtgggccgcgccatctcgcgctgctcctgcccctgctactgctggcctcggcgggggtcacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcaggcgctggtggcgctggcgggggccggggccgcggcgcccgccgtgcggacgtacaacatcacggngtacgtcccgctgggcaaggcctncacgccgctggactttccggcgaccgacctcgccgcggacgccgggggcggcaagatccgggtgt

SEQ ID NO: 40060 - DNA, 300 bp, Zea mays
  Clone ID: LIB3062-039-Q1-K1-H5
caaatacctgcctaaggtacaccccaactcatacatcaatcatgatcagcatcatataactatcacactgctacatcatacttattgatacaaccacgtccatgcatccattcgaaacaactgttccttataacttccctcaacctcctgatcacaaacacgctggcttacatacctacatccttgtataagattacacacacttcgctcacgcacactttcacaacttacatgaccttttgatgaattacacaacctttaactaacaacagacatatacaacctttatttaccaaacac

SEQ ID NO: 40061 - DNA, 436 bp, Zea mays
  Clone ID: LIB3062-039-Q1-K1-H6
cgctgaggctgttgatctttacaacaagcattacaagcgcgacgacacccgcatgggggttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgatatctcaccaaactactcacctgtgctcaacactgacgacgcctacgccagtcaagaagttaacgggcctgacgggaagcccattggtcctcctatgggaaatccatggatctacatgtaccct

SEQ ID NO: 40062 - DNA, 454 bp, Zea mays
  Clone ID: LIB3062-039-Q1-K1-H8
cggtcccgcacgactagcggaataatatccaccggcgacgggaacgggaggcggcgcggccggagattcgagagggatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtggttgatatgcttctgttcaacgcgacggaggagctgaacaacatagtcgaacatgcaaagcagcgccatcatgtgattgggcagtatgtgatcggccaagagggcctggtgcatgagctggggtcgaaagatctagggaactctgacttcctgaagaaattc

SEQ ID NO: 40063 - DNA, 166 bp, Zea mays
  Clone ID: LIB3062-039-Q1-K1-H9
cctgaattccctgtctcacaaagtcatatgtttattaggaggatctcatctatccaaaccatattcttcctatcttaccctacttcctccaagccgagtttcctatcaggtgacgacacacaacacctcatcataccctgatatttctataccattaaccactcca

SEQ ID NO: 40064 - DNA, 122 bp, Zea mays
  unsure at all n locations
  Clone ID: LIB3062-040-Q1-K1-A1
ccccagaccccaaaccctagcttcgctcgttgcggcgagccggcgatggcgaagtctctgcgatccanacgcgagaagcggcttccgacgttgcgccgggagatagcggagcccgtctacga

SEQ ID NO: 40065 - DNA, 149 bp, Zea mays
  Clone ID: LIB3062-040-Q1-K1-A2
acgaaaaggttccttcgcttatggaatctatttgggggctcttcctgttatatcgagcaattcggtcggggtccaaatactctatgctatattttggggccttatgacactcactacttttggtaacgaacttgccccaacaagcaatg

SEQ ID NO: 40066 - DNA, 437 bp, Zea mays
  Clone ID: LIB3062-039-Q1-K1-G5
ccggcggctgctgtgggaggcgaccacggggcggaggtacatcagctacgacgccctgcggggcgacgtgggggggtgctccaggaccggggtgccctactacaactgccggatctcgaccaccgccaacccctacacccggggctgcgagagcatcaccaggtgcagggacgcggatccctaggctcttgctttgcttgctccatcgccttgcaaagggaagtggggctgctcctcgctccttcgacgctgcagggcggtgttgctgcaaatgcttactaaatgaagtgtattttattctgtcttcttctttgatctttcttcctcttttgtttgtcttggtcgtccttcctactttgccgggatatttagtaagtgtagtaatgaaacactaatactaatggatgaatctcgtgtgcaagatgttgatgagcaat

SEQ ID NO: 40067 - DNA, 460 bp, Zea mays
  Clone ID: LIB3062-052-Q1-K1-G12
gccaaatcaagtaccaactactgaagagttgattacgaagtacatagccacatgtggaccaaagatagaaaaacttgtgaaggcatatgttgataggcacagtacatgtcatccaaccatcaaatacagcagctctgagatgggagcttgagcttaatggtgatgacagcttgaaccttctgtcctaccaatctggttaaccttcatttgtaggcccaacaagttaatattgttcatacaaacatgtatgtccatgacttcttgaagcaagtagtcagcgaagttccagatattggtgcatctgatgttattgctgatgataagcttggcaaaagacgtatatctatcctgtaattgataaggttcttacatgtcaaaataatcttctacgaagtgttaataaatgctgaattgtcatcaagaaagctggagatggaagcgaggaggaattaaagaggac

SEQ ID NO: 40068 - DNA, 266 bp, Zea mays
  Clone ID: LIB3062-052-Q1-K1-G2
gcagatttcaatcttcgaatcagtctccagatatggctgctcgttgcatctacgggtgtccttggaaccttcggctaccatgctcccgagtatgccatgactggccagctaacttataagagtgttatatatagctttggggttgtccttttagagcttctaacaggaaggaaaccagtatatcatacaatgcctagaggtcagcagagtctggttacatgggcaacacctatattgactgaggacacagtataacaatgtgttga

SEQ ID NO: 40069 - DNA, 364 bp, Zea mays
  Clone ID: LIB3062-052-Q1-K1-G6
gtcggatgcaggctcttcctggtgtgttcttcttttatgacctttctccaatcaaggtcacattcacggaacaacatgtgtcatttttacactttttaactaatgtttgcgctattgttggaggtgtgttcaccgtttctggaatcatagattcgtttgtataccatagtcaaagagcaatcaagaagaagatggaaatcggcaaattcaactgatgttgccttactattgctgcaattaagtagctcctgttgcagctccaagatccagaaatgcaatgtggcttttcctcgaactcttggcacagttgcgtagttgacaaacaattgctcatcagataactcttgatgtgcttgccaacttg

SEQ ID NO: 40070 - DNA, 344 bp, Zea mays
  Clone ID: LIB3062-052-Q1-K1-G8
cgaagagcggcgacgccccgcgggggttccgggagaaacccaggcactccgagaagccgaccaagtacgccggcagccccaagagcagcgctcctcgcgtgatccaccagccttgctaggttcgctggccggcccctgatggggactcggtgactcacatggaaggctgctgcctctctagcagcatctgctactggctgcagctgccgtcggcgtcgtggtctgtctgtcaaagtcgaagtaaaaaaacgtgagtagttgtactactgtagaagttgcttttgtatagcatgcacgtaagaaatgaccaaaaaatataacaagaatgcagctgttagtttact

SEQ ID NO: 40071 - DNA, 420 bp, Zea mays
  unsure at all n locations
  Clone ID: LIB3062-052-Q1-K1-H1
gccgaaacacacgaaccgacgtgaccagatcaaaagcaaggagggaggcagcaactgccaacggcgatgatggggcaggacggcgtcggcggaggggtgatcggggccctgctctacgccgcgctggcggagctggcgctgcgtctggtgctgtcgtacaagtcggcggcgcacgcggtgcggcgggcgtggcggtgggcggacgagtgggcgcaggcgtaccagtactacgaggtgccgcgcctcgccgtcgacggcgcggagaacccgctgttccggaaggcggcggcgtacgtggcgtcgctgccgtcgctcgaggacgcggacgccgnctgcgtgctgtcgtcggcggccaagagcaacgacttcgcgctggagctggggccgggccacaccgcgcgggacgcgttcctcgcgcgc

SEQ ID NO: 40072 - DNA, 361 bp, Zea mays
  unsure at all n locations
  Clone ID: LIB3062-052-Q1-K1-H10
acaacatggtatatggagctagggttcgcaggcgccgccactcgagctccgccttgcgcgtgtgaggaagaaggcggtcacccagccgagcccggagccggagcaggaaaccgtggtggagaagcgcgtggaggaggcggatccatggagcgcagctcggcgggcggccccctggcagctggcgtggcgagctcatccgcgcgtgctcgactcgtacgcgccggtgccggccgncgtacccgtcctgtgcgacggcgagctcgtcggcgtgggctacacgccctatgcgcaccagctgcgcactcccccctgctcgacccctcagttcctggtggacggcctagggcccctccgatggtgt

SEQ ID NO: 40073 - DNA, 358 bp, Zea mays
  Clone ID: LIB3062-052-Q1-K1-H11
ccgaaatcccgttgcgtctctcgcgcgttaccaagctctcaagttttctcgcgccgacggcaatggatgaggtcaccgaggccgtgaacaacctcaacatctcgggcgtaggggccgcgggcgttgccggggcggaagggcacaagaagaatcgcatccaggtctccaacactaagaagcccctcttcttctatgtcaacctcgccaagaggtacatgcagctgcacaacgaagtagagctgtcggccctcggcatggccattgcgacggtggtgacagtagcagaaattctgaaaaataacgggcttgctgtcgcgaagagtatcatgacatctactgttgatatcaaggacgagac

SEQ ID NO: 40074 - DNA, 313 bp, Zea mays
  Clone ID: LIB3062-052-Q1-K1-H12
gcggttttagatctctcatatacttttggaacttcactggtggatgccaaacttcgacttcctgttgtattgaataaatttttgcagcctataactcttacccctgaagaatttttcctccagtggaaagcgctgactgttcacttgctgaaggttcaagaagtggttaaaggtgtgaaaccaatgcctctttctgagatggctaatcttttcatgagccttcacttggcggtcgctcctggacttgataacaacccgaacaatctggttgcatgcacgacattcttttctgaagcaacacaagccatgcttt

SEQ ID NO: 40075 - DNA, 354 bp, Zea mays
  Clone ID: LIB3062-052-Q1-K1-H2
ctttaccactatgatcttcctcttgcgcttgagaagaaatatggagggtggttaagcgcgaagatggcggacttgtttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgctggtgggaattcagcaaccgaaccttacatagttgctcataattttctcttggcacatgctactgcagttgcaagataccgtacgaaatatcaggctgctcagaaggtaaggtcggaatagtcctggacttcaact

SEQ ID NO: 40076 - DNA, 345 bp, Zea mays
  Clone ID: LIB3062-052-Q1-K1-H6
gcgggctcccggctcccttcggccacgcgcaccaccaccccgtcgtccgtggccgtggccaccccgcgcgccggcggcggccccatccgcgcgtccatctcctcccccaacccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggc

SEQ ID NO: 40077 - DNA, 383 bp, Zea mays
  Clone ID: LIB3062-052-Q1-K1-H7
tttgtatagagcgcaatggggtacattgcaccaaacctttctgcaattgttggcagtgctgttgcttccaaactgatgggtactgcaggtggtctgggagcacttgcaaaaatgcctgcttgtaatgttcagttactcggtgcaaagaggaaaaatcttgctggattttctactgccacttctcagtttcgtgttggctatcttgaacaaactgaagtatttcagagcacccctccacctttaaggactcgtgcctgcagacttattgctgcaaaatcaactctggcagcaaggattgattcaattagaggtgatccaactggaaaagctggacggaacttgttagaagaaattcgtaagaagattgagaagtggcaagaacc

SEQ ID NO: 40078 - DNA, 276 bp, Zea mays
  Clone ID: LIB3062-052-Q1-K1-H8
cacgcgtacgggtaaatcctccgtccttatggatgttaaaccatgggacgatgagactgagatgaggaagctggaggaggctgtccgcagtgtccagatggagggtctgactagagagagcaaatgaacaaagaaaagattggatacggcatcaagaagatgactatcatgttgacaattgtcgacgatcttgtgtccatcgacactctaattgaggaccaccttacgcaagagcccatcaatgagtacgtacagagttacgacattggggctttc

SEQ ID NO: 40079 - DNA, 320 bp, Zea mays
  Clone ID: LIB3062-052-Q1-K1-H9
ggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagattgggcaacggcagcggctcaactcgtc

SEQ ID NO: 40080 - DNA, 435 bp, Zea mays
  Clone ID: LIB3062-053-Q1-K1-A1
gaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctggcaaggaatataatgtccgtgttgcatccaggtacttcaaggggcctgagcttcttgttgacttgcaagattatgattactctttggacatgtggagtctggg

SEQ ID NO: 40081 - DNA, 436 bp, Zea mays
  Clone ID: LIB3062-053-Q1-K1-A10
attcccggtcccaacagtttcattcttcgagggggatcgcttgtcggcggggaagcaaagcttagttcttgacgcccaacctgcccgttgcatattcgcctcaggaatttgggaattatgtctctttgaggggaatcaagggacttgcttttacttgtctaggctccatgtctaagtgggagccagtcacgtttcaggaatctcttagctttgttaagaaagtaaaggcacgtgactacatgctatacatatcattgctcgatgtgctcaaccggaatgatcaaatccctctgcaagcttacagcgagctctcgcttctgtttcagcatcacgaagatctgttagcggagctgtcgaagttcaggcccctcccatgcccaaacaacgtttatacacacggctcgatttggatgatcatattcctcatgccttttct

SEQ ID NO: 40082 - DNA, 423 bp, Zea mays
  Clone ID: LIB3062-052-Q1-K1-G10
cggacgcgtgggtttttttaggacaatgaaatgccatgtggatatttggacttggcgaagcacttgaaaggagacaagtctcgaaccttctattacatgagtcattggcagtagataacaataagctgaagtaacattctcaaatttctctcatggtatacagggcttaatcctcatcctcaacaaccttagttcccaaacctttgagaccctccggtgggatctcagcaactgtgaccagggagtagagttcctccttcgcgtcttcctcatcgttccggttgcgggcaattctgacacggacacgccttggcacactgcggataccactgctccagatgtgcttggtgagcttcacgtcaatcaagaagttcgcattcattttcatatacacgaacgtgtactgctataaagttaactacc

SEQ ID NO: 40083 - DNA, 387 bp, Zea mays
  Clone ID: LIB3062-052-Q1-K1-E4
gggttgccgccgcgtgctggtgacggtcacggggcctctggggtgcgcgccggcgatccttgcgcagcgcagccgcaacggcgagtgcgcggcggagctgatgcgcgcggcggcgctcttcaacccgtagcttggcgcgcgtcctggaccagctcaacgcgcgctttggcgccggcaccttcatcgcggccaacgcgttccgcgtccacttcgacttcgtcagcgatccggccgccttcggcttcgccacggccaaggacgcgtgctgcggacagggcccccacaacggcctgggcctctgcaccccgctctccaacctgtgcgccgaccgcagcaagtacgtcttctgggacgcctaccaccccacggagcgcgccaaccgggtca

SEQ ID NO: 40084 - DNA, 433 bp, Zea mays
  Clone ID: LIB3062-052-Q1-K1-E5
gttcaagagatcagtgtatggtggagttgtaggccctgtcccaccagcaccagacactgaagggggtaatgacgaagtatcggttcaagagatcagtgaagcccagcccttgccttgaagacggtgctcatttgccttaaagccccgctttcttctcccgcacctggtgatcttcacgatgttgttgttgcacagcaggtccggactgagtatttcctatttggttctatttttagtgcactataatatcacaagcgaagctacaattggttgtgagctatattggcatatccttcccttggatgtattcccttgaacaatgattcagaacaactgtttaaccattttctaaaggatcgactgcttatgtactcatgcagaactgcctaattgtgcctctggctgaatagcagccaagtaagcatgacatgct

SEQ ID NO: 40085 - DNA, 358 bp, Zea mays
  Clone ID: LIB3062-052-Q1-K1-E6
caacgaacgcgatcgcgcgccgacgacgacgcgcggtgccggcgcctggtggtgccgtgttgcggactccgctgcatcgcctcggtcggtcgtcgtcatatcatgggtgtccggctgccggtgtgcgtggtccgccgtcctcgtcctcctcgtgcgggcggccgtggcgcgggagtacgcggccatcttcaacttcggggactccctggtggacgccggcaacctggtggtggacggcatcccggactacctggccacggcgcgcctgccctacggcatgacccacttcggctaccccaccggccgctgctccgacggccgcctcgtcgttgacttcatcgcgcaagagctgggcgtg

SEQ ID NO: 40086 - DNA, 293 bp, Zea mays
  Clone ID: LIB3062-052-Q1-K1-E7
gccttttgtagtttgcatacaccatacagcggcgctgctggtagtccatgttgacgtggcagtgcagttctttcaagtaacgcaagtaaagttgttaccacaatttcggacctgtctaccatatttgtgttgtaacttttcattgtttatattgaaaaatggaaatggaacgcctcccatgattcatgtgattgtggacaatctggaagtttgaactcatatcctgtggtgacttatgtatattgtacacgcacgttggatcctcctctgaaattgactggaatagtttcaac

SEQ ID NO: 40087 - DNA, 408 bp, Zea mays
  Clone ID: LIB3062-052-Q1-K1-E8
ctcaaggtcatagctggtgtagacacgagcttcactgtgacatccaagggtggagacgacgaggagttctcagagctgtacacattcaaatggacgacccttctgatacctccgacaaccctgctcctactgaacttcattggagtggtagctggcatctccaatgcgatcaacaacggatatgaatcatggggccccctgttcgggaagctcttctttgcattttgggtgatcgtccatctttacccgttcctcaagggtctggttgggaggcagaacatgacgccaacgattgtcattgtctggtccatcctcctggcttcgatcttctcgctgctttgggtccggatcgaccctttccttgcgaaggatgatggtcccctgttggaggagtgtggtctggattgc

SEQ ID NO: 40088 - DNA, 341 bp, Zea mays
  Clone ID: LIB3062-052-Q1-K1-E9
atttcgtatggtgccagtagcgctattgtttgatttttgtggctgctcttcttgtacagtaccgagtgcgagagatgcatagtcatcgtatacataccaatacaataccgtacctataggtcttcctattcatgtggaagagtagaacttgtatccttattagctgtcagtaaaaaaaaaaaaaaaaaaaaaaaaaaaaaaaaaaaaaaaaaaaaaaaaaaaaaaaaaaaaaaaaaaaaaaaaaaaaaaaaggaaagccaaactaaaaaaggccaaaaaaacaaaaaaaaccagccacaagaacgccgcacaagcaaaaaaaaaaaagggggggggcttta

SEQ ID NO: 40089 - DNA, 325 bp, Zea mays
  Clone ID: LIB3062-052-Q1-K1-F10
ctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaagccacctgcaactgcctcaagagcatga

SEQ ID NO: 40090 - DNA, 231 bp, Zea mays
  Clone ID: LIB3062-052-Q1-K1-F11
gtgagtgagagtgtgagactgagggagtagaggtactcattattgtgaaccatcaagttacacacgcatgcagtacagaattaaacaggtgtgtggttgtgtgccctggatctagctatctagttcttagtgacagcggtctactcattgtatgagcaccacaactagaataaggaccacaaggacgtcgaggaggccatcggctacacgatgtacaactaggtcttccgc

SEQ ID NO: 40091 - DNA, 307 bp, Zea mays
  Clone ID: LIB3062-052-Q1-K1-F12
atcacacttgactggagtttcgaacaaacaaaatgccttacaataagtttaactttgcaaactgtgaaaagttcactgatgccaggctaccagatatcctgcaattcctcaaaattctgcaatgaagcatgccaagagtatttgacttaataccttgattgcactatataaaatatcaagacatagtttgagtcattgattgatgacaaagttatccatacaatgtgttcaaagatgtcatgttactgatgaatatcattgaagaacttccatttacaatgtcacctattcgtctgcaccacagaaa

SEQ ID NO: 40092 - DNA, 395 bp, Zea mays
  Clone ID: LIB3062-052-Q1-K1-F2
ggagagcagtcaccaaaccaaaccgctctcgagtctccatccattctctccgctcatgcgcagctctctagtctccagctctagctagccttagcctcgtccaagggacgaaggggccgaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttccgcctcctcgacggcggcggcttcgggtccgcccagccggcgccgctccccgccgaggtcgccgcgctctacgacgccgtcttcgagcagttcgacgccgaccacagcggcgccgtc

SEQ ID NO: 40093 - DNA, 397 bp, Zea mays
  Clone ID: LIB3062-052-Q1-K1-F3
gataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaaga

SEQ ID NO: 40094 - DNA, 392 bp, Zea mays
  Clone ID: LIB3062-052-Q1-K1-F4
ctgcacactgccatcgctctcctacggtactgctgcctaccgcgcgtctcgtcccttcgctgccgctctatcggatctcggccggagccatgggcggcggtggcgcggcgctgctgctgctggtgatgtgggcgggcgtggcgtcggcggccgtgtacgaggtgggcggcacgattgggtggaccgtcatgggcaaccccgactacgccgcctgggccagctccaagcagatcgtcatcggcgacactgttgtgttcacgtataacaagcagttccacaacgtgctggcggtgagcaaggcggactacaagaactgcatcgccaccaagccgacggccacctggtccacggggaacgattccgtcgtcctcaacaccacgggccaccactac

SEQ ID NO: 40095 - DNA, 360 bp, Zea mays
  Clone ID: LIB3062-052-Q1-K1-F6
cccacgcgtccgcgaggttcaggtttcacgcagtgcggcgagagctggcagccatggagagggggagcccatggtcgctgcggctgctaatttgctgcgcggcaatggtggccatcgcgcttctcccccaacaaggaggccaggccgcttgtttcgtgccgacgccgggtccagctccggcaccgcccggctcctccgcgacgaacacgaacgactcctccgctgctcctcggccagccaagcccagcgcattcccacccccaatgtacggtggtgtcacccccggcagtctccagccacacgagtgcggcggccggtgcgcggggcggtgctcggcgacggcgtaccagaagccgtgcc

SEQ ID NO: 40096 - DNA, 422 bp, Zea mays
  unsure at all n locations
  Clone ID: LIB3062-052-Q1-K1-F7
gaccgacccgccgccgccgccgccgccggccgacgactccaaggccctggccatcggcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacanagaaagcaaacatagaagctgaactgaagaagattgaggaacaactggaaaagaagaaggctgaatatgcagagaagatgaagaacaaggttgcaatgatacacaaggaagccgaagagaagcgagcgatggtggangcataacgcggtgaggaggtcctga

SEQ ID NO: 40097 - DNA, 386 bp, Zea mays
  Clone ID: LIB3062-052-Q1-K1-F8
ctcgatctgaactaccagggcactgagtttccccacttcagtttgtatcagcgagtgctagagactggtgaaccaacaaacaacctaggattttcagatccgtgcattagaactggccgcacttcattccaaacaaccagatctactagtggaggcaagagagaaagaggaaacccgcctctggttcatggtcgagatgcatctagaggtattcgtggaggaagggggtggtccataggtttcggaggtgggagtggtcgtggtggtatctctgttcctgttgaatctttggaggatgaagcagaagctgaatctgaagctcgttcagttgtggatggaggaactgattttgtacaacaagcagccatgcttgtaagaatgagaaa

SEQ ID NO: 40098 - DNA, 346 bp, Zea mays
  Clone ID: LIB3062-052-Q1-K1-F9
aggagatctacctccactcgctccccgtcaaggagcaccagatcgtcgagaccctcgtgccggggctcaaggacgaggtgatgaagatcacgcccgttcagaagcagacccgcgccggacagcgcacccgcttcaaggcctttgtcgtcgtgggcgacggcgacggccacgtcggcctgggagtcaagtgcgccaaggaggtggccaccgccatccgcggcgccatcatcctcgccaagctctccgttgttcccgtcaggagaggctactgggggaacaagatcgggcagccgcacaccgtgcccttgcaggtcaccggcaagtgcgggtccgtcaccgtgcgcat

SEQ ID NO: 40099 - DNA, 343 bp, Zea mays
  Clone ID: LIB3062-052-Q1-K1-E3
agccactggcttgacaacctcatgcgtagcctgtgcagcaccttgtggctcacagtggaagggaacataaccgtagcagggcattggtacaaaagcagtatggtagtatggaggaggaataatcattggagaaagataggggggcatggctcctggcatcaccgttcctgcctctccagcaattgaacttgtggtatctgagtcctgttccataggctgagatgtcatcactggggctgaaactggaactgggacctgaactggcgatggaactgaagcagacactttcacaggcacaggaggtaccacagtagctggagagaccacaggtgcaggcagggct

SEQ ID NO: 40100 - DNA, 416 bp, Zea mays
  Clone ID: LIB3062-052-Q1-K1-C4
ggaatcccggtcgaccacgcgtcggacaccgcttcatggcttctctccgcctccaaaacaatgctcgctcctccgagactccagctcccaccacccaaaccccctcgatatcccaagaaatcctcgcaagaaccaacttttggtgcccaatgcggccaagattgccaacgcctccgaaattccggttcctcgcatccccactagcacttccaaggccgcaatcctggcccagaaggccgcgctttggcgggacgcccttgtccccgttgccgccgccttcgcgtcctgtccgctcccttccctcgcggcggagggcgacgggaaagtgagcctcgagtccatcgtggtggcaatcgacgacttcaacaatcgcaaccctttcttcgtggctggggtcgtgttcgtgtggctagtgg

SEQ ID NO: 40101 - DNA, 357 bp, Zea mays
  Clone ID: LIB3062-052-Q1-K1-C5
cggacgcgtgggaaggccaatcccgagcagtggtgcgaaacctcgagcgctggcgccggtgaccataacaaagaggaagccgcggtagcactggtagcggcagcagtagggggtatatgtcgtaagcgttcagcggcgatgagaccgcccctttcttcggcttccttggcgcctccgctgcgctcgtcttctcatgcatgggggcggcgtacgggacagccaagagtggcgtcggcgtggcgtccatgggtgtcatgcgcccagagctcgtcatgaagtccatcgggcccgtggtcatggctggtgtactcgggatctacggcctcatcatcggcgtcatcatcagcactgggatca

SEQ ID NO: 40102 - DNA, 392 bp, Zea mays
  unsure at all n locations
  Clone ID: LIB3062-052-Q1-K1-C7
cgcctactggctatcaccagcacgcaccgccgccgcctctcatctcatccccgcgctgcttccccacccgcccccggattggcgctgccgcacccagatcttccccacccaaatcgactccgccatcgcccggatccacgcagagccgtcgcggatcgacgtgctgccgccacagattgcgcgctgtcgtacggatcgagagacacccaccgcaagccttccgcgctggcgccgttcgggaagtaaggaggctacggagagggcacaagctggggggtgtcgaactccgtggagaacgcgcgggcggtggatgcctagctctggtgggagggtgaggaaaatcaggttcatcgactcgctgctcctnctcgaaagcagtggacccacgggca

SEQ ID NO: 40103 - DNA, 409 bp, Zea mays
  unsure at all n locations
  Clone ID: LIB3062-052-Q1-K1-C8
cgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcagacgtaccggggctgaagaaagaggaggtcaaggtggaagtcgaggacggcaacgtccttcagatcagcggcgagcgcaacaaggagcangaggagaagacggacacctggcaccgcgtggagcgg

SEQ ID NO: 40104 - DNA, 287 bp, Zea mays
  Clone ID: LIB3062-052-Q1-K1-C9
agctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaagagcccgtcgcggccgaacc

SEQ ID NO: 40105 - DNA, 227 bp, Zea mays
  Clone ID: LIB3062-052-Q1-K1-D1
gctctctgctgcggccggatccaggctcgggcttctcccctccctggcgtacctttggaccgcggcagcaactcggctggcggacgcttgctgcccaacctgaccattggtttttccgattctttgtttgtttgtaaccgttacgctcaccaccaccttcgcctcctgcacaccgcgccagccaaaccactcccacccgtgaataaacctcgcaaattgccgaactg

SEQ ID NO: 40106 - DNA, 378 bp, Zea mays
  Clone ID: LIB3062-052-Q1-K1-D10
cccctatccacgagcaaggcacagcagcaggggagtcggagtgacagccgcccgcaggatgccgacactaaacctgagcaccaacgtgccggtggacgcggtggtcgccgccgacatcctcagggactgctccaaggccgtcgccaggatcatcggcaagcccgaatccgtacgtcactcccgccccccacccgttcggcgcaatgcctcggtcgcacgtcccttctctttaccaatgcgtgtaggctccctcccggtcgctggtcagcggcggcttggctcagtgccctttctgatgaaacgaaacattccccacgtgctgcgctgcggcctgcggtgcaatatgtcatggtgtcggtcaacgggtcggtgcccatg

SEQ ID NO: 40107 - DNA, 319 bp, Zea mays
  Clone ID: LIB3062-052-Q1-K1-D11
ctgccatcacacagcatgcaaagaacaataaacctgccctggtgtatgtaccgacaaggaagcatgcaaggttgactgcattggacttgtgtgcgtactctagtgttgagggtgctggaactccatttcttcttgggtcaggagatgagatggatactttcaccagaggtgttgaagaagagactcttaagaatacacttaaatgtggtgttggctatttgcatgagggtctaagtgagcttgatcaggaacttgtaacccagctgttccttggtgggaggatccaagtgtgtgttgcaagcagcacaatgtgttgggg

SEQ ID NO: 40108 - DNA, 447 bp, Zea mays
  Clone ID: LIB3062-052-Q1-K1-D12
ctaactacccccgcgctggctcgccaccaccgccgcagcaggcgtgggaatctgggcagcgccccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttaacaaaggagcttgggcgctggaatgaagtatctgatttctatcacagagcttcaaaattataccgggaatgtggaaggccacaacctgcatctgatgctct

SEQ ID NO: 40109 - DNA, 413 bp, Zea mays
  Clone ID: LIB3062-052-Q1-K1-D5
gctgcaccctggtgctttatatcttctcggtgctgtatatctaactggggactgtgttaagagagatatggcttccgcgttgtggtgttttcatagagcttcagaaaagggacatgctggtgcagctatcgcatatggatccttgcttcttaaaggtgctgaaatacctgaagttattacaaggttcaactcaggcaagagtccatcaactgggaaaatgcggaaaaggacccaacagcaggatccagtaaagctagcgaaagaacagtttcaaattgcagctgaggcaggctgtgatctcggtctgcggtggttgaagaggcttgaagcttatgaaaaccaagaagaaaagctaaagcaggttcagcaatgatatccactgaaagaatcccattgcatttgtcgcattacag

SEQ ID NO: 40110 - DNA, 370 bp, Zea mays
  Clone ID: LIB3062-052-Q1-K1-D6
cggacgcgtgggcccttctctccgtctatttccaagctttctccagatcaaatcagaaaggggaagggaagaacggcccagcaatgccgctctgcagcttctacgcctccacctccgttcccgtcgtcaagccccagcagtccgtcgcctcgtccaagccccccaccacggcggtggcctccgtggcgacaactgtgccgatgcgcagtgcagcgacggtgacgccagccgtggccacaacaacgagcctagcgctgtctctgcacctgccggagctgccgtcgcaggtgaaggacaagatcctgagcctggagctgatgggcgtggactatgggcgcgcgctggagcagaacccggcgctccgcgacgc

SEQ ID NO: 40111 - DNA, 409 bp, Zea mays
  Clone ID: LIB3062-052-Q1-K1-D7
gtgtatggcttccctccactcgttgaagatatctgggtatacggggacagtttcagatcaagtttagttgcagtagtcaatccacaccaagaaaacacaatgaagtgggcagagtccaatggctacaagggttcttttgatgaaatctgcaaacttgaaggactcaaagagtacatcctgaaagagctggcagccgttgcgcagaagaacaagctacgaggcttcgagtacatcaaaggcgtagtgttggatcctgtgccttttgacatcgagagggatttggtgactgcaacaatgaagaagaagagaaagaatatgctgaactattaccagtctgagattgacacaatatacaaaaagcttgaggcgcaaaagaatgctgccagaactaagtgaagagatgtgccct

SEQ ID NO: 40112 - DNA, 397 bp, Zea mays
  unsure at all n locations
  Clone ID: LIB3062-052-Q1-K1-D8
gtgaaggccaagatccaggacaaggagggcattcccccagaccagcagcgtctgatgtttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcaccctncaccttgtgctccgtcttcgtggtggtcagtaagtcatgggtc

SEQ ID NO: 40113 - DNA, 323 bp, Zea mays
  Clone ID: LIB3062-052-Q1-K1-D9
cccacgcgtccgcccacgcgtccgcaatatatttggcattgctgttcactccaagtgtactgatggccccatttgcagagactcttggcagtaagtataggaaaacatggcttcgacttgtccatcgtactttggagcttgcaggtcctgcgtttatcaaatggggccaatgggctgcaacacgccctgatctgtttccaagtgacctttgtactgaattgtcaaagctgcacacaaaagcaccagctcacagctttacctatactaagaaaactgttgagaaagcttttggtcgaaagctatcagacatttttgaaaatttt

SEQ ID NO: 40114 - DNA, 321 bp, Zea mays
  Clone ID: LIB3062-052-Q1-K1-E1
ctaagttaccaggtcatgaagagtcatacaatccttctgttgaatacattcctacacaagaggaaatagattcataccagcttatgtatgaggaggatcgcccaaagttcattccgaaacgatttgagtgccttcgaagtgtacctgcatatgagaaggcgttgagggaaggttttgatcggtgtctagatctttatctatgccctagaacccgcaaaaagcgtataaatattgatcctgagtcactcaagcccaagttaccaagtaaaaaggatttgaagccatacccgaaaacttggtaccttgagttcaagggccata

SEQ ID NO: 40115 - DNA, 316 bp, Zea mays
  Clone ID: LIB3062-052-Q1-K1-E10
cagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggacatcgggcggctggaccacagca

SEQ ID NO: 40116 - DNA, 291 bp, Zea mays
  Clone ID: LIB3062-052-Q1-K1-E11
acgcacccggactccgtcgacgccgcggttatggttcagacgctgcacgactgcgaggcgcccgggtccaaatgcgagaggaacgcgtgcgccacgtcgctggaatccatggtggactttgccaccgtcagcctcgggaccagccacgtgagggccgcgtcgactgtcgtggtgagggaaggctcgccgaagcaggagtacaccgtgacaggcgtgaagcgggctggcggggggcgcctggtggcctgccacgcggagccgtacgcgtacgccgtgttcgcgtgccacttg

SEQ ID NO: 40117 - DNA, 432 bp, Zea mays
  unsure at all n locations
  Clone ID: LIB3062-052-Q1-K1-C2
cgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtncttgnatatcggtatctatgatgagccaatgactccagggcaatgcaatatggtggtgg

SEQ ID NO: 40118 - DNA, 446 bp, Zea mays
  Clone ID: LIB3062-044-Q1-K1-D12
ggaccactctccatcctcgaagtgatcaggtgaccagacccaccgctgaaccactctccatgctcgaagtgatcaggtgaccaggtcctgaagaaaattgccctacaacaagggagagtacagagagggtaacatcgagcgtgtcatgagacagatcgagcttgagtccttcaacaaggctgtagccgcgcttaggggttcagcggacgtggatagactgagactgatggatacctacagcctctcgtccttgagaccggacggccacgttgggccttacagaacaccctatccctttgcaaggggcagcagtaaatccacgcccgtccaaaatgattgcttgcactggtgtgtaccatgccccattgatgcatggaatgatcttgttatgaagatggccctggatccatgaaaaccttatggatttgtatggtgtgctcttatgg

SEQ ID NO: 40119 - DNA, 442 bp, Zea mays
  Clone ID: LIB3062-044-Q1-K1-D2
ctttctcttctgctgctcgccctcggtttctgatcgcgaccatgggaccccgcggcgtcggcctagcgctccttgccgcggcgctgctccaggccctcgcccccgcgtcggcggcggcggcggcggggggcctggtgcgggtcgcgctgaagaagcagcccgtcgaccagaacgcccgcgtcgccgcgcgcctctccgccgaggagaggcagcgcctcctcctccgcggcgccaacgccctgggctcggccggcggcgacgacgactccgacgtcatcgcgctcaagaactacatgaacgcgcagtactttggggagatcggcgtcgggaccgccgcacagaagttcaccgtcatcttcgacaccggcagctgcaacctctgggtgccggccatccagtgctatttctcgatcgcttgctacttccactcgcgctacaagtc

SEQ ID NO: 40120 - DNA, 418 bp, Zea mays
  Clone ID: LIB3062-044-Q1-K1-D3
actcgatcggcgagatgggcatggtcgcttccatgtgcacggagcccatcaagcggcaccgggtggagagagacctcgacggcaaggtggcggacgcgctccgggagcggacgaggtcccggcagaggaccttcaggtcggtgaacagcatcaccatgcgcctgcccaggttcaaggaagggctcagggacgtcaagaacatcttcgaccagtacgacgaggattcagatggcacgatcgacagcgaagagctgcagagcttcggaagcagagtccgggtgcacatgtccgaggaggagatgagcaacctgcaccggtactgcgacatcgacagcaggaaagggcgtccagttccaggagttcgtcgtgctcctctgcctcgcgtacctgctcttcgggccagacgtcacacgacgcg

SEQ ID NO: 40121 - DNA, 445 bp, Zea mays
  Clone ID: LIB3062-044-Q1-K1-D4
ctccgatcctcgtcgccgacgcatccacccgaaccctcctccgcgacctcgccgtcgccgcgagccttggccatgtcgatcttcgagtataatgggtccgccgtggtggcgatggtggggaagaactgtttcgcgatcgccagcgaccggcggctgggcgtgcagcttcagaccatcgcgacggacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagacctttgccagccttgtctctgcgctcctctacgagaagagattcgggccatatttttgccagccaggcattgctggacttggagatgacaacgtaccatttatttgtactatggact

SEQ ID NO: 40122 - DNA, 438 bp, Zea mays
  Clone ID: LIB3062-044-Q1-K1-D5
gatgcaacttacactacctcggattcgtctgagcatggcattgttgaggctgtccatattgaaactggattggaagatgaaagtgcaacagcatcatctgggactggatctggtgatgacaacggtaactcatctgatagcgcctctgcagaagaaaatactgagactgtatctggtgatgatgagaagggcatgggaacaggtacaaccactgaagcgtcatattccatacaacagaactctgagaacagcagtgtctcagctgaggcagagaattcccaaggggattcttccagcggagtgaatggttcttcagaagagacatctaacaagggtgatggagctacagaaacgtctaacaagggtgagcaggtggatcccaagattgaaactagcacatccaccaatgccgagcataatgaatctcaaggggctgat

SEQ ID NO: 40123 - DNA, 363 bp, Zea mays
  Clone ID: LIB3062-044-Q1-K1-D6
caattcagcaaacctctggccaatctaactaccgtgaagattgtggtagtggtagaccatgtcaggttgatgaacacaaacagtcagaggaaaaccaccagttgcatcattcaagacaaattcatcgggaatcaggacaaccagttgacatggttagagctcacatggatcatgctaaccagagcgcaagctgcagccgggatatctgtaaaggaagcggatgcacgggtagcggtgaagccgataccaatgcgaatacgacggttggcctagagagtggcaacgagagtggcatccaatatagtgacaggtctcaccgagaagctgctttgatgaagttccgcatgaaaaggaagacagatg

SEQ ID NO: 40124 - DNA, 437 bp, Zea mays
  Clone ID: LIB3062-044-Q1-K1-D7
attagggatatcctttcaatgcccatgcctatgccaaaaaatccaaagattgcccttatggtcttgacaccaggttcattgccctttgagaaattgtgggagaagtttttacagggacatgagggaagatactccatctatgtgcatgcatcacgtgaaaagcctgttcatactagttctttgtttgctggccgggatattcacagtgatgcggtagtatggggattgatttcaatggttgatgctgagaaaagattgttagcgaatgcactggaagatgttgataatcaagtttttatcttgctttctgacagttgtgttccactgcattcatttgattatgtgtataattacctcatgggaacgaatgttagcttcattgattgtttcaaggatccatgtccacatggcagtggaaggtactctattgagatgta

SEQ ID NO: 40125 - DNA, 407 bp, Zea mays
  unsure at all n locations
  Clone ID: LIB3062-044-Q1-K1-D8
gtgctcagcttcggctctgccatgtccagcttagacctcacggagcagatgaaacagctgagggagaagctcgtcccgatagcgggggacgagcgctcagttggctctcgcactcaaggaccttctgccaaggcagaagacccggacgaccggaaggagaatgttacagcagataaatccgcgagagttgttcagcatccatgcatgacgaacggggtggccatgtggccatttagctgcgcgccaccagtaccggcctctgcctgttacggcccaggcagcatcgcaatcccgttctacccggcagctgctgctgctgctgctgctgctgcctactggggttgcatggttccaggagctnggagtggcgcatgggccgctcactccggccagtccgagacgggctc

SEQ ID NO: 40126 - DNA, 405 bp, Zea mays
  unsure at all n locations
  Clone ID: LIB3062-044-Q1-K1-D9
atcatagtgcttctttgcaaggccgagcacagattgttccagattcacaagtgaattcagaagagaaggacaaaaattgttctgttgttttttatttggatggagcgcacagtcctgaaagcatggaagtatgtggcaagtggttttcccatgtcacaaaggatgatacaaggctaccatcttctgtggagcagtctcatacatctatgtctcaaaagatccttctgatcatttgcatgtctgngagagatcctattagattgcttccttgtctcctggatgcatcaactcaaaatggagtccattttgacctgtgcctatttgtgccgaactcaatacatcacacgaagcttgattcttacacttgagcatcatctgagcctgatcaaatcgatttgtcatggc

SEQ ID NO: 40127 - DNA, 328 bp, Zea mays
  Clone ID: LIB3062-044-Q1-K1-E1
aatttccattcgacccacgcctacgcatgagactcgatctaactatctactccatatcactttcacttactttgctaatagcaaccgtcctagttattcttcctattactttacctccacaaatgcttatcttctaaaactctcaactcattaattttactcatatacaactatatacttatgtacctctaacttaactcttatcatatcttaccactctctcttaattaatacctttaatccttctcaaattaaattcctaatatatatcctcagaaacataaatatacctttttcttaaatcgcatttctagataaaccttttata

SEQ ID NO: 40128 - DNA, 442 bp, Zea mays
  unsure at all n locations
  Clone ID: LIB3062-044-Q1-K1-E12
gttgatgctatgaaggctgttgctgatgcatactctaaaagatctctcaagtattttgaagctgcccttcgtgattataagtcccagctggaggaggaccctattgtccacaggcatctttcttctctgtatgatacactgctggagcagaatctctgcaggttgattgagccctactcaagggtggagattgcacatatagcggagatgattgaattgccgattgaccatgttgagaagaagctgtcgcagatgatccttgacaagaaatttgctgggacactagatcaaggtgctggctgcctcattatctttgaggattctaagacggaggatatcttccctgccactctcgaaaccatttcgaatgtcgggaaagttgtggacagcctttatgtgaggtcggccaagatcatggctngaaagcagctagtcttacctg

SEQ ID NO: 40129 - DNA, 392 bp, Zea mays
  Clone ID: LIB3062-044-Q1-K1-E2
gtggatcggacacccaagatttgagctcatccgccatgatgtcactgagccacttcttgtggaggttgaccagatctatcaccttgcttgccctgcttcaccaatcttctacaagcacaatcctgttaagaccatcaagacaaatgttattggtaccctgaacatgctgggacttgcaaagagagttggagctaggattttgttgacatcaacatctgaagtttatggtgatccacttgagcatcctcaaaccgaggcctactggggcaatgttaacccaattggagtcaggagttgttatgatgagggtaagcgtgtagcagagacgctgatgttcgactatcacaggcagcatggcattgaaatccgaatgccaggattttcaacaccta

SEQ ID NO: 40130 - DNA, 421 bp, Zea mays
  unsure at all n locations
  Clone ID: LIB3062-044-Q1-K1-E3
cggaanttcccgggntcggacccacgccccgtccggggaaaggaagccggagaatgaagggcgggaaggcagtcacgccggtgcggcgtagggcccagcgttttgagtgaaaagccgtatnnatagatatatcagtatatanntatatatanntcggcacgaaacatacatannctgttcataanntagtttgaaagtgcctttaaaggtcaacaaggggcatgtgtgtacaagtaagggnnttggcgtccctagggggttagtttgggtgaacccataaaaatggaggggaatctnnataaaggagagatcccgttngttaattcaaaaattaaaataaccaagaaggatcccctctttccataagattcccctcttccatttttctttgtcccacncaaaaccaaccccnntgagtttc

SEQ ID NO: 40131 - DNA, 299 bp, Zea mays
  Clone ID: LIB3062-044-Q1-K1-E4
gcacagtcatccacactaacgaacgaactcttgcttcgatcacgagctagctgaggtcggggatgggggctgtgctgaacagcaggaagacgccgcaggcggtggtggccgtgctggtggcggctgcgctgctggcttcgtccgcttcggcggcgatcacctgctggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcg

SEQ ID NO: 40132 - DNA, 246 bp, Zea mays
  Clone ID: LIB3062-044-Q1-K1-E5
gctcgatctcctcatcgctactggatggagagcagttggctagttgttagcggtttccctggtttctcttcctcttgtgttccccgtttcagtttgcttatagccccgaagactcttttctcccgtagtgtcggaatgccagggtctgtccctgtgggtgtgttgcgtaactgggatccgagtataccctgctgtgttcgtcgttacattgaatggatctgaatgaaagtgggttagattggagct

SEQ ID NO: 40133 - DNA, 427 bp, Zea mays
  Clone ID: LIB3062-044-Q1-K1-D11
cccacgcgtccgcgtgaacccgccgccgactcagcatcaggagacgcgccaaggagagcccgcaaggaggcgactatgagggccaagtggaagaagaagcgcatgatgaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctctatttgctgctaatatcgacctacctattaagtaattgc

SEQ ID NO: 40134 - DNA, 442 bp, Zea mays
  Clone ID: LIB3062-044-Q1-K1-B8
agcaaatctttcagccacccgatccccaaccgcccggcccgacattccctccaaccgccgctgcggctgcgccgcccaccgccgacaggcgcagcagtcaacaggaaccgagccatggcgagcgcggatctgctgcggagggaggaggagttctactcctccctgtttgattccgccaaaggcgatggcgccaggtcgcgctcacagctgatcgagaggaagatcgaggccctggaggacatggccaccagggtcagtaaccggagatcgcggaagtggtttaacgaccgtttgctgattgaactcgtcccgcgtctttacgttgaagagatcaaaggcctattcgctcctccgccgtggggtgagcaagtgcccttgtcagcattctacagggcaaatgttggtgaatgggattccttcaggagcattgacatggatgctg

SEQ ID NO: 40135 - DNA, 394 bp, Zea mays
  Clone ID: LIB3062-044-Q1-K1-C1
gtgagctgaagccgggtgagccacttttttttggctcatgccctctagttcattttggaaaagcacgtcactggtgaagccatttgaaaaagaggtgtttggcacaacttttgcatgagccagagccgaagctgaaaaataagccctaccaaagggccctaaatgattaaagcttaaactcacattatcatgcaagcttttctttcttgtctactgaacatgcatgcatgcatgcatggacggaataagcagtagataaaagaaatgcacaaccagtctgttctgttgaattgaattgaatgttcactactacgactaagcaaagaaaacctgcagtcgtcttcagctactaaccagcggcggcgggtccaaggcatgggctggcaagttcaag

SEQ ID NO: 40136 - DNA, 400 bp, Zea mays
  Clone ID: LIB3062-044-Q1-K1-C10
ggagtaccaggacgagtcggtgctgtggacggagagcggcgacgtgggcaagggcttccgcggcatgcgcatggtgaacaacatccggctcaacttcgacgccttccacggcgacaagggccacggcggcgtgcacgacggcaccaccgtggtgctgtgggagtgggccaagggcgacaaccagagctggaagatcctgccctggggcgacgaggcctacgccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccac

SEQ ID NO: 40137 - DNA, 442 bp, Zea mays
  Clone ID: LIB3062-044-Q1-K1-C11
agctgttggtttagcaatatgggtcccatctgttgtaaatcaatctggtagcaaagatacagtcgaggcaacatcacctcgtcatggctattcgtcattgttacctcccacagataggaatgagacagattggaggcgacaagatggagacgatgtggaactcacaattctagacgttgatccctaccactatggtagtaacaatgaggagatgcttcttgatgacttgaaggtatcacaagcaatgacaaagcattatgtgaaggtcacacctacattcaccatcgaggagacaacaaggcttatgcaagagaagcagcaaagctgtgttgttgttgtagataatgaagattttcttgagggaattgtaacattaggtgaccttcgtcgtaaaggatttgtgccaagtgaaaactctgatagtacccaggcaaattcatcg

SEQ ID NO: 40138 - DNA, 429 bp, Zea mays
  Clone ID: LIB3062-044-Q1-K1-C12
gcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccggagccggcggcggctgaaaaggtgaaggaagaagcggcagcg

SEQ ID NO: 40139 - DNA, 308 bp, Zea mays
  Clone ID: LIB3062-044-Q1-K1-C2
cttagctcgagcttcttcaccgactaggccttgtctcattgcgaatagactactactcagagggggagccgttgtgaccggcccgaggagaaacctctgttcgcggagactggcatgacccacagcataagctgaaaaaaaatctttaccaacatgacttacatcattaaagcttagactaacattatcatgcaagcttctgttgatcgtctactgcacatgcatgcatgcatgcatcgacggcataagcatgatatcatagaactgcacaaccattctgatctgatgaattgaattgaaaagttact

SEQ ID NO: 40140 - DNA, 445 bp, Zea mays
  Clone ID: LIB3062-044-Q1-K1-C3
acgccttcccctcactccttcctccgtcccatgctccgccgctgacacgttcgcccgactgagcctgacgatggccgccgccgcctccgccatcaccaccgtctcaggcgttgtgcttccccaaaccttcctatcccaccggtcgccgccgccgcaggtcctagccgtggcctcctcattccgccggctctccttgtgcgcttcccctcaccgggtcactcacataatcccccgcgctgatgcaagtgccgaagctggagaaccggagcctgccactgcttcagctgaatccgaagaggaggtggccgaggggtctgtcgctgtggcggaagcggaggaaccgacgccgtcgagcaagccgaaggttaagttcggcgaaataattgggattctgaataagcagttcattgaggaggctgagaaggtgaagactgtaccggatctg

SEQ ID NO: 40141 - DNA, 281 bp, Zea mays
  Clone ID: LIB3062-044-Q1-K1-C5
atcattccattcctcatcatcactttgctcttcaatctaccaattcaatccaattgaaccgtctatatctataccctgtatgcctaactacaacctagtcacaccttccgcttaccataatcctactatatcaccactcatctgccctcataatcctaacacttagactcctcattccaacatatttcccagatcgctttctctctccagatcactcacataatttcccacacttatcctaatcccccatctagagaaccgtagactacccatgtttcacc

SEQ ID NO: 40142 - DNA, 428 bp, Zea mays
  Clone ID: LIB3062-044-Q1-K1-C6
gccgcgggattccgtgtccctctccaatccggcgtagccatcgtcgccggatacaggatcgggtccccgcgatggagccctcaccaacctcctcctcgccggctgtggcgcgccggttgtcgccggaggtaaggagggtgccgaagcgggcgctggaggagttgttggagcaggtccagcgggctgttgagatgctgcgcgatgccgacgctgatctcgccatctctctctcggaggagaccgcagcagcctcgccggaggccgaggaccgcaaggacgatgttggtgtcgatggagatggcatggcgacgtcgtcggttgcgagtgactccgattacgagacgacgcagatgtgtgaccttcttaaatctaaggttggatcactcgagttccttcaaagctcaatggtattcagaagtcagtagatc

SEQ ID NO: 40143 - DNA, 441 bp, Zea mays
  Clone ID: LIB3062-044-Q1-K1-C7
gttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctaccgcggtggcggtggaagcttacggcgtggtcgtggaagcctaccgcggcgtgggggat

SEQ ID NO: 40144 - DNA, 474 bp, Zea mays
  unsure at all n locations
  Clone ID: LIB3062-044-Q1-K1-C8
ctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacanaaatcttgaccggtacgagcgctactcctatgcaa

SEQ ID NO: 40145 - DNA, 435 bp, Zea mays
  unsure at all n locations
  Clone ID: LIB3062-044-Q1-K1-C9
gtggcgtccacagtgctggtgtacgtgcagacgcacgtgggctggggctggggcttcggcgggcccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgatgacggcgcggaggcgagcccgtggcgcctgtgctcggtgacgcangtggaggagctcaagagcgtgatccggctgcttgccatctgggccagcgggatcgtgttcgcg

SEQ ID NO: 40146 - DNA, 399 bp, Zea mays
  Clone ID: LIB3062-044-Q1-K1-D1
aaagagacttgtttcaactttttactccaaaacatttagttttgctctgcttaaggtaagtgtagtgagtatcttcgatattactttaactaccatttatgtttgtccttttgaaaatgtattaaccattaattttgctgagatagagctagatactcatgtacctctatgtttgtccttgtgatctcttgaaacttgctcttaattaagacctttaggccttgtagaattgtagtcttaatttatatgatgggtgacagagaagtagctttttctgaaatgggataattggataaactttttagtataattttgtggagtgttattggtgctgaaaaagatcgaggaagatagatttgtacttgttagtgtccaggggatttgcagaggaagcatttt

SEQ ID NO: 40147 - DNA, 447 bp, Zea mays
  Clone ID: LIB3062-044-Q1-K1-D10
ctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggcttcgcggcggcgtcagcatggccaacgccggcaacatccccggcaagtgcggcgtctccgtcggcgtgcccatcagccccaccgtcgactgcaccaagatcaactgatcgatg

SEQ ID NO: 40148 - DNA, 439 bp, Zea mays
  Clone ID: LIB3062-044-Q1-K1-B7
gaatttgttggtgacaaatggtattattaaaattgctgactttgggttggcaagagaaatagtcttccaatcctccttacactgattatgtttccaccagatggtatcgggctccagaggttctactgcaatcttcagtttatacacctgctattgacatgtgggcggctggtgctattttggctgagctttttacactgtccccactttttcctggtgaaagtgaaactgaccagctttacaaaatatgcactgtgcttgggacccctgattgcactatttggccagagggaatgaacctgcctcgttcatgcagctttaagttttttcagaatcctccaagaaacttatgggagcttattcctaatgcttcatctgaagcaatcgatttgatccagcaactttgttcctgggatcctcgaaggaggccaactgctga

SEQ ID NO: 40149 - DNA, 244 bp, Zea mays
  Clone ID: LIB3062-044-Q1-K1-A12
cgacaacgcggacaactgactgtcgctctgctgccgcgtcgactcaagcgtcgcatgatccgtatgcacgtacagggaccgaacagacactgcgagagtgagcatacttgtataccaagccgtgccagactactcctggctacaagcgttcaagtgcaacaactgcatgagaaccacagctatccaccgctacctacacagaaatggactacagctacaacatcacgaacatatgccagacagt

SEQ ID NO: 40150 - DNA, 304 bp, Zea mays
  Clone ID: LIB3062-044-Q1-K1-A2
ataaggaatacacatgggctccctaaaacgttttaattcattgctagcatacttaattactggctctgttaacttgctggtcccgagaggaaatctttgactgtaaaatgatcctgacaagtaccatttcaagcccaagcaacttttgaaacagattgccaccatctatgtccatatctcaaggggctacatctaatctctcttctcatcttcaatctcaaaagatgtcacatcatacaatgatcagttgttttctagtgcagctaatattctgtggaaaattgtggctgatcccaaaatcata

SEQ ID NO: 40151 - DNA, 454 bp, Zea mays
  Clone ID: LIB3062-044-Q1-K1-A4
ctgctttatgacaccaagggccgcttccgtcttcacccaatcagggatgaggatgccaagtgcaagctctgcaaggtgaggtccgttcagtttggccagaagggcatcccctacctgaacacctacgacggccgtaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccattggcaagggcaacaagccgtgggtgagcctgcccaagggcaagggtatcaagctcagcatcatcgaggagc

SEQ ID NO: 40152 - DNA, 378 bp, Zea mays
  Clone ID: LIB3062-044-Q1-K1-A5
aacgccggggccggaaaaaagggaagccagagcacagagccagacctggcggcgctggacagccaaaaacgccgccaaggatccttctctctctctctctctctctcttcgcgtccatcgacctgaccgcggaggcgcgtgcttcttcttcccgctctccactgcagtgtcatgaagattgagggaaacttgcatgtttgatatacccagctgctttctgtaacgaaaaactcgtgatcattttgttgaattggtcactgtcagggagggatctacttgtcagtttttggtattaaggctgctggccttcccttgcagggtatctgtagaataaatgggagaagcacactcggatgaattttgccattgccaggggtg

SEQ ID NO: 40153 - DNA, 402 bp, Zea mays
  Clone ID: LIB3062-044-Q1-K1-A6
aacgcccgtgccgtaaaaaagggaatccatagcacagagccagacctggcggacctggacgtgcaaaaacgccgtcaaggatccttctctctctctctctctctctcttcacgtccatcaacctgaccgcaaacacgcgtgctatctcttcccgctctccactgcacagacatgaagatcgaacgaaacttgcatgttcgatatacccagctgctatatgtaacgaaaaactcgtgatcattgtgttgaattgcacactgtcatggagggatctacttgtcagatcccggtattaaagctgatggccttccattgcatggtatctgaagaataaatgggacaagcacactcgaatcaattgtgccattgccagacatatgctagcaagtatgcactactcag

SEQ ID NO: 40154 - DNA, 398 bp, Zea mays
  Clone ID: LIB3062-044-Q1-K1-A8
acctcgtcggcaatgtcgggacctccaaacactaccaccgtgaaacctgcgccccggaagttctctccacatggcaggtcgcacttcctctcaagtctaccatatccctccatctacagctcacgacaaaacgtccacctaaacaatcttacctatagtgaaaatccaatcatctacatgacgatccacggatatatactctactgtgcactaaccagtgtgcctaagagacattagctcatcctgagcatttacctgtctatagccactcggattagccatcgccacagctttgcttgcatttagtaatcttaccaatggctatgcaaactgcttatgcgtactctacagcctgcttccagccttaaccctcttcctggccttcgatccgactttta

SEQ ID NO: 40155 - DNA, 427 bp, Zea mays
  Clone ID: LIB3062-044-Q1-K1-A9
aaaccccacccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggtactaatatacaagacaattcccttgtacatgtttcaaaagc

SEQ ID NO: 40156 - DNA, 431 bp, Zea mays
  Clone ID: LIB3062-044-Q1-K1-B1
cagacgccatcctcgaaatttatcagaggagattggtcgtctatctggagcactccgcgggcatcaagccccacgcttaaggtcagggtttctgttggagcgtcagggcgatggtgtttggggcgttcctttatcaacaaggggtagagaaggaagaaggttaatggagattcggaatgcacttgaaatgattcaaaggggggaaaatgtaaggctcgagtctatcttctatggcggcctcgacattcatgacagacacagggacatgcgccttgacattgacaatatgtcctatgaggaactattagcacttgaggaaaggatcggaaatgttagcactggcctcagcgaggaagctgtgataaagttgctcaaacaaaggaaattttcatcgtggagactataagcatctttggacccagaaccatgct

SEQ ID NO: 40157 - DNA, 402 bp, Zea mays
  Clone ID: LIB3062-044-Q1-K1-B12
aacgagaccaaggacaacgggctgacgctcttctgccccgtcgactcggccgtcgcggccttcgcggccacgtacaagaaccgcacggccaaggccaaggcggccatcctcctctaccacgccgtgccggactacttctcgctgcagctgctcaagtccaacaacggcatggtcaccacgctggccaccgccagcgacaagaagatggactacagctacgacgtcaagaacaaaggcgagacggtcacgctgcagaccagggtcgtcacgtccagcgtcaccgccaccgttggcgacatggagccgttggccgtgtatgccgtgaacaagttcctgcagcccaaggagctcttcaaggtcgtcgaagcgcccgcgcccgcgccgggaccgttcaagaagaag

SEQ ID NO: 40158 - DNA, 453 bp, Zea mays
  unsure at all n locations
  Clone ID: LIB3062-044-Q1-K1-B2
ctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatgggttctgagcaaccgncnggtccatagcanaccaaccctgcatgcagggccagcttattatatataatatctga

SEQ ID NO: 40159 - DNA, 404 bp, Zea mays
  Clone ID: LIB3062-044-Q1-K1-B3
acgccagagcttcctttactactgtctgcggcattggtttccttactacgagttcatccagcgcgtgctgaccatgttggctacctcgggtatgttccaaagcttgatgcggctatggcttatgagggaagaaaggagactatggcatctgggcaggctaccagtgcatcgaatgcagaacctaacgaacatgacaactcagctcactccgaggccactgtacagactccacatgaacgtgttcgccttagttggatgcgtgctctgcatcagcttgcgtctagtacaacttgcgcagaagctatggcagcaacaagtgcatgaactcctgaggttgtaccactgcttatgaaagcaattggatggcaaggtggaagtatactggcattggagacattaaagcg

SEQ ID NO: 40160 - DNA, 139 bp, Zea mays
  Clone ID: LIB3062-044-Q1-K1-B5
atcatacatgacaactccgctcacttcgacgtcactaacaattctgcagcctaaatggctaatgttacgcgccctacagctgtgcattacctctcgcgtatgacaagtttacccacagctatacctgctacactgtgca

SEQ ID NO: 40161 - DNA, 440 bp, Zea mays
  unsure at all n locations
  Clone ID: LIB3062-044-Q1-K1-A10
tcggcctcaaaacctgatcatcagagaaacgaaaaggaagaggtgagcgtgggagataaaacaggagaggggataagagatatagccctgagaagaatggcccttacaactgatgaactcaaggccaaggccgaggtatactacggtgacgagatctgccagctgtgtacccagctcctgctcagggaagcaggcctccccaatggtctgcttccattgaaggacctaatcgagtgcggctatgtccaggaaactggattcgtgtggctgaagcaaagcaagagggttgaccacatcttccatagtctangaaagctggtctcttacggcaacgagatcaccggctatgccgagaagggcaggatcaagaaggtcaaagggataaagaccagggagctcatgctgtgggtcccggtggaggagattgctcttgatgatga

SEQ ID NO: 40162 - DNA, 453 bp, Zea mays
  Clone ID: LIB3062-044-Q1-K1-B6
cgcgacgggtttcctcttgggttttgttctgttggcaaggcctcaatttagctggatggaaagtcatgagttgccacacactaaccaacctcccaagtacaaaatatactggtatgctttgtgggttgtggcactcgtcttgctgttagttgggtaagtaaatccatatggctggttcagtatatttgttgtagacatgtctttatgcgtttattaaacatatattgcagaaaacgtgctacaaagattcgtgattctggactaatgctaaattttggacgagctataaagatattacttgtttttgtgaaagcttgaaatagcactaatgtcaaattcttggggcacaggtttgtgatttcactagtgatgcttttcaaagggaagaacgggaacgatggctgccattggtgccactacctgaactgcgtgccaacatccaagtgggagtgt

SEQ ID NO: 40163 - DNA, 345 bp, Zea mays
  Clone ID: LIB3062-038-Q1-K1-D2
ccacgccagccgccgcagccacaccggcacaccgccggccagcagcagccatgccgcccaaggtggacccctcgcaggtggtcgaggtcttcgtccgcgtgacgggcggcgaggtcggcgcggcgtcgtcgctggcgcccaagatcggcccgctcggcctctccccgaagaagatcggcgaggacatcgccaaggagaccgccagggactggaagggcctgcgcgtcaccgtgaagctcacggtgcagaaccggcaggccaaggtctccgtcgtcccctccagcgccgcccttgtcatcaaggcgctcaaggagcccgagcgggaccggaagaaggtcaagaaca

SEQ ID NO: 40164 - DNA, 397 bp, Zea mays
  Clone ID: LIB3062-038-Q1-K1-D3
agactatgttgaccgaggtcagcacagcttagagacaatagctttgcttcttgctcttaaagtcgagtaccctgaaaatgtacacttgatcagaggaaatcatgaagctgctgacatcaatgccctttttggcttccgccttgaatgcattgagagaatgggtgaaagtgatggaatatgggcttggacaagattcaatcaactgttcaattatctcccactcgctgccatgatagaaaagaaaataatctgcatgcatggaggcataggaaggtcaataaacacagtggagcaaattgagaaacttgagaggcctatcacaatggatgttggttccattgtcctcatggacctgctatggtctgatcctacagaaaatgataatgtgggagggttg

SEQ ID NO: 40165 - DNA, 430 bp, Zea mays
  unsure at all n locations
  Clone ID: LIB3062-038-Q1-K1-D4
aggaaaggggcgcttgctttatattctttctaacctgcgatctccgtcgatccagccgagaggtcgtgtgcgcgtggatgtgtgcgtagaagggatgaagattacggcgctcctggtgctgaagccgtcgacctccggagccgggagctcctcgtccggcggcgagtcgggcccggaggcggtggtgctcgcgaacgcgatagacgtcagccacttcggctatttccagcgcagcgccgcccgcgagttcatcgtctttgttgcccgcaccgtcgctcagcgcacccagccaggccagcggcagtccgtccagcacgaagaatacaaggtccactcccacaatagagatgggctttgggctgttgcattcatggatgatcaatatnctgtaccgagtgcattttctcttctgaatcaggttcttgatgag

SEQ ID NO: 40166 - DNA, 378 bp, Zea mays
  Clone ID: LIB3062-038-Q1-K1-D5
atccccaagcaaacaaacagggtagagggagaggagaggagaggagaggagaggttgggtctgggacaccatgggtccgatgaagctgtacggggcggtgatgtcgtggaacgtgacgaggtgcgcaacggcgctggaggaggctggctccgactacgagatcgtgcccatcaacttcgtcaccgtcgagcacaagagccgcgagcacctcgtccgcaacctgtttggtcaggttccagctctgcaggatggtgacttgtacctcttcgaatcacgagcaatctgcaagtacgctgctcgcataaacaagccagagctgttgagggaaggaaacctctatgatgcagcaatggtggatgttttcatcgaggtggaggc

SEQ ID NO: 40167 - DNA, 416 bp, Zea mays
  unsure at all n locations
  Clone ID: LIB3062-038-Q1-K1-D6
ggttgccgctgctaggtggattgcaaagctctcagggccttgtctggcacaagcatggcaggtgtacccagacttcaaaataaaggttgttggacattcactgggaggtggtacaactgctctgttgacatacgttctgagggaacataaggagtttgcctctactacttgtctggcatttgctccagctgcatgtatgacatggaaactggcagagtcaagagtgcattttatcactacagtcatcaacggagctgatctggttccaacattttctgctgcgtcagtagatgatcttcgttcaaaggttacagcgtcggcttggctaaatgatctncgtcaccaaattgaacaaaccagaatcctaagcactttttatcgttctgcatcaggcttgggatcccggctttcatcta

SEQ ID NO: 40168 - DNA, 286 bp, Zea mays
  Clone ID: LIB3062-038-Q1-K1-D7
cttttgcctttcgcacactttaacttactttcttttctcttatgtcaggtccctcaaaatgtgcacttgatcatatgaaatcatgaatctgctgacatcaatgccctttttggcttcctccttgaatgcatcgatagaatgattgaaagtgatggaatattatcttgtacaacattcaatcaactactcaattatcttccactcgctgccatgatagaaaagaaaataatcttcatgcatctaggcataataaggtcgataaacacaacttagcaaattgacaaac

SEQ ID NO: 40169 - DNA, 450 bp, Zea mays
  unsure at all n locations
  Clone ID: LIB3062-038-Q1-K1-D8
ggcatctgtatgctataggaagcagccgggagttcaaaggtttttcgagggaggtggatagatccgttgttcagtgtatatgggaacgtgcaggagagttttttcctgcaatgaagaatgtttcttttgatattgatcagaatactcaaatcagaatagggcatcgtccatacatgcctgatggaaagccagttattgactttattcctaatctctcaaatattttgattgcaactggacacgaaggaagtggacttactttggcactaggcactgctgaaatggtcactgatatgattcttgggaaatcctgaaaagtgagctactcaccttttttccatcaaacgcagattttcaggatgatcgnttatccggaaaccctgcttcagctcttcaagtgacaaactaccgtcctttgttttgtccattggatggaacatctctttgaat

SEQ ID NO: 40170 - DNA, 299 bp, Zea mays
  Clone ID: LIB3062-038-Q1-K1-D9
cttacactcatataactcctactgctcccatttatatttaccaatttttttcaattaacacgggcacgtttaatattaatgattgtattccacatacaaaacccatattatcaatatctattaatatatttaatacttcaaatacaaataaatctcactcaatactatactatacttatcatcattctataaacacacttaattaccctacactaatccacacaactactattactaattacatacactaacaatatttaccaactagttaacttcatcacttataaacttccaatctt

SEQ ID NO: 40171 - DNA, 302 bp, Zea mays
  Clone ID: LIB3062-038-Q1-K1-E10
cattctctcattctcttcacctatttttactttatcaatctctcaacactactattgtcctgtttaaatattacagttggtaccataaatcactatcccctcttcactccatcttctacttcgctacaaacacttatccttcactacactttcattaccactatctatcactcaatgcttaccacttatactaccaaccctacatctcaatatgaaactaatctaatcttccctacacaactcctatttaatacctatacactccacaatctactacatcctataatccatatactatacca

SEQ ID NO: 40172 - DNA, 408 bp, Zea mays
  Clone ID: LIB3062-038-Q1-K1-E11
gaaggacatgcgcataaatatggcaatatcagcagcatttgtatgtactcttctctgagattggtaagaagacccagctgttgctaacatgctcattgtttatggttattcacttgtatgtctcgtatatgcactgcagctttgcattattattcttgtcagaaaagctattttaagctatcagcttgaaactttttttttaaaaaaaagaaagcttgaaacatgtttggaagcttaaatcataagttcagatcatttaagtttggatttcatgttttgctagtcatttttaatctgtaaagttgttcagaaaaactacaacccgaatccaaaacagatataacttgttttcaccagatacaactttctccatagttctcttcaaaagggcaaacatgttatgaaaaa

SEQ ID NO: 40173 - DNA, 388 bp, Zea mays
  unsure at all n locations
  Clone ID: LIB3062-038-Q1-K1-E12
acggcgcggagtgcaacctcactgggagaggaggatgaggatcgccgtggactccgggaagggatcgctacctgccgacagcgcgacccgacatcatccacagagacgtgaaggcgagcaacgtgctcctggacgccgacttcaggcgcggtcgccgacttcggcttcccaagctggtcccggacggcgcgacgcacgtaccaccaagtaaaggcacgctgggctacctgcgccggatacgcgatgctcgggaaggcctcnagagctgnacgtcttcacttcgggtcacgctgctggagctggccagcgggaggaggcccgtggagaagctgagccccaccacgagcgcgaagcagaccgtgacggagtgggcgctcccgctggcccg

SEQ ID NO: 40174 - DNA, 433 bp, Zea mays
  unsure at all n locations
  Clone ID: LIB3062-038-Q1-K1-E3
tgtgcgggcaggcaggcggctggcctccgtccgcgcatcctcttctggcgaggagctcccccacgcagccgctgctctgtccgggtcctctgttccgtccgctccccgatctcccccaatccgaccaaaccggcagagccggggggcggcgatggcgctgcgacgggcgctcctcagatcggcagagatctctttcgaacgcaaggctgcaattgagtacattcattctttatcaagggcacagcctgctcgttctctcaatggtgctggcctttgtcctgctagtagatcacttagcacccaggccgtcactacgtcaagcacaccacagccttcgnctgccccacccgcttcagagaagactcactttggtggcctcaaagacgaggatcgcattttcaccaacctctatggtctgcatgacccttttctg

SEQ ID NO: 40175 - DNA, 368 bp, Zea mays
  Clone ID: LIB3062-038-Q1-K1-E4
acgctctccttcacacgctcagagttttccatggcattcccctacgtttccacgacagtcgacgggagactagaggactcggtgctgtccagctttgccgagaactgcaacaatggtttcggaagaaaccgcatcacctacacagacacgtgtaccggtcaagatctgaagaaataccacaacatggatgccatcaatgacctggtagtgtcaggggtagcgtcaaggagagccaaccacccaagtggacagaccgatgtaatcgtcttctgtaacggcgggttcgagaatccaggcactgcgaaatcagaaggagagctgctttcccagcttgtggactcgcttgacttgtcgggagcccaatacac

SEQ ID NO: 40176 - DNA, 482 bp, Zea mays
  Clone ID: LIB3062-038-Q1-K1-E5
acattctttagcgaggagctgaacctgaacttgacagaagcagcatgggtgtcagtgcttgctcctttgggttcaatgagcattacatctattgcagcaccttttgcagacaacttgatatcaaatggagttgacaccacgaaggtgcgaaaaatttgccaaacaattgcctttgtgtcacctgcgactttcatgatgctttcctctgtggatcttggactgcctccctgggaaattgttgcttttcttacaagtggtgtagcactctccagcttcgcattgtcagggctttattgcacacatcaagacatctctagtgaatatgcaagcattctcctgggaatcacaaacactgtaggcgcggtgccaggaattgtaggcgttgcactcacatgctttcttcttgattcaactcattcttggagtatatcactctttgcgccttctatcatcttttacttaacttggactgttgaatgggt

SEQ ID NO: 40177 - DNA, 426 bp, Zea mays
  Clone ID: LIB3062-038-Q1-K1-E7
acgcatacattaaggattctccaaagccacctccagagagaattacattcacgtttccaggaatgaactcatccgcatacgtggcgatggtggtgactggagctggaaaggcggcagcggtgcagaaggcgctctcagacaagcaaacctcgtcagacctgctgcctgttgagatggctgtgctgcaagatggagaattcacctggttcactgataaggcagcggtgtccttgctgcagaacaagtagagtcccatggtaaccttggctcgaagccattttagctcataaaataaaagatccaggggcctgcgtgcatagctgcattcgtccttcaggatttcgtgtaacggaaactcgatccctttatgtaatgtgtgttgttcggagtaatgttcaaaaactctattggcttacggcttttctg

SEQ ID NO: 40178 - DNA, 417 bp, Zea mays
  unsure at all n locations
  Clone ID: LIB3062-038-Q1-K1-D12
caatgatgttaaagatgacctgtctcaaattggatttgatgtcgaatcaattcagaaaatggttgctggattggagggaaagatcgagttacttgagaacaaacaggacgtggctaatactggtatctggtatctctgccaagtagcaggcggtttaaaagatggaataaacaccaggtttttccaggaaaccagtgagaagctgaagctctcacattcagctcaacctgaaaacaagccagtgaaggggcttgaatttttttcggaaagcaccatggaacagaaagtagctgactccaaaccaattgcggtgacagtcgacgctgagaagcctgagaaaaccgctgctgtaatgggcaccacagtgcacaggtctatcaggttctcatatcggaatgcangccttgctttgtgatc

SEQ ID NO: 40179 - DNA, 328 bp, Zea mays
  Clone ID: LIB3062-038-Q1-K1-B4
tccggcgcccgagaagacgcgcgcagccccacccagccgcctacaagcgctccgctcccacagacagacagggtgggctcgacggatgagcatgtgtgagaaagatcagaatttgccatggcgatactacctgttccgcgacccttttgctcctcccaacgggtactactggcctcctaccggttactgtgatggccactgctgtgacctccatcattacggtagagcatcacatccagatgagactcagttgcattctgctcaactcgcatatgatatgtacaacccatcagaagcacccatgagcaccagcacgaaacagtatatg

SEQ ID NO: 40180 - DNA, 450 bp, Zea mays
  unsure at all n locations
  Clone ID: LIB3062-038-Q1-K1-B6
acggatatagctgatgattgctatttgttagcatcaagatgtatccgttactgtcctgaggtatgttatacctacagagatgggtcaaagattggttgactgtgcaatggctggtataactatacaacacagggaagcctgtaaatcgatattgtcttttctatctgatgtcattgaccttccaaactcatctgacgggggacagtaccgtaaagttattaacacaatcatacttcaccgtggcgcaacccttactagaataatgattgctgccttaacaggggcgctaccatctggtcgtctggaggaggtttcttatggtctgcttgcacttagcagagtctgtggtgagaacatgctgaactgggcagggaaagcattaatcttataccgncacaagcactaacagatgcagaacgtttgcgcttcttcaacaccatatctgatgct

SEQ ID NO: 40181 - DNA, 389 bp, Zea mays
  unsure at all n locations
  Clone ID: LIB3062-038-Q1-K1-B8
acggctggaggaagcggcggtgaccggtgaggaagctctcctacaattctttgccgagtgcagggggnggttcttgcagaggcgcagctcaacccagtactggcattttcattcaggcgcatgcaaaatcctttagtctctgggaatttgttctagctgatttttaggcttccccaaattgttttgccggcaggcgcgggcgtttcagattgcttgttcattcttgtgcctttgccgggaggtgttcccagaaccattcttgggcttctctgtgtccgtttgtgcataaggaagtttttgttctgtgagaagcttcttttgtaaaacatgcagtgccttctgatgttggatggaatgggatgctcgcctgccttccgaagctgtcttaa

SEQ ID NO: 40182 - DNA, 409 bp, Zea mays
  Clone ID: LIB3062-038-Q1-K1-B9
agcatatccaggtaccatatatgatgattcaggtgtggagacttttgacttgccaggacaagcagattttattcttgggcgctgctttattgaggtggaaaacaggttcaggggtaacagcttccctgttattgttgcaagttcaagtgtttgccaggagttgagaagtctagaagtggagcttgaggattcacaggttcttgatgtttcttcggatggtcagattcatgactgtaggcagtcaaaaacgagggttcaagttctgcacttccttaatgaactcggctggctctttcagagggcttctgcctgtacattgtccaccagacctgatgtgtctgatttggatttgactcagttttcaatcacacggttcaaatatcttttactgttctctagcgagcgttgg

SEQ ID NO: 40183 - DNA, 326 bp, Zea mays
  Clone ID: LIB3062-038-Q1-K1-C1
cgtcgtagcgtccctcttccacctcttctctccctgcttccttgtctaaatcgatttgtcagccattgctttcgtccttactgcagtgtccgttttggttgtttggtgaaatctgtcgctatcttcgtcgactccagttcgtcgtccatttcttaaagttcaaaaaggcctgctttgtccccatttttcttccccgtcccaaggtacgtgattgcagcagatacgacttcctctgcttcggatctccttcaatcgtcatcttccacttcgcgttttcctcttcgtactcatatggctttgtctgcagcaatgctttacgggtcgcg

SEQ ID NO: 40184 - DNA, 390 bp, Zea mays
  Clone ID: LIB3062-038-Q1-K1-C10
acgcagctgtcgccagtttctcagtctttacctatggcgctgcatactatattaccgatctcgcgggcacagagcttgacagacacgaatgtacgttcattgtctccatccaatggtaacaccatgcaaaacacactgaggccgttctcatcagaagcagtttctcacctcaatatgccgaggcccactgcgatacctgtcgcagacccatggtcgtcgaagcgtgtcgcggtggagtctctgcttccttctcggcctcaggtttcataccagatggaacaattggaccctgcaccagctagtatacctcatagctctgcgttggcaccacttaccggatgagggtgcttggttgaccaaaatgtgaactctgatcctcaaaatcatctc

SEQ ID NO: 40185 - DNA, 227 bp, Zea mays
  Clone ID: LIB3062-038-Q1-K1-C11
gaaaaaggaaaggaaaggacgaaggatcggttgcgaagtctatggcgtcgacggcggggtagctggcgcggccggcggcgcagaaaggagcggtgcccctgttctaccgaagggccctcaaggacaccctaaattggcccgtcaaccgcaactttttttaccagaacccgtcgaatttccggaacaagttcaaggccaaccgacccgtgaataacctgaacttggtc

SEQ ID NO: 40186 - DNA, 398 bp, Zea mays
  unsure at all n locations
  Clone ID: LIB3062-038-Q1-K1-C12
ctcatgctttgctcctcttcaaacgctcgagaaagagagagagagacgaaaccctcgttcgggaccctancatagccacggccttcccgcacgctaggaaggggaagatatgggcgccgaggaggacgccgctgcacgccgcgagcgtctccgcgccctccgtgccgccaaggacctcctctccacccccgacggcgccccaaccccttccaccgacggagaacaccaaaatggcaaccatgagatggcagaagagccagaattaccaggtcctcaggatgcacctggtgaagctggtaaagaagatggtagccccactgaagaggccgaagaggttgaaaatgatggtgagcttccagccatgaaattcagaaactacctttcccatgatgagcaac

SEQ ID NO: 40187 - DNA, 385 bp, Zea mays
  Clone ID: LIB3062-038-Q1-K1-C3
acgccgaattcccaggcaggcaggtcggcgaggatggcatgaagaccgaataccgagccgtgctgaggcgctttacgggaacggtacaggaccccaaaatctcagatccttcctgcccgcccgcccgtgcccgtcgactcgtcgttcttgccggccgtgccccacctacggcctctcctcctgcacggggatcggatactccacatgctgcgcgatggtgctgtgggtcttcggctactgctccctcatctggaaccccggctttgacttctacgacgaaatcctcggcttcatcaagggctacaagcgcacctttaatctcgcttgcattgaccacataggcacaccggagcattctgcgaggacctgcacgcttgaaaccgac

SEQ ID NO: 40188 - DNA, 347 bp, Zea mays
  Clone ID: LIB3062-038-Q1-K1-C4
gcagaaaagaaaagccgttctccctacgtttccccaaaccccaaggttcccaaccatggcaggcggggtcgattctgactgcgagcaaaaccctaaggacgccgagcggcacgtgctcaccgtcgaatccgacgccgatttcttcgaggaggactacgacgaggatggcgaggaggaataccaagaggaggaggagctggactggccggcggctgcggcggcagaacgggagcggatgcagtccgcgttacggaggctgtcatccgaccccgtgggcatccgcgtccacgacgtgatcatcaagggcaacaccaagacgcatgacgagctcatcgaggcggatgtcg

SEQ ID NO: 40189 - DNA, 436 bp, Zea mays
  unsure at all n locations
  Clone ID: LIB3062-038-Q1-K1-C6
agaagatcacggttcaggtcacccggagcggctacaggcagaagctctcaatatatgaactgctcgtcggcgacatcggtcacctctccattggtgatcaggtgccggctgacgggctgttcatgtcaggcttctcgcttctgatcaacgagtcgagcttgaccggagagagtgagccagttgccgtcaacgttgagtacccattccttttgtcagggacgaaggtgcaggacggttcttgcaaaatgctcgtcacgacagtcggcatgaggactcagtgggggaagctgatggccactctcagcgaaggtggtgatgacgagacaccattgcangtcaagctgaatggtgtggtcaccatcatcggtaagataggacttatctttgcagtggtcacattcgaagtgctcacccaagcctgttcggctcaagatca

SEQ ID NO: 40190 - DNA, 273 bp, Zea mays
  Clone ID: LIB3062-038-Q1-K1-C7
ggctgggccaagttcaccggggggttcttcttcggcggcatctacggcgtgctctgggccgactttctcctctacgtgctcgacctcccctacttcttcaagtagaaatcatcaaagatgcgtatatatatagctccggccgatcctcctctctagctgcatggtatgtaagtggtgtggtccttgtttcatttcactccagcggtgatcagcgccgtgtataaatgtaattcctctgctttgcacatggatggattgagatgtaacctgttc

SEQ ID NO: 40191 - DNA, 392 bp, Zea mays
  Clone ID: LIB3062-038-Q1-K1-C8
gacatcatggaaagatgagcatggagatgaattactttttgttagcaataaggctagtttggagcctccaaaagctatgcgtggaggaataccaatatgctttccgcagttctccaactttgggaatctggaaccacatggatttgcaaggaataggacatggagtgttgatgatgatcctccgccatttccagtgccaacctccaatagcgcttatgttgacttgatcctcaaacctactgaagatgatttgaagatctggcctcatagttttgaataccgactgagggttgcacttagtcctggtggtgatttgatgctaacttcacgtataagaaacactaatgcagacgggaagccattctctttcacttttgcataccacacatact

SEQ ID NO: 40192 - DNA, 387 bp, Zea mays
  Clone ID: LIB3062-038-Q1-K1-D10
cggggctgacgggccccatcccggcctgcctggccgcgctgtccaacctgcagttggtgacgggtctcccacaccaacgtgtccggcgccatcccggagtccctggcgcggctgcgcggcctcgactcggtggacctctccagcaaccagctgacgggcggcatcccggcgtcgttcgccgacctgcccagcctccggtcgctggacctcgggcacaaccagctgacgggcagcatcccggcggggctggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttc

SEQ ID NO: 40193 - DNA, 360 bp, Zea mays
  Clone ID: LIB3062-038-Q1-K1-B3
ccgcccacctcgtccctcacttgccctctccctgccaggcttgccggaaccctagcctcatggcccgtcccctcccgggccgagctccctatcgccggattcgtgctgcgggatggactccgacgtggagatgaacgccgccagcgacgaggaggtgatggacgatgaggattactacgactactgctacagcgacgtgggtgacgacggccacggcgggagcgaggaggagctggtgcccgtggactacgacgagggccttgaggccgagggtaccgacgaggtggtgtccagacgcgagcagacatttgtggttctaaatgaagaagttatatctgagcgtcaagaggaagatgtaag

SEQ ID NO: 40194 - DNA, 408 bp, Zea mays
  unsure at all n locations
  Clone ID: LIB3062-038-Q1-K1-D11
gctaccagcaccacagcctagcaccccaccgcgtctagggttttctgctccaatgggcgccgcggnggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctttgggccaagtccggatcccgtaagctcccccactcaagctctcgccgcatccatccctacccttacccaaatgctcacccgcttgccgctggtgtctggttcggttttgggacggtcttggctcgtcggctccatctgattcgctcgatccgtgggtctcgcttgcttcgatccccgcagcgggg

SEQ ID NO: 40195 - DNA, 466 bp, Zea mays
  unsure at all n locations
  Clone ID: LIB3062-037-Q1-K1-H8
agggcacaagcagaagttgcggttgtacttttcttcctccgccgtcggctcagatctctgggtgcgggctagcgatggcgtcgttctcggaggctcccccagggaacccgaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacaaaaacaaggctgtgatctgggaggagaacactctgtatgactacctgcttaaccctaagaagtacattcctggaaccaagatggtcttccctgggctgaagaagccgcaggaacgtgctgatctcattgcgtacctgaaggaagcaactgcgtaatataatgacancgccttgccatgaagagaaaatcggtttgcagtttaataata

SEQ ID NO: 40196 - DNA, 389 bp, Zea mays
  Clone ID: LIB3062-038-Q1-K1-A11
tgcatcgagtgccaggcgaaccaagccagcgcgaccagcgatgagtgcactgctgcttggggagtctgtaatgatgcgtttcacttccactgcgtcagcaggtggcttaagactcgtcaagtgtgcccattagataacagtgagtgggagttccagaaatatggccactagttcctgggcaccctcatgtgatgttggggcttacttctagtgactgctaccactcgagtgtatttttttctgccaaacagctccatcttttactgctttggatgcttgcatgtatcacaggtcaattatcactagtagtacgtccacctgggactgtatttggattgttcgttgagaggatagtagttccattttataaatgttatgtggattttcat

SEQ ID NO: 40197 - DNA, 309 bp, Zea mays
  Clone ID: LIB3062-038-Q1-K1-A12
ctgagtaacgccgatgtcgcggtcgatcagtaccaccggttcgaggaggatatacagctcatggcggacatggggatggacgcgtaccgcttttcgattgcctggtcgaggattctgcccaatggtaccggccaagtcaaccaggccggcgtcgaccactacaacaggtttatcgatgcactgctatcgaaagggattgagccatacgtgaccctgtaccactgggacctcccccaggcctctgaagacaggtacaacggatggctggacaggcagatagtgtacgactcgccgagtacgccgagacat

SEQ ID NO: 40198 - DNA, 426 bp, Zea mays
  unsure at all n locations
  Clone ID: LIB3062-038-Q1-K1-A2
tgaattcccggatccaggtgttttggatttgtcaattttgaaaatgcagatgctgctgttcaggctgttcaagagttgaatggcaagatgttcgatgataaggaactgtatgttggaagagcacagaagaagtctgaaagagagatggagttgaaggagaaatttgaaaagaatgttcaagaggtagctgagaagttccaaaacacaaacttgtatttgaagaacttagaggagaacattgatgatgagaaattgcgtgaactctttgctgagtatggcaatattacttcctgcaaggttatgcgggattcgaatggtgtcagcagaggttctggatttgttgctttcaaatctgctgaagatgcttaccgagctcttacggagatgaatggcaaatggtttggngcaagcccctttatgtagctc

SEQ ID NO: 40199 - DNA, 364 bp, Zea mays
  Clone ID: LIB3062-038-Q1-K1-A3
acgcgcttcgtgacttctctctcctctcgatcgattgcttcctccaccgaggcgggggaaagcggcgcgcagatcgccgtaggcaagcggcgatcactccagctttgagcataagtttctgcagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgctttgtgatcgatagagaagagtgcttctcgcataacgtggagtatgagggggatactgtccatgtatccttcgtcgtcatcaaaggctgacaccccgtggcatta

SEQ ID NO: 40200 - DNA, 352 bp, Zea mays
  Clone ID: LIB3062-038-Q1-K1-A4
acgctgctcgagcaccgcagaaaaagaaaaagattaggcaaaggcaaaggaatcccaatcaggcgagcagggggaagaaccagctgctgcggagtgcggagatgtcgtcgcagctgatcgaggagcaccggtcgggcgcggaggtgcacgttgggcacgagctgtgcgagcgcaagtcgcgcgagttcatggtggagctggtcctccccgactggctcctgccgctgaccagcctggacgaggtgggctacaatcggtcgacggggttcgtgtggctgcggcaggcctgcggcctgacccacaccttcgggttcatcggcaagcaggtgtggttcgacagggaggtaacggc

SEQ ID NO: 40201 - DNA, 424 bp, Zea mays
  Clone ID: LIB3062-038-Q1-K1-A5
gttgaaacagatccacaagacaggacccaactgcggctaacagttgcctcgggcgagcaatgtttgacattcgagttgaaagagttcatcaaggaacatctggttgatatcccaaggactcaggtcgctccacctcgcgcagcagtccagccacagttgcctactacagcacctgccacatacaatgaccctggtaccatgcttgctggattgctatgagaagtaacccgaaggaatagtgttttgatgtacatggcagttatttaatacgaggatctaacatctccacaagcatcttgctgccaagacgtacacgtggagcaaccaagaaagagctggcggagtgtagtctccatgaggattctaaaccgagaaagagcttagattctttttgtgcgggttcaaggcccccttcctcttcatg

SEQ ID NO: 40202 - DNA, 311 bp, Zea mays
  Clone ID: LIB3062-038-Q1-K1-A6
agcgaacagagcactgaagcagagctagcgatctgtccggccaaaccctcacggccgcctggacaatgccgcgccatcgggcgctgctcctgcccctgctactgctggcctcgccggcggccacgcgcctggcgtccgccgtctgcgcaggcgagaagttcccggcggggcgtgcgtacgcgtcgtgcgaggacctgccgaagctgggcgcgtcgctgcactggacgtacgacgcgtccaagagctccctgtcggtggcgttcgtggctgcgcccgcagaaggtggcggatggatggcgtggggcctgaac

SEQ ID NO: 40203 - DNA, 350 bp, Zea mays
  Clone ID: LIB3062-038-Q1-K1-A7
ggcggctgtgctgaacagcaggaagacgcctcaggcggtggtggccgtgctggtggcggcggcgctgctggcttcgtcggcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattcccatcagcatgtccaccga

SEQ ID NO: 40204 - DNA, 269 bp, Zea mays
  Clone ID: LIB3062-038-Q1-K1-A8
ggaaggaactgcttgaagtgatggcccacatgtctcatgttgacagcagcgttgaggtcatgggaagccttctgtttggctccgatgacggtccaagggttctgaaagccgtccgtgcacctggtgaacctctggttgatgattggagctgcctcaagtacatagttcgcacttttgaggcgcgatgcgggtccttggcgcactatgggatgaagcacatgcgatccttcgcgaacatgtgcaacgctggcatccttcctgaagcagtg

SEQ ID NO: 40205 - DNA, 409 bp, Zea mays
  Clone ID: LIB3062-038-Q1-K1-A9
gggacttgcaaagagagttggagctaggattttgttgacatcaacatctgaagttggtggtgatccacttgagcatcctgaaaccgaggcctactggggcaatgttaacccaactggagtcaggagttgttatgatgagggtaagcgtgtagcagagacgctgatgttcgactatcacaggcagcatggcattgaaatccgaattgccaggattttcaacacctatgggccaaggatgaacattgacgatggccgtgttgttagcaacttcattgctcaggctgtgcgtggcgaaccccttactgtccagaagccaagaacacagactaggagcttttgctatgtcgccgatatggttgatggtcttattaggctgatgaacggaaacaacactggaccgattaacctt

SEQ ID NO: 40206 - DNA, 382 bp, Zea mays
  Clone ID: LIB3062-038-Q1-K1-B1
ggaccaagtgaagatgcatttggacgaactgcacagtttaaaacgtttgaagaacgagagggaggagacaattggaaaactgcggatagatattgggtcactgaaactccagtgtgacaacttgaaaacttcgctgtccaagaaagagtctgagaaagacagccttgcctctcaggttctgaagctgagaagatccgttgaaacccgggaaagggcgaaagcaaatggtcaaatttcagatgtgaaggacaatcagcatgctaataacaagcgcaccaagcacaataccggctccactgggagcattgctgcgctgccaggcaccaacagacaaggcgaaaacggtgactgcaatggtcctgacatgaggaactccactgac

SEQ ID NO: 40207 - DNA, 402 bp, Zea mays
  unsure at all n locations
  Clone ID: LIB3062-038-Q1-K1-B10
atcatatctccacacaactaagaagccagctgcagttaaagggagtgaagcaaaaggatggcgtcatcaacgggatcagagatgagcaaggaaatcgatgtccagcttagtccagaggagaaagaaagtttagatgagatcatcaaggaagctgagagcgacttggagtctgaggaagtcctggatcaatcccttgccattgttgccaagaatgaaggtttggacaaggacacaactacaaaactcacaatttacactgtaggtggtgttttgaagaatctgacagagggccccttgagtgttatggataagcacatatatgcaagacacactgtcaaaccatttcccagcctgattgaagctggaaaagacttggtgnttcatcatctcaaatatatttgc

SEQ ID NO: 40208 - DNA, 406 bp, Zea mays
  Clone ID: LIB3062-038-Q1-K1-B11
agatcatcagatagatcactggccctgtgctgattaccgcgcttcccatctgagcgggcaggctcccaggctacagggggagacgcagaggagacagctgctgcctggctgagacgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtggaggctagcggtgatggtgatggtgtacgccgtgggccacat

SEQ ID NO: 40209 - DNA, 410 bp, Zea mays
  Clone ID: LIB3062-038-Q1-K1-B12
acgggtgagctcatttaggtttctttagatatatctcgtaaagtgaaagaaatgtattgtgatagcgggttcagacattgtcgaggagttcaagaagcatgacaggaagcctgataagtacatcaaacattggtcagctgttaaaccaaagactggggtcccatatacaattgacattggatatgaacgctttcttgggccagagatcttcttcaatcctgagatttactctgccgatttctccactcctttgcccgagttgattgacaactgtgttcagtctgcaccaattgacacaaggagagctctgtacaagaatatagtattatctggtggatctaccatgtttaaagacttccacaagagactccaaactgatataaagaagatagtggatgaccgtgttggcc

SEQ ID NO: 40210 - DNA, 477 bp, Zea mays
  unsure at all n locations
  Clone ID: LIB3062-037-Q1-K1-H7
cttgcgttctcaaaccaacctaggcaattcgccgcagcctctcaccctcgcgagtcccgacctcccgcagccggcgcgcagatggcacccaaggcggagaagaagccggtggccaagaagcccgcggaggaggagcccgcgacagagaaggtggagaaggctccggcggggaagaagcccaaggccgagaagcgcctcccggcgggcaagtccaaggagggcggcgagggcaagaaggggaaaaagaaggcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctacaacaagaagcccaccatcaccttccgcgagatccagacctcggtgcgcctcgtnctccccgcgagc

SEQ ID NO: 40211 - DNA, 352 bp, Zea mays
  Clone ID: LIB3062-037-Q1-K1-G1
agaccacagccagtcagccacatcactagctatctgtgcagaggcaatggcgtccaaggtggagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctaccagaacttcaagatcacgctg

SEQ ID NO: 40212 - DNA, 277 bp, Zea mays
  unsure at all n locations
  Clone ID: LIB3062-037-Q1-K1-G10
ctctcgaccagactccccgtccgcaatcatgtctgaatccctctcaatccacttccgcgctggccatggaaggagaatcaggcgccccggatcgccgcccagcctccatggaaagggagtcctctcgatctgtgtccgcgctgtccatggaagaaaccttgctgtcagcgcgtctccacttggtgagtgatctttgggtagtcttgctatgaacaacaattccgtggtgctggtggacctgtggaagggcttgcggtcactaaagtgtangtggatg

SEQ ID NO: 40213 - DNA, 420 bp, Zea mays
  Clone ID: LIB3062-037-Q1-K1-G11
ccattgttggacgcgttcccctcctgcacgcaacctcatctcgtcctccagatccaggatggccgtcctccttgagacgttgggtccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaagcggcgggatctctcggtctgcagtcctgctccacctcgatggatgatgtctctgcgctgataattattggatca

SEQ ID NO: 40214 - DNA, 368 bp, Zea mays
  Clone ID: LIB3062-037-Q1-K1-G12
acggttcctgccgcgcctggtggagcggtacgctagggaggcgtgcgtgggccccgacagcgtggttccgtgggcacagcgcgagggggccgtcgccttcttcgacgaccggcctcagcaggaggccgcccagcgtggcctggggagccggcgcaaggccgtgcaggccgtaaagtggctgccgtacgccaccaaattccgctatgccttcgccaggagcatggtcgacaagccacactgctagctgcttcgcctcgcactcctcgcatcgcagctgttgccgtctggccccgtttccgctggataaagacatctgatcgctgtggcgcagccattctgatggctatatgtaaatgtctcgttgatgc

SEQ ID NO: 40215 - DNA, 290 bp, Zea mays
  Clone ID: LIB3062-037-Q1-K1-G3
acgctaggatggaggatgactcgccgctgacgattactattaagggtgcggtgacaggactcggctgggggaccatctggggcagggtcgacaccacctgatacgacttgccccgtgtggagcgcaacatgcggctccctggccttatcacaaccctaaaaatgtgcagcactatacggggccactttacccaccatcgggggcctatacatcggattttaccagttcgtacaaagccagcccaaaaagcgtcactttaaaaagggacccctgtgcgctttttttcccaa

SEQ ID NO: 40216 - DNA, 305 bp, Zea mays
  Clone ID: LIB3062-037-Q1-K1-G5
gtccttgtcgacgcatcatcgatcgagctgcacgttggttctggctgctctcctggtatgggtcccacgctgccgcggcgaggcttccggctcagttttattgtgtggtcggcggcgaggcacgcggcggccatgggatcccaccgcgacggcggtgtagaatgatagcagctgtaatacactactctgtactgtgatgtgcaagtagatagtactagttactagttagccagtgtaaggttcctccgtgtaacaagtcatcagcgtgtgatcctcttcgtctgttcatcaatatacacatttct

SEQ ID NO: 40217 - DNA, 370 bp, Zea mays
  unsure at all n locations
  Clone ID: LIB3062-037-Q1-K1-G6
catcacataaaaccantgcatttagaagcagcgcaatggcgagcagcaccatggtccgtctcctacacaggcttggccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaacccggagcctgaggtcatccactcncgctgggccatgctgggcgcgttgggct

SEQ ID NO: 40218 - DNA, 418 bp, Zea mays
  Clone ID: LIB3062-037-Q1-K1-G7
ctggcatgagcatggaccgcatggcgcggcgttccgtgtccttgctcctcgctctggctctcctggccgtcggggcggtctcagactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacggggagttcagcatccagatgaggctgatcccgggcaactccgcgggcaccgtgacctccttctacctgtcgtcgggcgacgggcccgggcacgacgagatcgacatggagttcatgggcaacgccagcgggcagcccgtggtgctgaacaccaacgtgtgggccaacggcgacggcaagaatgagcaccagttcta

SEQ ID NO: 40219 - DNA, 391 bp, Zea mays
  unsure at all n locations
  Clone ID: LIB3062-037-Q1-K1-G8
ccgggagctggaggtgatccactcccggtgggcgatgctgggcgcgctgggctgcgtgttgccggagatcctggccaggaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgncgncgagctcaaggtgaaggagctcaagaaacggcgctttgccatgttctccatg

SEQ ID NO: 40220 - DNA, 410 bp, Zea mays
  Clone ID: LIB3062-037-Q1-K1-G9
aggttctggaggactatcacgaagaacatccagaagttactgtccttgacccaccaaatgcggtcgagcatctgaacaatcgacagtcaatgcttgaagaagtagctgatttgaacctgtcaaatttctatggagaagtttgtatcccacgccagctggtcattacgaaagatccatcctctataccaacttctgtagctatggctggactaactttgcccttggttgccaagccattggttgttgatgggacgtctaaaggtcatgaactatatcttgcatatgacgaggcatccttgtcaatgcttgatccgcctctggttctacaggaattcataaaccatggcgggatcctctttaaagtgtatatcattggtgaaacaatacaagttgtccgcaagttctctttt

SEQ ID NO: 40221 - DNA, 86 bp, Zea mays
  Clone ID: LIB3062-037-Q1-K1-H11
cgggtgaaaaaaaaaaaataaaacaaaaaaattaaaaaaaaaaaaaaaaaaaaaaaaacaaaatgaaaaattaacaaactatttac

SEQ ID NO: 40222 - DNA, 402 bp, Zea mays
  Clone ID: LIB3062-037-Q1-K1-H12
gacgacgtcgtcgacctgccgagatgggtgcactcggtggtccgggaggagtggacggccggggtgtttgacgtggagctgatgaagcaccagaacatcgaggaggagctggtacagatgctgcagatagccatggtgtgcactgccaagtcgccagaccggcgcccgacgatggaggaggtgatcaggatgattgaggggctccgccagtccacctcggagagccgcgcgtcttctgatgagaaatccaaggagtcgaaccctccatcggtgtaaatcctgcgcagctcccttcgtccgcttgatcggttgttgttgccagttgcacctcatttgatttgttagctaatttatttatgattgagtttcttgtaaaccgtggttagcatctgctgcatttag

SEQ ID NO: 40223 - DNA, 401 bp, Zea mays
  Clone ID: LIB3062-037-Q1-K1-H3
cacacactgttcgaccaacgcgacaactttctgcaggaattttggaagactctctatatgaggatgatgagcctgactatgggcctcggcgaacgccaggtcactgacgcttcgaggatcaattggaagctgaagcactatctgataagcgtatcatcaacgcgaagacgccaaatatgagctgtaatgttccccgtagaccaccagaccctactgctcgtatgccgagacgttaagctgatgaatactcacgatagcgatagggcggagtcatagctatcaaactgactgcgctgatcttgaacattcaccgtctcgtgcgaagcaagatgagctggactaggagcaagagatctatgaacaatgtgaggaagaagctcctatctcagatgaacaaatgc

SEQ ID NO: 40224 - DNA, 361 bp, Zea mays
  Clone ID: LIB3062-037-Q1-K1-H4
cgctcgctcgacactgtcactagctagttgctctactagagggcgggtatagagctgcctgcaatccgccgctgaggagggaggatcggaagcgacgatgaggtcgtttgctcctgtctttctgtcggcggtcgtggcctgcttggacctgccggcacccggccagggcggaacttctaccaggacacagagatgacctggggcgatggccgcggcaaggtagtggacggcgggcgcgggctggacctgacgctggaccccacgttcggctccgggttccagtccaagagcgagtacctgttctgcaagatcgacatgcacatcaagctggtgccaggcaacttcgtggcacggtcaccac

SEQ ID NO: 40225 - DNA, 311 bp, Zea mays
  unsure at all n locations
  Clone ID: LIB3062-037-Q1-K1-H5
ccgccaccgaccccgtccgtagaggtccccaaacccgaaccccccgatcaccacgatcccagtccctccgcccgtcgccggctgcccctcgctgccggggccgttgaggcgcaagaagagtggcatccgctcccgctctccacggccgacctttcccttccgctcacccttcccaccggccagaccttcctttggcgccgcaccttcctctccccgctccgcttcaccggtgccgtggggtcccacctcgtctccctcttccacctgcccgactccgacgatggccgnctcgcattcctnctncacaacga

SEQ ID NO: 40226 - DNA, 245 bp, Zea mays
  Clone ID: LIB3062-037-Q1-K1-H6
acatctgcacttcatagagagttttctatgattttgttgacatcaacatctcgagttgtatttaatccacgggagcatcctcaaaccgatgcctactgtggcaatgttaacccaattggagtcacgagtttttatgatgaaggtaaacttctatcatatactcttatgttcgactatcacaggcatcatggcatttaaatcctcattgccaggattttcaacacctattgtccaaggatgaacat

SEQ ID NO: 40227 - DNA, 300 bp, Zea mays
  Clone ID: LIB3062-037-Q1-K1-F9
gaagtattccccgccgccgctgccatggccaccctcaaccctttcgaactcctcggcgccgacgacaacgacgacccggcgcagctgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaagtggacgggga

SEQ ID NO: 40228 - DNA, 383 bp, Zea mays
  unsure at all n locations
  Clone ID: LIB3062-037-Q1-K1-E5
accgcgtcttcgtactcgcctacctccgcggatcaaacctttcccccttctcccaattcccgacggcggtccatcccgtaacgcgagaccattagggagtgcatttcgatccacatcggccaagccggtatccaggtcggaaacgcgtgctgggagctgtactgccttgagcatggcattcaagctgacggtcagatgcccggtgacaagaccattgacggaggtgatgatgcttttaacaccttcttcagtgagactggtgctgggaagcacgtgccccgtgctgtttttgctgaccttgaacccactgtcatcgatgatgtgagaactggcacctaccgncagctcttccaccctgagcagctcatcaatgcgaaggagga

SEQ ID NO: 40229 - DNA, 370 bp, Zea mays
  Clone ID: LIB3062-037-Q1-K1-E6
cgtactctcatttctagacataccctgattttctacttttttttcatcaaagaggacacaaacacatgctgggttactacatatgggcggccggtaaacgcaactcttcttctatggacacatcttaccaccaccctttactacttcggctttccatgaagaggttgctcttatgcaccttccgatacaatcattctctcattcttttgtagatttcacgtttgagctgctgattctcacatccctactctacctccatgctcctcgattctcttatactgctcctgctcttaccatcttttcacatttttaagttgtagatccactacatgatgctactaaatatagactcttatcatattctatctat

SEQ ID NO: 40230 - DNA, 457 bp, Zea mays
  Clone ID: LIB3062-037-Q1-K1-E7
ctgggagatagagagaggagagggagggtttcctcaaagagaacctgaacccaaacccaaggagagaacactagcgttccctcaccagggcgggcgtccatcccagcagccatggcgatggcgtacaagatggcgacggaggggatgaacgtgaaggaggagtgccagcgctgttcatggagatgaagtggaagaaggtgcaccgcttcgtggtgtacaagatcgacgagcggtcgcgcgccgtgctggtggacaaggtgggcggccccggggaagggtacaacgagctcgtggccgcgctgcccggcgacgactgccgctacgccgtcttcgacttcgacttcgtcactgttgacaactgccagaagagcaagatcttcttcatcgcctggtcaccggcggcgtcgaggatcaaggccaagatcctgtacgcgacatcgaagcaaggcctgcggcg

SEQ ID NO: 40231 - DNA, 315 bp, Zea mays
  unsure at all n locations
  Clone ID: LIB3062-037-Q1-K1-E8
aattccctaatcgacccaggcgtcctctaaacaatcgtnaaactctgataatccatttccttttcatcattctggatactaaaaaagggtagcgtaagaccaacactaggctggacagtaaagctgaccttcattttacatccatcatgactcaagctttcaactacatttttctcacatcaactgaactttcttaactcctctctcttcttaaaaactcattattttgattcctgtcgcaaggactagcttcatacattatatgcttcttgtcgccactatccgatgactacaatataattctgttcactttct

SEQ ID NO: 40232 - DNA, 369 bp, Zea mays
  unsure at all n locations
  Clone ID: LIB3062-037-Q1-K1-E9
gctagctctctgtctcctgctcagagtcgcagttcgctttgttgtactagagcgctgagcagatctttccttgtttggtcattccngtacgaaggggaggggtccaagtgaagagaagagaaggcctgcgagcgatgggcatcgtcgacgtcgtctccgagttctgctccttgccgaggactcgccggcatctcaagaagaggaagcagttccagacggtggagatgaaggtgcgcatcgactgcgaagggtgcgagcgcaaggtgaagaaggcggtggagggcatgaaaggcgtgagctccgtggaggtggcggccaagcagaacaaggtgacggtcacgggctacgtggacgccaccaaggtcatgc

SEQ ID NO: 40233 - DNA, 466 bp, Zea mays
  unsure at all n locations
  Clone ID: LIB3062-037-Q1-K1-F1
ctagcgccggcgcctccatttcgttttcctcactctctcctccagctcagggtccggcggggaagggaaggcaagatgtacaccgcgaggaagaagatccagaaggagaagggtcttgagcccttcgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaagattgtgaggccacccaagaagggttcagctgttctgcgccctcgcaccangactctgactgctgttcacgatggcatcnttgaggatgttg

SEQ ID NO: 40234 - DNA, 343 bp, Zea mays
  Clone ID: LIB3062-037-Q1-K1-F10
cccacgcgtccggtctctaccgagagatgaattgctcaccaaactgttgctgaactagccgggcatgccatgaggacctggctgtagtcgagtagttctctgatatgcgtcacccccttgactgttgctggtagatagcttcctgcgtgggtgcgtctgtaaaggtgccgattgtgctttcgatttctcagaattttggggatcagaacaacccttcgtaactctttgccctgttgtaccaaactaggttagatggcaaaattgctgaaattttcttgtagctgttgacatgtatggtttcgttcgtatggatgtgaaaatggtacctcagttttggagtttc

SEQ ID NO: 40235 - DNA, 391 bp, Zea mays
  Clone ID: LIB3062-037-Q1-K1-F11
ggatcatcagtcccgagcggatcgaggcgcacgccaagcactggaaggatgctgactacctgggcttgaacacctacatgtggtggatgaacaacgccgatatcaaagtcaggagacccaattcgaggtactggtctgacaacgatgaggttcccaggattgaggcgtacggccgtgtgttcaagacatggtctgattggctcaatgacaacatcgatcctgcccgaacgtccatcttcttcatgacgatttctcctcctcacctcagcccacagaattggggaaacccggacggtatcaaatggtgtagaaagacgcttccatatcagaactaccggccacacttggatctttaacatgacatgcggctgtattacttaatggtcaatgt

SEQ ID NO: 40236 - DNA, 384 bp, Zea mays
  unsure at all n locations
  Clone ID: LIB3062-037-Q1-K1-F12
ctcgtcttcacctcactaacacgcagctagcaactctttctctcctgcaataatggccgctcgctcctcctcctcccaggcgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggcttcgcgggggcgtcagcatggccaacgccgncaacatccccggcaagtg

SEQ ID NO: 40237 - DNA, 459 bp, Zea mays
  Clone ID: LIB3062-037-Q1-K1-F2
ctggagaagcgtggtgctttgatagtccgtcgcctctgcgttcttctgggtgctgaaaaaggatagcgtgagttctccgctattcttgagagtgaagttgaccttgattttgcatccgtcatggttcaggctttgaatttgattttgctcacatcaactgaacttggtgagctccgctctcttcttaagaagtcgttagtggattcctgtggcaaggacttgtttcagtcattatatgcttcgtggcgccactctccgatggctacaataagtttgtgtttacttgctcaggcatacagtcatgcgagctgtgttattcagtcgctgggagaagaagacataaatgtgaaatttttggttcagttagataaattgatccgtctcttagagacttcaatatttgcttacttgcgtttgcagcttcttgagccctggaagcacacctggcttcttgaaact

SEQ ID NO: 40238 - DNA, 459 bp, Zea mays
  Clone ID: LIB3062-037-Q1-K1-F3
gaagcaaggagttttgacttctggtcgtgttcgtcttctgctccataggggcactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgtgaacacataccgcaggacattcactaccaagaacggcaagaaggtcagcaaggcacctaagatccaacggcttgtgacacccttgacccttcagaggaagcgtgctagaatcgctgacaagaagaagaggataactaagaagaagtctgaggctgctgagtaccagaagct

SEQ ID NO: 40239 - DNA, 378 bp, Zea mays
  unsure at all n locations
  Clone ID: LIB3062-037-Q1-K1-F4
gtcgtcgtcgtagcagagatgacctagctacgtgtgtgtcatgcatcaaactggcgggtagggcagaagcagaagcggcgggagctgcagctgagccagatgcgccgggacatcgccaagctcctagaggccggccaggaggccactgcccggatcagggtggagcacatcatccgggaggagaacatgatggccgcgcaggagatcctcgagctcttctgcgagctcatcgcggttcgcctgcccatcatcgaggcccaaaaggagtgtcctattgatctcaaagaagcaatatcaagtgtctggtttgccgctccaagatgtgcagatctacctgaactgatgcangttcaaatgatgtttgcaactaaatatggg

SEQ ID NO: 40240 - DNA, 372 bp, Zea mays
  Clone ID: LIB3062-037-Q1-K1-F5
acgctagcgccggcgcctccatttcgttttcctttctctctcctccagctcagggtccgggggggaatgtaatgcaagatgtgcacggcgaggaagaagatccataatgagaagggtcttgagccctccgagttcgaggactccgttgcccaggctttctttgatctggataactggaaccaggagctcaagagcgacctcaaggacctgtacatcaacaatgctatccatatggatgttaccggcagtaggaaggctgttgtcattcacgttccataccgtctgcgcaaggccttcatgaagatccatgtcagactcgtcaaggagctggagaaaaaattcatcggcaaggatgtggtaattgttgctaca

SEQ ID NO: 40241 - DNA, 332 bp, Zea mays
  Clone ID: LIB3062-037-Q1-K1-F6
cggaagccggttgcctacaccataaacacgttggccggtgctctgtacaaggtcttgagcggctcgactgatcaagctaggaacgagatgcgccaggcctgttttgattacttgagcctcggaagcgtcttctcgaatgggcctattgccttactctcgggtcttaatcctcggccactgagtttagttgcacacttctttgctgtcgctatctacggtgtcggtcgctagatgctccctcttgcttcacctaaacggatgtggattggagccaggctgatgtctagtgcatgcggcatcatacttgctatcatcaaagcttaaggcgtgag

SEQ ID NO: 40242 - DNA, 312 bp, Zea mays
  Clone ID: LIB3062-037-Q1-K1-F7
agtagagcatgcacaacctcaacttacagatcttaattggcagatgcacactgaggacaacgatgtgccactacgatggcgactgctaaggcagcttttagatacgattgatgatgaacaaccggctgatgctctgctagctattcgtacttgaggtgatccaaaatgttcgagcgacaactccaatgctgcatcatatgacaagctatgtcaaggcgtacaagcgtgaagaaccgatctgcatcttgggcatgaagttacctacacactacatacgaagaaagctcactgagtccagactgatatactact

SEQ ID NO: 40243 - DNA, 284 bp, Zea mays
  Clone ID: LIB3062-037-Q1-K1-F8
acggtcgtcgtcgtagcagagatgtcctagctacgtgtgtgtcatgcatcagactggcagataggaaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattaagaaagaacaattgatat

SEQ ID NO: 40244 - DNA, 454 bp, Zea mays
  Clone ID: LIB3062-037-Q1-K1-E4
cgcattgcgagagaaagcctgattttgtactctttcttgatcaaagaggagagaaacagagggtggtggacgacgggtcggcagcccgtaagcgcagctcttctgcgatggacacagctgacgacgacccgttacgacggtgggtttgcaggaggaggttgctcttctggaccttgtgatgcgatgattctttcattcttttgtcggtggcccgtttgagctgctgattctgacagccctggtcggcgtccatggtcggggattctcttatgctgctgctgctgctaccacctgttgatatttttaggtggtagatccagtacatgaggctactaagtagggctccggatcatatgggatctatccttgtgctttgcgtcaaacttctttgacctagaaaattttaaacttgggtgggttcggttggtaggctgtgtttgtctataaaaaatga

SEQ ID NO: 40245 - DNA, 264 bp, Zea mays
  Clone ID: LIB3062-037-Q1-K1-C7
caccatcatcggtaagatatgacttatctttgcagtggtcacattcgcagtgctcaggcagatcctaatccagggcaggatcattaattatacctactttagctgtactttagattacacattgtaactacttgagttcttctccattgctgtcaccatcgtctttttgtcagtacctgaaaggctaccgcttgccttgacacttatccttgcattttcaatgaataacattatgaactacaaagcactcttcctgcacctttc

SEQ ID NO: 40246 - DNA, 432 bp, Zea mays
  Clone ID: LIB3062-037-Q1-K1-C9
ctgaattcccggggaagaacatgatacttctggggggaaatcaaaaggacaaggaaccggaaatgttctcattgttactcttgttgatgcggagacagaaagtagcataaacgctaccatgcttgaggaagggcttgcccggctcgaaagaagcaagagatgggacactagggagaggaagacggctctccagaacctggaacagttccaggacaaggcaaagaaggaaaggctgcggatttggcagtacggagatgttgaatcggacgaggacgagcaggccccgcctgcaaggaagcctggaggtcgtcggtagagactgggcagtgtaaggctgcagtctggcatgctatgaaagttttggacaaccacaaatgttggactctgccgggagttatagatgaagacttactgaagggtaccgtatttata

SEQ ID NO: 40247 - DNA, 361 bp, Zea mays
  Clone ID: LIB3062-037-Q1-K1-D10
ggttattcttgttggtggctcaactagaataccagctgttcaggagcttgtcaagaaaatgagaggaaaggaccccaatgtgacagtcaaccctgatgaggttgttgcacttggagcagctgtgcaggctggagttctgtctggcgatgttagcgacattgtacttcttgatgtgacccccttgtccctagggttggagacactgggtggtgtcatgaccaagattatcccacggaatacaaccttgcctacctcaaagtcggaagttttctcaacagcagctgatggccagactagtgtggagatcaatgttctccaaagagaaagaaaagttgtgagagacaacaagtctattggtagc

SEQ ID NO: 40248 - DNA, 283 bp, Zea mays
  Clone ID: LIB3062-037-Q1-K1-D11
cttccacgaggagaacccgagctgctcctaataataatgaccaattgttggcaatgagcacggtcacttctgaggttgatgatgagattgttgatgtaaagcccatagtatcaatgtctggtgaaaggatggatactttaaatttaaaggaatcttacttaaaggttgaccatattattatggaaggttttaagaactttgattaacctacaaggttccacaaaacttattatggttattaccttaaagaaccatattgggcaacttatgaatttgatcactt

SEQ ID NO: 40249 - DNA, 400 bp, Zea mays
  unsure at all n locations
  Clone ID: LIB3062-037-Q1-K1-D2
ctcctcccagccgcagctggtcgcggcggctgcggtcctggcagcggcgctgctgctgctggcggggggggccgggacggcgtcggcggcagtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcagcgtgcccatcagccccaacgtcgactggcccaacgatcaactgatcgatggaaccatagtggagggagct

SEQ ID NO: 40250 - DNA, 459 bp, Zea mays
  unsure at all n locations
  Clone ID: LIB3062-037-Q1-K1-D3
cgatggctccgacaccacttctcgctgcccccgtcatgcctcccatcgcgccacctggcacggctcccgcaccggctcgcgtttctccggccccaagtccaagcgtcgccccgaccccgtctccgacagaagctcccaccccgtcgcccacagaggccccgaccccgtctcccacgctggcgcctacactcgcgccgttgagctcggtgtcggtgagcccgtcgctggcgccggggcccgcgctcgctcaggaggacgagtcggcggcgccaagctcgcgcactggcgtcgtcgcggccctggtggccgccgggctcgtcgtcggcttgttntaagaagtagagctgcggcgtttattaccgctatacgtccgtaccgttcctcgcacgggtctctngttctcctgttggtgttctcatggattgatgcacgcacgaaccattcttgctgtacaacaca

SEQ ID NO: 40251 - DNA, 335 bp, Zea mays
  Clone ID: LIB3062-037-Q1-K1-D5
acaagacgagcgactactgccgacattgacacctgacttcacgctactaccagctatcgcggcgtgtgtgaccatacagagccccatgccgacacgatcagcgacgacaaccgcatataccgcaaagactaactacgttgacgcactgcctggcactctgcagaatgctactagacgaataatcgcccatggctgaaccatagatacacatggagcatgcagctggactgtacatgcactgaaatcaaatgcaacaacactatcgcccacaggaccatggtgaaactcttgcacggagggttcagcatcacgacttgtaactgcatggcacacca

SEQ ID NO: 40252 - DNA, 200 bp, Zea mays
  Clone ID: LIB3062-037-Q1-K1-D7
taccataacgttagctcactactaacttcatattcatcaacatcatacatacatctatctagctagacacacgtgataggctctccactcacttcatcatttctttcaacctcaccatcactttccccgtcacaataccatttactgagctcctgattcttctaacaccttgttcatccacactagtcctaataaacacc

SEQ ID NO: 40253 - DNA, 353 bp, Zea mays
  unsure at all n locations
  Clone ID: LIB3062-037-Q1-K1-D8
agacaaaacactcccactgtcccacacccttagtccacagactcgcactgcactcgggcaagccanngaggctgggaaggatcagggatccatccaccgttctgtcttctcaggtcgacaggaggccagaccaggtgcgcgcgtccgtgtcggcgatgagcgcgggcgggagccgggcgcggcagaacgcgatgcgctcaggggtggtggtgctgggcgccgtggccttcggctacctctccttccgcgtcggcttcaagccctacctcgaccaggctcaggaggccatcgactccgcccgcgaccccgaccctgaccncgccaccaccgncgcgagggacgcctncgacgat

SEQ ID NO: 40254 - DNA, 278 bp, Zea mays
  Clone ID: LIB3062-037-Q1-K1-D9
aactaatacaccttctctaccacaaatctctcaaagacactctcaactaatccctccaccgacacctcttctaccaatactcttaatatcttcaacacaaaatcaaatccaacctacacatctataaccttcaccttatctatatactcatctacaatactcaacctcaatacattaacttccacaacccacatccctacattattccattatcaccaaaactacactaaattcacaataaatcccccttcacctaaaattatccaaatcattttcaa

SEQ ID NO: 40255 - DNA, 347 bp, Zea mays
  Clone ID: LIB3062-037-Q1-K1-E1
ccccaaatctctccttcctcacacacgcgaagctgagagaccaaagaagaagaagaaggagggagcaagcagaaagttagctagctgctagcgtggaagtgcccaaggcgagagagagaggcaagctagctaggacggccgcgacaggctagccagccagctggtagctcctgcggacgaggcgatggctggcgccgacgtcgacgtcgggacggagctccggctcggcctgccgggaggaggcgccgcggcggccaagaaggacaccatcgacctcaagctgaagctgcccaccgccggcattgaaggaggcgctgccgccgccaggccggagccgggagccgaga

SEQ ID NO: 40256 - DNA, 405 bp, Zea mays
  unsure at all n locations
  Clone ID: LIB3062-037-Q1-K1-E11
ctttgacgaagggccactgaagaaatttgaagaggctacatcccagaacaaataccaaccagggtnggggatcttccacttgaagtgcgccaaggtgatgcgcatccagaacaccttgggttgttgtcacaccagttctgtaagcagcacctttgcttacccctgttgacttgcgcatctttcgtgcggaggaatggtcacacaaacagagccagccatcagcagtaggttagcttgtgtagagagggagagagagagagaggcctcgacacttgttcctagaaaatccttcttggaaattaattatgtgttaccaatgacttgcaactggagcccgctgggatatatatatgtaagaacttcacgctgttgtactactaaactatgagctatccatggtgtgtc

SEQ ID NO: 40257 - DNA, 356 bp, Zea mays
  unsure at all n locations
  Clone ID: LIB3062-037-Q1-K1-E12
agaattcgctggaggcgcttttttcgaagtcggagagtacaccaagtacgaaaaggtcaagctcccacctaggctatgcgttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctaatggttctcgaggtgaggaatgtgattggggatagaggactggaagttgttgccgatacatgcaagaagctacgaaggctgagaatcgagaagggggacgatgaccccggccaagaagagcanggaggagtc

SEQ ID NO: 40258 - DNA, 365 bp, Zea mays
  unsure at all n locations
  Clone ID: LIB3062-037-Q1-K1-E2
atgagatctcttcttacccgcctcttcacctcaactcacattgtcatggcctcgtcttcctgctcgtcctctccatctcggcggttggtccacctcacacgccatctcgtctcctcttcttccggcgagctttcctcagtcggcgcccccgccaccgccgcctcagatgccgaccccgtgaaaagcccacgctccaccgnctccagggttcacgccgcggtgctggtctgcctcttcgaggaccctagcagtgggccacgggtcctgcttacaaagcgcgcttnctncctctcctnccactccggggaggtgtcgctacccggagggaaggtggacgatggagacgcagatccgaaggccacagc

SEQ ID NO: 40259 - DNA, 372 bp, Zea mays
  unsure at all n locations
  Clone ID: LIB3062-037-Q1-K1-C6
catcgctgtgatccctccaccctcctcgtccccctagccgtgtcgcgatggccaccggcggcgccgccgccgccgccgcctgccctctcctgctcctcgccgcgctactcctcgcggtgtccgccaccacgagcgcgctcaccgacgacgtgctcgcattggtggtcttcaagatggacatctcggacccgtcgggccgcctcgcgacgtggaccgaggacgatgatcgtccctgctcctggccggccgttggctgcgacgcgcgcacgggccgcgtcacctcgctctctctcccggcggcgtcgctctcgggccgcttgccgcacgcgctgctccgnctcgacgcgctcctctccctcgcactcccgcgga

SEQ ID NO: 40260 - DNA, 357 bp, Zea mays
  unsure at all n locations
  Clone ID: LIB3062-053-Q1-K1-D6
cgactacgacgcanacgtccctgggggctcggcccagacgcgagattactacatggatacgtgaagccggaggcgccgcagccttgacaggtcgagctctgtgcggaggtcctttgaagtcaccgacccaaagccagtgccagtgccagtgccaatacctgttccagtgaccgcaccaccggccgccattgtcaacggcaaggaatcccctgcaatgggcagctcggagttctaccacttccaccacgccgaagacctgttcgaccaccgcttcagcaccaactcactcgtcgagggcttctccgncagcctggacgctgccttccacggccccgcgaaaaaccgccgcggtggcgc

SEQ ID NO: 40261 - DNA, 185 bp, Zea mays
  Clone ID: LIB3062-053-Q1-K1-D7
cggacgcgtgggattttttgttttgttttgttacaatagcaatttggttcccgttgggaagctgatatcggttagatgctggtatagaggaaatctgagttttggcagcacgacctattattgcatggtgcttctgcttcatgctgttcggtccattgtatcgaatatgccgtagagatggcact

SEQ ID NO: 40262 - DNA, 384 bp, Zea mays
  Clone ID: LIB3062-053-Q1-K1-E1
gttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcattagtacaacta

SEQ ID NO: 40263 - DNA, 425 bp, Zea mays
  Clone ID: LIB3062-053-Q1-K1-E11
actcctgctagttggggccaagctggaggttgtcatcatggagatggccaaggagatacaggacaaggcgacggtcatcaagggggcgcctgtggtggagccaagtgacaggttcttctggtttaaccgccctggctgggtcctcttcctcatccacctcacgctcttccagaacgccttccagatggcgcatttcgtttggacactggtaggtttggacaatggtagcctgtaaaagatcctcgagtgttctgttcatccagtcagtgcagcataacgagcagaggctgacttgcctacctcttttctctttggctggttcgtcctggcgcagctcaccccagacctgaagaaatgctaccacgagaggctgggcctgagcatcatgaaagttgcggtgggcctggctctccagttcctctgca

SEQ ID NO: 40264 - DNA, 429 bp, Zea mays
  Clone ID: LIB3062-053-Q1-K1-E2
aggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcacctactgcactggccttctgttggctcgccgtgtgctcaagatccgtggtttggatcaagagtacgagggcaatgttgacgccactggtgaggacttct

SEQ ID NO: 40265 - DNA, 446 bp, Zea mays
  Clone ID: LIB3062-053-Q1-K1-E3
cacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaat

SEQ ID NO: 40266 - DNA, 456 bp, Zea mays
  Clone ID: LIB3062-053-Q1-K1-E4
gcaggattgattctcgggaggggcgttggttcggacagagaggccgcgaagcttctggctgcagaagaggcactgaagaccttgaaatcaaccactgacccacaaattaagaagtatctgagacctgtaagatgcaatggctgattcccttccacgttctgagctccgcaaccaaatgagctttagctcatttcaccgttacagatgtcattgatttagcagaagtgcatcaccctttctgtgagtatggttgacatctcacctcgagcacatgatgtgtgccaaacacatgtcttgttctggaaatcctggctttgaaggtggtaacatagagagcggacatggtgctttatgcattcttttgaccatcatacaagtatagatgttatgtcttgtttaggatagtggcatagttggctgtaaacaagcaggagagtagatgcggatctaaaattc

SEQ ID NO: 40267 - DNA, 385 bp, Zea mays
  unsure at all n locations
  Clone ID: LIB3062-053-Q1-K1-E5
gagacgccgccggactgccgtgcccagcgcccgtgaccatcccatcccatccggtcatacatgaaggaccgccgtggcagctcctccgtcggcggcggcgagcgcttcgccgttttccccttctccatgggctgcatgtcgcagtccgccgtgtccgtcgccgaccccggcgacaagaaggcgcagggggacccgtcctccactgccgccgccacggtggctcgggcagcagcagcaggttcatcggaagaaggcgccggcgaggccatgacgaaggagaaggccgtggcgtcgtcggcggcggcgacgccggggctcgtggcggccggngtgtcgaggctgatgaaggggatcccgagcctgtcgcagatgttcgcgggggaag

SEQ ID NO: 40268 - DNA, 404 bp, Zea mays
  Clone ID: LIB3062-053-Q1-K1-E6
caccaacagctagtgctagtcccccttcctttcatccatccatggcatgcgtcagcaggttccagagctgccccattgccagaagagcaaagatcaacacgaggtccaggggctgcagcagtagcgtggcgaaggggtcatcaccaccagccttccagttccagtgcagggcgtcgactttcgcggcggacaccagccttcggctcgagctggacgagaaccccgaggcgatcatctcgggggcgtggcccgggaactgctgactcctcagctacgactaccttcgcgcctacctcgagtcgcatgagacggcggcctaggcagacggtcagcagcgcggcgtggcgcttctgagcgagaccatgtccacacccgtgctggtggccacagcagaccagaccctg

SEQ ID NO: 40269 - DNA, 350 bp, Zea mays
  Clone ID: LIB3062-053-Q1-K1-E7
cgcttctgccggtccgcgcttgtgcggtgggcgaagtgctgttgttggtgcgggaagcgtcacacaacctagcgggtgctgaccttggtgggggagcgaggagtcgacacaagggtgagaaccatgagtgatacagggtacactgtgcacgtcactaacctatagagcagagtatgttacagggatctgtatgagtccttttcgtgctatggccctattgaacatgtataacttatcacatcatgagaatacggagctactgcttatgggacatatactgagcgctttgccttgtaaactgcggtattgctaagtgaggctactattgtggatcagacggtatgcataac

SEQ ID NO: 40270 - DNA, 391 bp, Zea mays
  unsure at all n locations
  Clone ID: LIB3062-053-Q1-K1-E8
cgaagagagtgggacgctgggtgatatatgggagactgtatcaaacagtgatcttgggttgctactgatatctgattctgctcaggctgataactacgagaaaattttctcgcacatgaaaccaaacagtattcttggtttgtcacatggatttctccttggacatttgcaatctctgggttttgatttccctaaaagcatcagtgtgattgctgtatgccccaagggaatgggcccatcagtcagaagactttatgttcaaggcaaagagatcaatggtgctggtatcaatgctagctttgctgttcaccaggatgttgatggaagggcaacagatgtagctctagggtggtcagtagctttaggttctnctttcacatttgctactact

SEQ ID NO: 40271 - DNA, 314 bp, Zea mays
  Clone ID: LIB3062-053-Q1-K1-E9
tcgacccacgcgtacgagtcctgtgccatcgagaagatcgactattgctgaacggaaacaaccgaaaactggtgagcagtcgccacatcgcgacgggaaaattgaagacatagaccaggtcaatgtgaagctggtccggaagcaagaggacagaagactaccaatgctggacgtgcggcttatctaagctaaccgaagtcaagaggacccaagtttatgaccgcctacagcattcatgcatgctgtatgagaacaatcgtcatctcgacattccaaaacagaacaatcactggctgtaacgtccgaggagatct

SEQ ID NO: 40272 - DNA, 402 bp, Zea mays
  Clone ID: LIB3062-053-Q1-K1-F10
cggacgcgtgggcgaaccacaacgctcaaccagctgacccctttggtctcaatccgagttctgctattccaggatctcagctatacaacacaccaactcagcagcctttccagtcacaacagcctctgcagcaggcggcgctctatgcgaatgggggtgctgtggaccctggaacgtcttacgatcaggcatcccagtttaaaaatgttagttctgggtggaatggtcaagctgccaaccctgctgtgcccctgccagagcaagcactgaattacgatgatcaaagtggaaaccttccaccgcctccttgggaggctcagccagcgtcaaacaatgaattgccaaatggccaattgggaagcttgcaacctctcccaggttcagctggccagatcggtggca

SEQ ID NO: 40273 - DNA, 411 bp, Zea mays
  Clone ID: LIB3062-053-Q1-K1-F12
gccagaggatgatggaatacctgaggagatggaaggcgccgtcgatggattgtctgaaaaggtctccaggatgcactcctaaggcaggactgtccatggcgacagcaatctcgacacaaggtttctgtctggtgcactgtaatgccgactacacactgtttggatcttgtgtacgcccacagctagttcaactaagatgtatcactagttcgtccatggaggaaggagaatggacgatgaagtgtggtcagcctgtcgaccatgaagtgttttcttccaatggagtctagggtatgtttgagttctacaacggcttgtgccgtacgaagtgtcagcagtgtacgaggaggaggatatcgctgtcagtacacattttgcctgtctagaaaattatgagtactttctacgatc

SEQ ID NO: 40274 - DNA, 382 bp, Zea mays
  unsure at all n locations
  Clone ID: LIB3062-053-Q1-K1-D5
gcgctgcgttccagagccagccaaagacgacgtgcccgccggagagcaccctggtgggatgccccgccgcagctgccatggacgcggcggccctcggggagaggaaagtcagggactactccagctacgtgacgtacgctactctgcatgactgagccggcgccacatcggcatgcagtaggaaacagagttccttgctgtcattttggctatttgttcttgtattcatgatgcgtgtgcactagtgtgtgttgtgattgttgtctatttgcattgcacgtgtgttgctgtcacatctagatcgtccatttgaactgccatgtccattatttcatgaaaaaagttgttggtgctntaataaagttgtaccttagttatcttc

SEQ ID NO: 40275 - DNA, 461 bp, Zea mays
  Clone ID: LIB3062-053-Q1-K1-F2
ctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcaggtggtgggatggccaccaatccgaagctaccgcaagaacacgatgtctaccacccagctgaagggcagcaaggaggatgctgaggccaagcaggaccaggggtcctgtacg

SEQ ID NO: 40276 - DNA, 415 bp, Zea mays
  Clone ID: LIB3062-053-Q1-K1-B9
atgaggatgagaagaagggagcagcagtgggcaccatgaaagtgaagacgggagaagaaggtaataagggtgcgtcagagcaatcggaggcacagatatttgtgcagatggtagcggcatttggattgaaggataagttcgatgaggagttcttgagaaggctgtttgttgctaatggacggaagagggagcttgctaggattgcatgcgtgcttggatttgaggaaagccttggagatattgttgaggaactaataaagtcagggaatgctatagaggctatatatgttgcccatgaagctgatttgcttgggaaatttccacctgtgcctctcttcaaatcttatctgcagaattccactgataaggctcaagcagtgttgaaaagtggaagacattccaggtctgcacttga

SEQ ID NO: 40277 - DNA, 408 bp, Zea mays
  Clone ID: LIB3062-053-Q1-K1-C11
cgaaaccctcgccgccgatcggtttcggagaagagaagcaaatcaagatgtttctcggctcgctcccgcggcgcccgagcaaggaggctgcgtacaagcagctgcggtcgcacatcatcatcatggcctcctgcgccgccgtcatccgcgccaccccttacatcctccatttcctcgcccgcgacggcgacatccaggaactcaagctcgatctgtaggcccgtccgttgcttccccacctccagaggtgctacaaaggcaaccgttagttcgaggccactgcaaggtactatggagttagtggctacagtgcctgcttaagtttctttgttgttccaagtttagtgacaaaactgacaatggtgtagcaactgggttgtgctgcgaccagtatttcgtttttgccta

SEQ ID NO: 40278 - DNA, 401 bp, Zea mays
  Clone ID: LIB3062-053-Q1-K1-C12
ctccggggttcggtttcgtgggtgagcggatcgagatggcggcgtcggatgttgagggccgctgcttcgtcggcggcctcgcctgggccacggacgaccactgcctgcacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcacggagctggacggccgcaacatcaccgtcaacgaggcccagtcccgcggcggccgtggaggccgcggcggcggcggatacggtggcggacgtggaggcggcggctacggcggtggcgggcgccgcgatggcggcggcggctacggccgtggc

SEQ ID NO: 40279 - DNA, 393 bp, Zea mays
  Clone ID: LIB3062-053-Q1-K1-C2
ggcaagaagaaagaatctgggaagtcatcagttttacttgatgtgaagccatgggacgatgagactgacatggccaagcttgaggaagctgttaggagtgtccagatggaagggctgctctggggcgcatccaagcttgtcccagtcggatatggtatcaagaagctgcaaatcatgatgaccatagtcgacgatcttgtctctgtcgacactctcattgaggactatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaattttccatagctatatgtctgctttgtgt

SEQ ID NO: 40280 - DNA, 327 bp, Zea mays
  Clone ID: LIB3062-053-Q1-K1-C3
gaaatgccttttgctgtatctggatgctggactcttgcggtcttgccttaccgagacgtgctgaccatcagataaggtgtgtaacaaggtgacacgatagagtttcgtctaaagcaggggacgaacaggcgcacactgtcacacttacgtgtgcggtttagtgttttagcacatcattactagtgcgatatgctcagtatgattggtgtcgtagtacaatattttgttgcatgatgtattataacacacactaatttggaggttcactaggtgctagataagcaacgacactcgtgcatgtatttgatgacgcttgaactcaactgt

SEQ ID NO: 40281 - DNA, 414 bp, Zea mays
  Clone ID: LIB3062-053-Q1-K1-C5
aacaaaaactgcaaagtccctggatgggtctgccttaaaaacagggcaggaggaggagggtcctgaagaggctgatgctactgaaaaagcaatggaagaggttgacaacgttgtgaagtccctggatgaagaggtagaatcaaaggagatgcagaagcagcaaaagcaggatcataatagcatgagcctcaggaagcttagagccaagcacaagaaatatctcattgctgcaaaggaggaggaggtcactgaagggaagaggcttcctctcgaggaggtggatgagaatgcctgcatggaccactgaacagaacaagtaggcgaaattttgtgtggatggcgtctgccacaaaaggattgaatcgaggagtgtgctcttggtgtgaagtgataactaggcttacgcatgttcat

SEQ ID NO: 40282 - DNA, 254 bp, Zea mays
  Clone ID: LIB3062-053-Q1-K1-C6
gccatcatctcgtgcatcgggtcgctgggcagcatcctcggctccttcggcgacgtgtgcagcgccttcttcgggagcgaagctgcagacgctgcaggacgcgctgtgcaacacccgcaccgactgctacggcgacctcctccgcgagggcgccgcggactacctcaactccatcgacgccgagaagtacgcctacagcacgcagcaggttcaggactgcatcgtcgtcgcgctcactttcaaggtcgacgtcg

SEQ ID NO: 40283 - DNA, 403 bp, Zea mays
  unsure at all n locations
  Clone ID: LIB3062-053-Q1-K1-C7
ggataaattactatacctcaaggttctctaagcacgtcgacttctcagaagactactgacctaagctcaacgccgacgacgcctatgccactgcagaaatctttggacctgacgggaattctattggtcctcctatgggaaatccatggatctacatgtaccctaaaggcctaaaggatctccttatgatcatgaagaacaaatacggaaacccgcctatctatatcaccgagaacggaatcggggacgttgacacaaaggataatcctctatccatgcaagatgcgttggacgactacaagaggctagattacctncagcgccacatctcagttatcaaagaatcaatagacttgggggcggacgtgcgcggccacttcacatggtctctgttggacaactt

SEQ ID NO: 40284 - DNA, 377 bp, Zea mays
  Clone ID: LIB3062-053-Q1-K1-C8
gtacacaacggcagtgcctcattcatcatgcaaaaatcactcccgttattaaaaatccgtgtggcagctgcatgccggggcttggtggcatcgtgcctgctggggacagagcaggagctccacagccctgcctggtcaaagttgtggccacgggacaggggccccaagtcccagcctacctcttacacaggggccagctgcggggtggggcgggaagtgaggttcagctccagggacttagtgcctcagtttctccacctgcaaaatggagacgctaatgatgcctcccatagggcggggtgagggtgtatgagattcttcagggagaggttcaaagggtgctggtggccatgtcgtaagtactgagaatgcctggc

SEQ ID NO: 40285 - DNA, 338 bp, Zea mays
  Clone ID: LIB3062-053-Q1-K1-C9
atgaagaaactcaaaatgcaatcatgggtcatcccaagatacagtttccattatggattgaattgggagaaggaagccatccattacctctctgagaaagcgcaattgtgaaacctgccaagaagggacctaaggttgttaccttggcactccttaaccaggcacataacctacacagatatggaaaactatatcttcagatgtgcccaaagttgagagtaagactcgtatatggcaccagcttatctgctgcagtagttgagaatagtgcccctcagggcacatatcaagttgttctcgcagggaatatttccaaagttgctcgtgctgttgccgca

SEQ ID NO: 40286 - DNA, 419 bp, Zea mays
  Clone ID: LIB3062-053-Q1-K1-D1
cgaagatattgcaaagaatttgcggttgaatttgacaaaaaaggatggtggcttgttaaagatggaagcttcaaagcccggaaggaaaggggtaatgggtatcgatgccgaagtatttgaggttagccccaacttccatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttaaaaacttatgagctagtgcaatgtttttagccaatttccaatctttcgtgtatttgtgtagtttttactcttttattatccatttttgttttcccgtgtaataccaacaaaaacttgtgtagttgtgttattttctg

SEQ ID NO: 40287 - DNA, 417 bp, Zea mays
  Clone ID: LIB3062-053-Q1-K1-D10
agacgagccaccttatacgagatgataagggattatggacatgctgctaatgatttaaggaagctaatctcacttcttgaaaagaaagtcaatgtgtctggaatatcaccaaaagcttttaacaagcataaagatatcaagcaagcacatgcgaggctttcacacatacatgctgaagcaaaaaacgatacccccctgaatttgtatttaatcttgggagtggagccatcctgctcttcagcagatattaagaaggcataccggaaagctgcattgagacatcacccagacaaggctgctcaattattagtaaggaacgagaatgctgaagatggattttggagggatgttatcaaggaagtctatgcagatgcggatcatctgttcaaaacaattggggaggcatataatgttctt

SEQ ID NO: 40288 - DNA, 404 bp, Zea mays
  Clone ID: LIB3062-053-Q1-K1-D11
tcgatacgagcaaccttatacgacatgatattggattatagacatgctgctaatgattcagggaagctaatctcacctcttgaaaagaaagtcaatgtgtctggaatatcaccaaaagcttttaacaagcataaacatatcatagcaagcacatgcgaagctttcacacatacatgctgaagcacaaaacgataccccactgaatttgtatttaatctttgaagtggagccatgctgctattcaacacatattaataatgcataccgcaaagctgccttgaaacatcacccatacaatgctgatcaattatcagtaatgaacgagaattctgaagatggataccggagggatgatatcaatgaagtctattcagatgctgatcatctgttcaaaacaattgggg

SEQ ID NO: 40289 - DNA, 301 bp, Zea mays
  Clone ID: LIB3062-053-Q1-K1-D12
ggttcgtgaggctctccgagttcggttcgtggtgacggacgagatgccgcgggggatgttgagtaccgctgcttcatcggcggactcgcctgggccacggacgaccactctctccacaacgccttcagcacctacggcgaggtcctcgagtccaagatcatcctggatcgggagacgcagatgtcccgctgcttctggttcgtcaccttctacacggaggatgctatgcggaacgccatcgagggcatgaacggcaaggagctggactgacgcatcatcaccgtcaacgaggtccagtccc

SEQ ID NO: 40290 - DNA, 429 bp, Zea mays
  Clone ID: LIB3062-053-Q1-K1-D3
gcagacgcgccgccgctgccgaaatgcaaggaccgcgacgaccagaagtttctcgaactcgcccgcgccgcgcaggccgattggctcgtgtcgaaagaccgcgcgctgctgaagctcgcgaagcgcaccgcgcgcgacttcggcttccggatcgcgcaacccgcgccgtttgccgaggcctgcgcgctcgacgccgcgccggccgcccctgccacatcggcctgacgcactccgcaccacccgatttcgaccgtatcgatgaacgctccttcagacatgccaacgactcccgtattcccctcgcgcctgccgaacgtcggcacgacgatcttcacggtcatgagcgcgcttgccgtcgaaaaaggcgccgtgaacctcggccagtgtttcccggatttcgattgcgacccgtgcatcgtcgatgcggtc

SEQ ID NO: 40291 - DNA, 341 bp, Zea mays
  Clone ID: LIB3062-053-Q1-K1-D4
gcggatgctgcctaaatgcagggactgcttttaccagaaggttctcgtactcggcggcggggtgcaggccgattggctcgtgtcgaacgaccggtcgctgctgtagctggcgaagcgcaccgcgcgctacttcagcttacggatcgcgcaaccgactccgtttgccgaggcctgcgcgctacacgccgtgccagccgcccatgccacatactactgacgcactccgcaccagacaatttcgaccgtatcgatgaacgctgcatcagacatgccaacgactcccgttatcccctcgcgcctgccgaacgttggcacgacgatcttcacggtcatgagcgcgc

SEQ ID NO: 40292 - DNA, 358 bp, Zea mays
  Clone ID: LIB3062-053-Q1-K1-B8
caggctcaccacaccaaccagcaagcaaaaattccccaatcctctcgtctccgcggctaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgtcatggacgtcgtctacgcccttaagcgccagggccgcaccctctat

SEQ ID NO: 40293 - DNA, 445 bp, Zea mays
  Clone ID: LIB3062-053-Q1-K1-A2
agaggaggagaggaagggcagcggtggcgccgccgccggcggcggctcgacccctggggcgaatctaagggacctggtgtcgagggaatactacggccacaagaagaaggtgcactctgtagcatggaactgcctaggcacaaagcttgcttcaggatcgatcgatcataccgcacgtgtctggagcattgatccacatgtccattctaaggttaaagatattgaactgaaaggccacacagatagtgtagatcagctttgctgggatccaaatcatcctgatacagttgctactgcagctgctgacaaatctattcgtctttgggatgctcgaagtggaaaatgtcaagttgttgaacttagtggagaaaacatcaacatcacatataaacatgatggcactcagatagcttgtggaaacaaggaggatgagctgacgatattg

SEQ ID NO: 40294 - DNA, 332 bp, Zea mays
  Clone ID: LIB3062-053-Q1-K1-A3
gatcttatagagcttggctttcttcttgacggccagatcgccctggcagtccgatggggcgcgcttcacgccggctatggtggagacgtagactgcgccacgcctaggtgcaagcttgtacttgttgagccaatagacgtcagcgtcggcggcactgcgcttgcccatgccgttctttgactcctcatgcaggacgttctcgaagctttagatgaaggattttgaccgggacgcgaggacgatggagcgaatggccgtcagagatgcgacagatcatcaccatggaaggagaccatctgataggatgcggacgtgctatagtactctgcatc

SEQ ID NO: 40295 - DNA, 404 bp, Zea mays
  unsure at all n locations
  Clone ID: LIB3062-053-Q1-K1-A4
cttggtcctagagggagagagatctcgaactccaagggcgcatgctccggttgctagctacgatgccgtgtgcgtagctgcggcagcccttgatcgatcaatcgatcgcttgtgcggaaggagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgncttctcctcttgtgaacaacccggccgcgccgnncgccaagaagaagcggaaccaacccgcagaccctgacgcggaagtgatcgcgctttccc

SEQ ID NO: 40296 - DNA, 383 bp, Zea mays
  unsure at all n locations
  Clone ID: LIB3062-053-Q1-K1-A6
gggagaagatgcagctggggaagaccgtcgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgacgnccggggaggacttctactcctcgctcttcgcgtctcccagggtcaagggg

SEQ ID NO: 40297 - DNA, 372 bp, Zea mays
  unsure at all n locations
  Clone ID: LIB3062-053-Q1-K1-A7
caaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtccatggcaacggccatgaccaacttgatccccgncatcaccttcgtcatg

SEQ ID NO: 40298 - DNA, 344 bp, Zea mays
  Clone ID: LIB3062-053-Q1-K1-A8
gcaatttcgccctcgattcgaccccgattcgtccgcccgcgaccgggattccctccggcaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaagccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggt

SEQ ID NO: 40299 - DNA, 300 bp, Zea mays
  Clone ID: LIB3062-053-Q1-K1-A9
cggtgttggcttctcctaccccaccggttcgtgttcaggttctggttcgtgggccgagagcggaagagcatggcctgcgtctggacggtgagtaccgatgcttcgttggcggtctctgctgagccaccgacgaccactatgtctacaacgacttaagaacctactgagaggtgctctagacgctgatcatactggatcggtatacgcaaaggtctatacgatgctgatgtgactcactatccacggtagactcaatgcgcacaacgactgagatcgtgaacatccaggtgctattgtgac

SEQ ID NO: 40300 - DNA, 364 bp, Zea mays
  Clone ID: LIB3062-053-Q1-K1-B1
gttgagtattcactgcatgttgtaaaagtcgtcaatccaccaccactccgtaggggagagaagataatagaggagcgcgcgatcgatgtcagactctggcgatcgtcatgtacgcggtcctgcgggtgcccatagaggctggtaaatcatggggactaagtctatgaaacgcggacgtgccgagaggagacagttggctccatggagttctacatatgtgacacctaacacagcaaggccagcatggggtggctgtggttcctcgcacccttgtggaaccagctgggctcaagctacagatcatggtgctgctaccagtggcaatcctagaccgacatcacaaacatcgcgccctgttctggct

SEQ ID NO: 40301 - DNA, 408 bp, Zea mays
  Clone ID: LIB3062-053-Q1-K1-B10
gttgattactatgagcatggtgttttggtgttgtattcaaagttctgagctatccttaactaactggtgctgtccgaagtggggtgcacaaaagcttttggatttgatattacagctgcttgtagtgggtttttagtcggcttaatcacagctactcgctttatcaaaggcggaggttttcagaatgtcttagtagttggtgcagatgctctttcaaaatacgtggattggacagacagaggcaggattgaggctgtttcatcctcctctgctgcgggatgggtggggtcgtcaccgtggcgtcactcgtggcgtatcgtgcagtatggacgacaacggggagctgtcaagatgggttacctcaagacggatgagttcctcaagaggggcgagagcggtggcacgtgc

SEQ ID NO: 40302 - DNA, 405 bp, Zea mays
  unsure at all n locations
  Clone ID: LIB3062-053-Q1-K1-B11
gcttacatctcaataatcgctctaattgtttgcattccacctgcattgatctttgaagggcccaagctaatgcagcatggatttagtgatgccattgcanaagtaggtttgacaaagtttgtcagtgacctattcttggttggactgttctaccatctgtataaccagattgctacaaacaccttggagcgagtggctcctctgacacatgctgtcggcaatgtgttgaaacgtgttttcgtcatcggtttctcaatcattgtttttggcaacaaaattagcacacaaactggaattggcacgtccattgccatagctggtgttgctatgtactcttacattaaggctaagattgaagaggagaaaaggaaaaagagcgcatgactgctgtgaataatattatca

SEQ ID NO: 40303 - DNA, 417 bp, Zea mays
  Clone ID: LIB3062-053-Q1-K1-B12
cggacgcgtgggatcggcgagtggcaatccaatggcacgatgaagatcatcgacagagggaagaacatcttcaagctgtcccagggggagtatgtggcagttgaggtcctggaaagagcatacctgcagtcaccccttgtggcatcggtctgggtctacgggaacagcttcgagtcgttcctcgttgccgtggctgtccctgagaggcaggctctcgaggaatgggcagcagccaacagcaaggccggcgactttgcagagctgtgcgctgatcccaaggcgaggacctacgttcgggatcagctgaaccaaactgggaagaaacttgggttgagaggcttcgagatgctgaaagcagtctacctggagccggtgcctttcagcatcgagaaggacctcgtcactccaacctttaaa

SEQ ID NO: 40304 - DNA, 450 bp, Zea mays
  Clone ID: LIB3062-053-Q1-K1-B4
gcggaaggcgagcacgaggagcagcagggagagggcggtggtggctgtgatggcagcagcagcagcagccccaagcaggcagtcaaccctggggaagaggaggtggtggaatctggtcctgtgacagcgacgcccaacgctgcttgtggattccaagaaagcagctatggcgtggtggaggtggagctcgtcttgcctgacagccccttcgcgccccccaccaaggaggaggcctcatacgctgatgctgtcactgctgcagccgctcggaacggtagcaccagcagcagcagccctcgccatgtggcccttttcgcacccgcgtcttccaccaccctcgagctgcccccctacagctcctcctgcttctttcaggtgcccaggttttctcctgggcatgaagccattgggctgtgatgtgaggtgcacaggacaaaaaatggggagggg

SEQ ID NO: 40305 - DNA, 380 bp, Zea mays
  unsure at all n locations
  Clone ID: LIB3062-053-Q1-K1-B6
aattattagagtaagtacgttaaataattaagaatgaaaaattaatccttactgcaggatggagcttcatttaggaggagagaacaggcaaggcttggcacgaagctccttgtgctgacgaggagatcgttcctgaacatgcacagggacgtagggtactactggatgcgtctggccgtctacatgggcattggcgtgtgcctaggcactatcttctaccaacttggctacagcagctacagctctatccagagtcgatgtgaagtaatcatgtacactatcgcactcctaactttcatgtctatcggaggatttccatccttcgtagaagacgtcaaggtgttcagaaaggagaggctgagcggncactacggcgtgtc

SEQ ID NO: 40306 - DNA, 370 bp, Zea mays
  Clone ID: LIB3062-053-Q1-K1-B7
cgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggcctcgtcgagggcttccgcatcaacggcctcgacggcgtcggcgagggcaacaacctctaccccggcggccagtacttcgacccgctgggcctcgccgacgaccccgtcaccttcgccgagctcaaggtcaaggagatcaagaacggccgcctcgccatgttctccatgttcggcttcttcgtccaggccatcgtcaccggcaaggggcccctcgagaacctgctcg

SEQ ID NO: 40307 - DNA, 438 bp, Zea mays
  Clone ID: LIB3062-053-Q1-K1-A11
tgctcgtaccggttcccaattccgggctagtcgtacgccagcgccggcgcctctatcccaggtctccattggtcgcttcgccaggtcctggttagaccccagctccgccacgagccactctagttatcggatcccgcatcgtggaatgcttgccatagggaggaaggtagctggaaggcgtgaagaaatgtctgcaaattatgcgtttggaccacaggatgatgatgcgactattaaacacaggcttctgactaggacaacgaccaccatgggtgaaccgtcactaaagaagcttcagaagaagttcatgtcctttgcaactgagatcgagaaggatgcagataacataagtgactgtgaaagactgtacaaggcctttctacatgaaattaacacctttgagctacctattctgaaaagcaaggctgtggttgatgc

SEQ ID NO: 40308 - DNA, 149 bp, Zea mays
  Clone ID: LIB3062-047-Q1-K1-A10
tgcaccagccctatggcactatataatatataagactagggggagaagttttccttcccccggaaggcacggctgtacatattatattagggattggttggttgtttgtgcaggcatttttgtatgcatgatattcggcctgtatgggt

SEQ ID NO: 40309 - DNA, 296 bp, Zea mays
  unsure at all n locations
  Clone ID: LIB3062-047-Q1-K1-A11
ccatgatcgatctatgcagagcaatgtgttccttggcaacacaaaattcaggctaccctatgttggctcgaactcatgggcagccagcatcaccaacaactgtgggaaaggagatggcaaacttcgcggccagattatctgatataggaaagagtttctcagaggtgaagatactagggaaatttgctggcgctgttggcaattacaatgctgatgtggttgcatatcctgaagttgactggcctaaggtggcagaagagttngttagatccttgggtttgcagtttaatccctat

SEQ ID NO: 40310 - DNA, 323 bp, Zea mays
  unsure at all n locations
  Clone ID: LIB3062-047-Q1-K1-A12
gtcgcatacataaaccagtgcagcagaagcagcgcatggcgagcagcaccatggccgtctggtcaagccttcgcggaaggcagtgaacgtgccgtcgctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggngctgtcggcggacccggagacgttcgccaagaaccgggagctgga

SEQ ID NO: 40311 - DNA, 365 bp, Zea mays
  unsure at all n locations
  Clone ID: LIB3062-047-Q1-K1-A2
gaccgctaatgtccgtccccggacaggtgatcaacctccgtataangaagatacattagcaaaatacacaataaatccagcaatggtgaacgggttttcagactttgttggttctgttgaggtgggaaaattagctgaccttgttctttggaaaccatctttcttcggcgctaaaccagaactggttgtaaagggaggtgcaattgcatgggctaacatgggtgatcccaatgctagcattccaacacctgaacctgttgtgatgcgacctatgtttggtgcatttggaaaggctggaagttccaattcaattgcatttgtgagcaaggctgctaaagaagctggtgtcgcaacggagtacagac

SEQ ID NO: 40312 - DNA, 334 bp, Zea mays
  Clone ID: LIB3062-047-Q1-K1-A3
gaagaagctgccacatactgatactgatgttcagttcaaggtgatgtttggaaaatatgggagcatggctagtgctagagttatgcgggatagcgatggaaaatacaggtgtgacggatttgtcaagtatcaaaatgcacatgctgcttatcaagctgttcaagagttgaatggcagcatattcattgattaacaactgtatttcgaatgatcacataacaactcttaaagatagattgattcgaacgataaatttgacatgaatgttcactaggtagctcaaaagtttcgcatcacagacttgtatttgaagaacttacaggagaacatcgat

SEQ ID NO: 40313 - DNA, 388 bp, Zea mays
  unsure at all n locations
  Clone ID: LIB3062-047-Q1-K1-A4
ctccttcaagttttagagaggcatcagattgatgcagaaatatccaatacttctgaagaaagagctctacatgaataatttggcacatgatcttgctaggtcagttgctggtgaagatatccttgtgatcttagatgctgagaatgtacgctgcaatagaaattatgattaccgttatgcacaagtgtcaacttctagcttacaatcaatagatagcaaggcttggccttccaaggcaaggtcactagttntcaagtcaagtgcagaattgcagcatgtcagcgaagttctttcagtgaacaaatatttgcgtgttttggatatcagtgggtgttctgtgaaggagatgcccgctccaatttttcagatgaaacaactgagatatctt

SEQ ID NO: 40314 - DNA, 107 bp, Zea mays
  Clone ID: LIB3062-047-Q1-K1-A5
aattccctgtccatgccccgttattcaagacggcagcacgcatgacttgctatcctccggcttgtgcacttcgacagcctacttaccggcgaagccccttctaaacc

SEQ ID NO: 40315 - DNA, 413 bp, Zea mays
  Clone ID: LIB3062-047-Q1-K1-A6
catcaattgtcacaaaaactaatttcaagcatctgtattggacgctgacacagcaggtagcacaccacaccatcaacggatgcaacatgaggccgggggatatatttgcgactggcacactgagtggacctgaaccggactccctcgggtgcctgctggagctgacatggaacgggcagaaggagataccggtggggagtttgacccgcaagttcctagaagatggagatgaagtcatcttgacaggatgttgcaagggtgaaggctacaacattggttttggaacctgcaccgggaaggttctgccggcacttccctgagccaacacgtcttggtatcagttctccggagtctcaacgatctcagctatcagagagttgtctcaacggtctcaactatcaaagagttcatgc

SEQ ID NO: 40316 - DNA, 452 bp, Zea mays
  unsure at all n locations
  Clone ID: LIB3062-047-Q1-K1-A8
gagaaagatatggactcgtttggtattagacttagtgttggtcaaggaagacctgtgaatacgaatctgggtagtgagcacaagacagggtctggtcagcactcggacacaaaagatcttggtggtaatggcactagcagtaccggtgcttcatcagacagagggtcaaagaagaaaagggggaaagggacagggtctaccaaaggtggatcacttgaaaaggatgatgacaatgaagaaagcattcctgttaagggcaagaaatctcacagganaaacaaggatgcntgtgcatctggtgacatnaaacatggtggtaaaaaaacgtcagagaaaatgatagaggagaatgcaaatatctttcctgatgaatngatagaagaaaaagttttggcttgtgctccagagttagaagagttgggaagctctgatgactcaaatgccccccttaa

SEQ ID NO: 40317 - DNA, 309 bp, Zea mays
  Clone ID: LIB3062-047-Q1-K1-A9
cccggtagcaggagcgcagccagcaagctcagccccccagccctactgccaccgcgccgagcgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacaggcactgtgaagctgctcaagcacaaagaca

SEQ ID NO: 40318 - DNA, 384 bp, Zea mays
  unsure at all n locations
  Clone ID: LIB3062-047-Q1-K1-B1
agggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcanggcaagagaagtttggtggcctcagggatggatactatatccatggccagtgtgcgatcatcattgttgatgtaacctcaaggctacttacaagaatg

SEQ ID NO: 40319 - DNA, 348 bp, Zea mays
  Clone ID: LIB3062-047-Q1-K1-B12
gtccatctttattggttctcattcatatttgtttctttgcattgatggttatagtggttcagtgaggtggagtgtcaaattggaaggccgtatcgagtgttctgccgctataactggtgatttctcagaggttgttgttggatgctataaagggaaaatttacttccttgatatgtctacgggaaaattatcctggacctttcaaacagatggggaggtaaaaatgcaaccagttgtggacaagatgaggaatttaatatggtgtggctcgtatgaccattacttgtatgcgttaaattacaaagatcgctgctgcacatacaaagttttttgtggtggaagcattta

SEQ ID NO: 40320 - DNA, 163 bp, Zea mays
  unsure at all n locations
  Clone ID: LIB3062-047-Q1-K1-B3
agaggagcagcatgtgcaccaaaaggatggcagcgccaggctccctgcgactttttcagggcccgtacttcgctgcggtcaagtgccagacgatgggtggncgtgcatccgcgcggtgagcgccacggtcactgttagacgtgcgcgcctaggctgttgacgc

SEQ ID NO: 40321 - DNA, 359 bp, Zea mays
  Clone ID: LIB3062-047-Q1-K1-B4
gagatgtgggatctctacagaagagaagttattagcgaaaaagttgacatttgggctttggggtgcgttctatatagaatatgctacttcaagtctgcatttgatggagaatccaagttgcagatactcaatggcaattatcgtatccctgagcaacccaagtatagcactgctgtcacagggttgatcaaagatatgctggaagcctctccaaattccagaccagacatcacacaggtctggtttcgtgttaatgagctactgccgcttgagttacaaaaaagtttacctgacggaccttcgccagccgtttccttgagtttgcaagatgaaggtgctcataaaagggcacatgtgat

SEQ ID NO: 40322 - DNA, 407 bp, Zea mays
  Clone ID: LIB3062-047-Q1-K1-B6
attcatcaaacctgaggaggcagctcatttggagagaaacttcagccttgcaaatggccatgcagtccatgatgcccagcatccttgccaggctaatgtggtcgtgcggcaggaactccacacccctgcttctgatcgttcatgcactcatttggagttcgacattgctgcaactggtctcacgtatgaaactggcgaccatgttggtgtatacaccgagaactgccctgaggttgtagaggaggcagagaggttgttgggctactcgccagacacatttttcaccattcatgcagacaaagaggatggcacttcactaagtggcagttctcttgctcctccgttcccctccccaatcacagtgaggaatgcacttgctagatatgccgaccttctaaattcaccga

SEQ ID NO: 40323 - DNA, 393 bp, Zea mays
  Clone ID: LIB3062-047-Q1-K1-B8
atcaaaatccatcgataaggcaaagaacttgtttgaggaaggaggcgattgggagaggaagaacaggttgaaagtatatgaaggcttgtactgcatggcaaccagaaacttcaagaaagctgccagcttatttttagactcgatttcgactttcacaacttatgagatattcccatatgatacgttcatcttctatacagtcctcacaagtgtcatcacattggatcgtgtatctctgaaacaaaaggtggtagatgcaccagaaatcctggctgtaattggcaaagtacctcacctctccgagtttctcaactccctgtacaactgccagtataagtcgttcttcgttgcattttctggtctgacagagcaaatcaagttagaccgttatct

SEQ ID NO: 40324 - DNA, 418 bp, Zea mays
  Clone ID: LIB3062-046-Q1-K1-H9
cggacgcgtgggcggacgcgtgggttgccaattggagatatacggatgatgaggtactcctcaaagattggtctgaggtcagatatagatccttctgccatttgaatggtagctcctgtaaggaaaactctagcaggcactgatggcactgaaccaaacatcatctttgaggagtaccttgccaattggagatatacggatgatgaggtttatgtttttgatggaggaaatgacagcacttcaaatggttttgtcgttaaatctattatgtcaactggccagtattttgaggtggcagaattgtatacagtaacattcctctgtattgtctctcaagatagtgaaactgctatctcatgggcagaaaaggctcatctaactgagcaaagccggcaggacctactaaaaaagcttcatg

SEQ ID NO: 40325 - DNA, 420 bp, Zea mays
  unsure at all n locations
  Clone ID: LIB3062-047-Q1-K1-C1
cgcgaccccgacgcctgcgttgccctacccctacctgacctccactgctccacacctgcacctgcctgcgacaaaagcaaaacctagccgccgcggcgccgcccgccgacctgccgtgccgactgctgagtgccgaccgacgtgcgcccgctgtccgctcgacgttgttggcctccctcgacgccgctggcaggtggccgctcgacggagtcgacgcctcacagcctccctcgacgcgacgccgctggccactcgacggagtcggcgcctcacagtcacagtgagatgtcagaatacaagaacgtcgttggggggaggctaaagctgaagggtaggcactggacgtgaaggaaggtggagtcaagaagaanaagaagaagcatcaactcgaagagtcgtctcagattgagcacgatgagc

SEQ ID NO: 40326 - DNA, 142 bp, Zea mays
  Clone ID: LIB3062-047-Q1-K1-C10
gagaaacatccacgactctcctcccaactgttttcctaaagcgaaatgataacacttcttagtaatggtctatgctcactctatccttgcgctagcctctatgaccggacctaaactggtgtgtgagaaacattcacgactc

SEQ ID NO: 40327 - DNA, 111 bp, Zea mays
  unsure at all n locations
  Clone ID: LIB3062-047-Q1-K1-C11
tcggccccgaccagcccgacctcatcttctcctcgtcggcttcacccctncaccacctccatggggtcgtctgangccgacgaggaccagctcctcaagagcttcctcgcg

SEQ ID NO: 40328 - DNA, 337 bp, Zea mays
  unsure at all n locations
  Clone ID: LIB3062-047-Q1-K1-C2
gcaattctgcatcatatctgtctgcaattccagtttcagaaatgcgcaaaaatctgcgattgcagtagctaaaaagaatgcgcaaaaatctttgtacgattgtgcgctgtcgaatctctctctgctgtgcacacgcgcgcaggagcatccgggcatgtcgaagggcgacaagaagcggctgtgcgcgctgatggactgcaggaagctgacggcggacgcgagcgagcacgccgtgcagaacgagcggctgcccctgcgcgtggtggtacaggtcctcttcttcgagcaggtccggcagtcggcggcggcagnctctggccgccccgcgcgctcgctc

SEQ ID NO: 40329 - DNA, 437 bp, Zea mays
  Clone ID: LIB3062-046-Q1-K1-G10
ctttctgctatccaactatttgcagatccatcgagacctgcttcaagaaacaggcgtcctggggatgaaagtgatggggactctatggatactagcagtgagagcagcattgagaatgacgttgagcggctaagagtctcatcatcactggaaggtacacatcgactggaaaatggtggcatacgaagtgatgatggtgaaggcgatgcatcttcaagttttccaatatttcagtatatggagagggatcctccatatggtagagagcctctgacagacaaggtatcaactcttgcacacagatttccagctctgaagacattcaaaagctgtgatcttctgccatcgagctggatgtctgttgcatggtaccccatatatagaattccaacagggccaacattgaaggatctcgatgcctggtttttgacattcca

SEQ ID NO: 40330 - DNA, 330 bp, Zea mays
  Clone ID: LIB3062-046-Q1-K1-G11
tcatacctagattcatatccatctagacttgctttaataaacaggctttctgactatgggaatggttcattctcaatgtagtctggcaaataaagcatcattgagaatcacgatgatctattaagagtctcatcatcactggaacgtacacatctacttgaaaattatctcatacaaagaaattattctgaacatgatacatcatatagttatacaatatctcactatatgtagagtgatcctatcatatagtataaagcctatcacatacaacgtatcaactctcacacacatatttacagctctcaagacattcactttctgttatct

SEQ ID NO: 40331 - DNA, 290 bp, Zea mays
  Clone ID: LIB3062-046-Q1-K1-G12
cacgcgtccggagatttaaacgaggatcctcttaccttgctgaaccagctattaaccaatggtcctgaagcattcaaagaggagaggataaactaattccttaaccttcttcaccatgctcgccaagttgtatcaattactcactatccaatccatcggctatatacttacctcctagatgatatgcatgctaaacatgcctactcatgtactaacatatatctttccctaaagtgcctagatccacagagtaatgcactattgtcttacatgaagatttcgaataacat

SEQ ID NO: 40332 - DNA, 156 bp, Zea mays
  Clone ID: LIB3062-046-Q1-K1-G2
tccctctccacccacacatacacattcattgtacacctcacctacgcattcacttactcgctcaactaatctacatcggcacagttaataaacaaaactgtcatacacatccatcttcaattacttccaaacaatgactactctcaacaactactt

SEQ ID NO: 40333 - DNA, 273 bp, Zea mays
  Clone ID: LIB3062-046-Q1-K1-G3
actacacaaatttccatttcatttcacacgaccttaacctaactacggccacgtatcaactaaaactctcacacacatccaacttcaattactacaaaacaatcactcctctcatctcctacataccctttttcctcaatcccatactaattcttttcatacttatacctttcacctctcatctcctcctacctccaatattacactactcctcaatctatatttctattcaccttaacttactccattgtctacaaataccctcccctacta

SEQ ID NO: 40334 - DNA, 382 bp, Zea mays
  Clone ID: LIB3062-046-Q1-K1-G4
caaggagattgttgatctgtgccttgaccgtatccgcaagcttgctgacaactgcagcggcctccagggcttcctggtcttcaatgccgttggtggtggcaccggctctggccttggttctctcctccttgagcgcctgtctgtggagtacggcaagaaatccaagctgggcttcactgtgtacccatctccccaggtgtcaacctctgttgtggagccttacaacagcgtcctctccactcactcactcctggagcacactgatgtctctatcctgctcgacaacgaggccatctatgacatctgcaggcgctccctcgacattgagaggcccaactactccaacctgaatcgccttgtgtctcaagtgatctcatctctg

SEQ ID NO: 40335 - DNA, 398 bp, Zea mays
  Clone ID: LIB3062-046-Q1-K1-G5
ctcgctccaagcacaccaccactccacagtgcacttcactctacagcaacgacagagggagtgagcagcagacagcagcagctgctgccatggaggcgtggagatctctcctcgcgagcttcgtgctcgccgtgctggccgcgcaggccttggtggctgtggtcgagtccaggaccggccccgtggagcaggcgagccaagcaggtgacgacgtgaagaagccggactgcgtgccggggatagacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgccttccccgtcccac

SEQ ID NO: 40336 - DNA, 360 bp, Zea mays
  Clone ID: LIB3062-046-Q1-K1-G7
gcggaccacccggccggccccattatattggacgatcgatgcagtcagtactcgaacgatagtgactgagtggcccgcagcagctctagcgcaaggacgactgcagctacactgtttgtttgttcaagaaagcctgtaggatcgatcggatcggatcggatcggacagagcgagctatagctagctagggctagctagctagatggcgaggctacgcctggcggtggtcgccgtcgccctggccttgtgctgctgcctcatgatccacgcgccgacgacaggtgccgctgctgccgccgacgacgcctcgtttcctcctggactggaggtggcggcgcagcagcaggatacccgagtggc

SEQ ID NO: 40337 - DNA, 424 bp, Zea mays
  unsure at all n locations
  Clone ID: LIB3062-046-Q1-K1-G8
gttccttctattgaacttcttgatcgtgtggctggccgtctttctcgtgagccaaagtcatgggaccaggcagttttcaacgaggagctgttcttcccgtcccatcctggttatgaaggcctccatgcatccaggagaaccatggatttttatcttttcatgaacagcaaagtcctcttcaagacagtgaggaaagacgccgggctcaagaagctaaagccagtgattgtgcatttgaactaccaccctaacaaactagagcgaatgaaagcggttatcgagttctatgtcaacggcaaacaagatgcactggatcatttccctgacgggtcagaatgaagaaattacagatagttgcgggtaaagaaacctataccctctggatcctactcnattttggggtgtctggccgttggatctacat

SEQ ID NO: 40338 - DNA, 413 bp, Zea mays
  Clone ID: LIB3062-046-Q1-K1-H10
ctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaac

SEQ ID NO: 40339 - DNA, 186 bp, Zea mays
  Clone ID: LIB3062-046-Q1-K1-H11
aaaaaaaaaaaaaaaaaacatttaaataaaaataaaaaaaataaaaaaaaaagagaaggggaaaaataaatggtggagagggctaatattgactattattaccttcgcgttcgtgtttcctgtttgctattctctagcttcccctggccgacgttttatcactggttatcttagacgattctcttg

SEQ ID NO: 40340 - DNA, 422 bp, Zea mays
  Clone ID: LIB3062-046-Q1-K1-H12
gggagttaagggaggatccgcagagcatggtgaagcagctattaaccaagtgtgctgaagcattaagtgaggagaggatagaggagttccttaaccttgttcagcaagctcgtggagttgtatcaattactggggagccaatccagcggttaggtgcttacctccttgagggtttggttgctagacatgcaaactcaggtacaaacatatatcgtgccctgaagtgccgtgagccagagagtaatgaactcttgtcttacatgaagattttgtataacatctgtccgtacttgaagtttggctatatggctgccaatggggcaattgcagaggcattaagaaatgaggacaggatccatattattgatttccagattgcccaagggacacagtggataacactgatacaagcgctagctgca

SEQ ID NO: 40341 - DNA, 429 bp, Zea mays
  Clone ID: LIB3062-046-Q1-K1-H5
cttgctgcctcatccattccagagctgcgaggcagacagagagacagacagagagacggacagacagagagagggatcgacggagcaaggcggggccgtgtccggtcacacgagcgagccctctcggccgcgcgtttgtgaatggtgaacggcgagcagcgggcggacgcggagtgcacgcgggcgtcgctgctggggaggtatgagatcgggcggaccctcggcgagggcaacttcggcaaggtgaagtacgcgcgccacatcgccaccggcggccacttcgccatcaagatcctcgaccgcagcaagatcctctccctccgcatcgacgaccagatcaggagggagatcgggacgctcaagctgctcaagcacccgaatgtcgtccgcttgcacgaggttgctgccagtaaaacgaagatctacatg

SEQ ID NO: 40342 - DNA, 278 bp, Zea mays
  Clone ID: LIB3062-046-Q1-K1-H6
ttcctcatccatttcatacatttactctgactattatacagacatgcacagtgacattcaaatatagggatcgactaatcatggctatgccccatcccttcacacgacctaaccctcatcaccaaccttttatgaatgctgaactgctagcaacatacggactctaagctcactctaacatctatcatattgagctataacctcaagctgaccctcttctagtacgacttagtcaaagtccattattcaagcttattaatcatcataacccacttcta

SEQ ID NO: 40343 - DNA, 394 bp, Zea mays
  unsure at all n locations
  Clone ID: LIB3062-046-Q1-K1-G1
cttttcttgagctccacaaatttccattgccgcgcgcgcgcgtttaagctagctgtgggcaccgatcaactgcaactctcacacacgtccacctgcaattgctgcaaaacaatggctcctcgcagcgcctacgtgcccgtgtgccttgttgccctgctcctgctcgccagccttagaccgtccagcgcgcggctgctccggccgccgatgggccgcgacggcgcaatcgatgtggctatggaggtgaaggacgccgtcgtcgacaagtacgcgccgctcctncttgccatgctgccgagggggccggcgccaccgtccgccccgagcggcggcaccaatgatatcccccggaattaaggaaccggtggccgtagtagttgtacgtacacgcatg

SEQ ID NO: 40344 - DNA, 306 bp, Zea mays
  unsure at all n locations
  Clone ID: LIB3062-046-Q1-K1-H7
atagacaggagagagagagagaggggaagagagagagagagagagagagatagatgtggtaactcaagaactgttcttatgcatgcagcagccataagcattgctactagggtttcatgcggggcgaagcagttggtctctgccgcctgaacgccgccggaatctgcgaggcctncccgagctgcgtccgtcgtcagataaggcagtcgtcggcacggcaatgccggttccgcttgctccgtacccagcttctccggcgccattcacgccgcccaatgtggcccaaagccagctcgtctgcaccgg

SEQ ID NO: 40345 - DNA, 437 bp, Zea mays
  Clone ID: LIB3062-046-Q1-K1-H8
cccagagttccttgcggagggcactgccattgaggacctgttcaagcctgacagagggcttatcggtggccgggagacccctgagggcaggaaggccgtccaggctctcaaggatgtgtacgctcactgggttcccgaggacaggatcctcaccaccaacctgtggtctgctgagctctccaagctcgctgccaacgcgttcctggcacagaggatctcctctgtgaacgccatctccgccctctgcgaggccaccggcgcgaatgtgactgaggtggcttacgccgtgggcaaggacacgaggattggccccaagttcctgaacgccagtgttgggttcggtgggtcttgcttccagaaggacatcctgaacctggtgtacatctgcgagtgcaatggcctgcccgaggtggccaactactggaagcaggtgatca

SEQ ID NO: 40346 - DNA, 390 bp, Zea mays
  unsure at all n locations
  Clone ID: LIB3062-046-Q1-K1-E4
aaaagagactaaaaaatcgccgttctgttttcccagttcgctcctcccatggcggcgggcgcgcgctctcgtctcgctgactcccgccgtctgcaggcatccccacctcctcttctgctccccttgccccccgccgcgccacatccgcctcgccccttcaaccgacacacccgcctcggacggaaacggcctcggacccggccccggtgtcttcctatcgccgcgcgcgctctcgcagctcgacgagctcgcggccttccgctacgagcacgccttcccgcacggtctgctcactgtgcgcgctctctcgcgcggccccgacgacgacgccgtggtcgaggcgctcgtccggctnctcgcctactccttctccgagaccgtgcgctgggc

SEQ ID NO: 40347 - DNA, 415 bp, Zea mays
  Clone ID: LIB3062-046-Q1-K1-E5
gttcgtgaggttctccggggttcggtttcgtgggtgagcggatcgagatggcggcgtgggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggccgtggcgg

SEQ ID NO: 40348 - DNA, 226 bp, Zea mays
  Clone ID: LIB3062-046-Q1-K1-E6
cggcaagcccgagagcttcggcgggcccttcctcgtgcccagctaccgtggcgcctgcttcctcgacaccgaagggccgctgcggctccaccggctacgacaacgccgtcacgctccccgccgagggcagaggtgacgagcaggagctccacaaggagaacattcagaacgccgtctcctacaccggcaacatcacgtttagcgtgaccaagagcaacccgcagac

SEQ ID NO: 40349 - DNA, 353 bp, Zea mays
  Clone ID: LIB3062-046-Q1-K1-E8
ggaggccatgcagcaatatgaaatggcgattgcatacatgggagatgatttcatgtgtcaattatttggaaagtacagagacatggccttggctgtgaaaaatccatgccatctcaatatggctgcatgcctgatcaaactaaagagattcgatgaagctattgcgcagtgtagcattgttttgacagaagatgaaagtaatgtcaaagcgctgttcaggcgaggaaaagctaaatctgaacttggccagacagaatcagcgagggaagatttcctcaaagcgaagaagtactccccagaagacaaggagatcattcgggagctccggttgctcgcggaacaagacaaggcac

SEQ ID NO: 40350 - DNA, 427 bp, Zea mays
  Clone ID: LIB3062-046-Q1-K1-E9
ggtgaagcgcgggtgctggtgcgggaagcctcgccagacctagcgctgccgactgcggagctgggtgcgggcgcgaggagtcgacgggaagacaagggtgaggaattatgagtgaaacagggcacactgtacaagtcactaacctctcgagcagagtatctgaaagtgatcttcatgagttcttttcgttctctggtcctattgagcatatagaacttatcagatcagaaggatacggtgccactgcttatgtgacattcaaggaacgctttgccttggaaactgcagtattgctcagtggggctactattgtggatcagccagtatgcataacctattggggacaacctgagggaacttttaatttctgggacaggccaacttgggaagttgaagaggaaatcgaatacaggaactaccaaacatg

SEQ ID NO: 40351 - DNA, 351 bp, Zea mays
  Clone ID: LIB3062-046-Q1-K1-F1
ctgcttctggaatcaggaaaggagatcaccacttcactcaagaaggcaccctccctggccacgccttttccttgagatgacgacgacgatgaagaagaagcagcagcagcagctcctcctcctcctttctctcatgtttctcgttgctgtcacagcagccgctgttgctgccgatccacatccacagcaggtggtactacgcctactctcctcttctcctcggcatcatccaaactgaatcagattgaagaatcatcaggtcattaacatgttcagtgtgtgtccagcaggtgcaagtgcagcagcagcagcaagcacagatgaggattaacagggccaccagatcccttc

SEQ ID NO: 40352 - DNA, 223 bp, Zea mays
  Clone ID: LIB3062-046-Q1-K1-F10
cccacgcgtccgcggacgcgttggctgtctcgcaccagctcatcccagctgggcccgcacccttgccttgccctgctgccaccggctctcccccaatccctcccaccaccaccagattcgcctcgccttctcgacgcccctccctcacccttgatgccacgccctccttccatggcgccacgcccgcgccccttaccacccgtccgagccgcgacgctgaccc

SEQ ID NO: 40353 - DNA, 397 bp, Zea mays
  Clone ID: LIB3062-046-Q1-K1-F11
cacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtagatatgtgcaagggagtgcagtatctcaatgaaatcaaggattctgttgtggctggtttccagtgggcatcaaaggagggtgcactggctgaggagaacatgcgtggaatttgctttgaggtctgtgatgtcgttcttcatgctgatgctatccacaggggtggtggtcaggtcattcccactgccaggagggtcatctatg

SEQ ID NO: 40354 - DNA, 287 bp, Zea mays
  Clone ID: LIB3062-046-Q1-K1-F12
gtcgcctcttcttctacaacctcccctcgcctcttgactaggccagcgttggatccgaccccttcgccatccgatccgatggagggcggctactcgtccggcgccagcctcggcgcctgctccggttgcgccgtggccgcatccgccaagtggcggagcgactcgtcgaggtcgttccagtactacctgcaccgttacacgcctaacgctactgggcggtggctcggcacgctcgacaccgctgcaatctactcgctgacattctacatggcgcaaggcattctaca

SEQ ID NO: 40355 - DNA, 360 bp, Zea mays
  Clone ID: LIB3062-046-Q1-K1-F2
cggaacgcacacaccgcccggtccccgatctccgatcccctcgtcgatccaaagatgcagagcttcgtcaagaccctcactggaaagactatcaccctcgaggtggagtcttctgacaccattgacaacgtcaaggccaagatccaggacaaggagggcatccccccggaccagcagcggctcatctttgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtc

SEQ ID NO: 40356 - DNA, 376 bp, Zea mays
  Clone ID: LIB3062-046-Q1-K1-F3
gggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctac

SEQ ID NO: 40357 - DNA, 421 bp, Zea mays
  unsure at all n locations
  Clone ID: LIB3062-046-Q1-K1-F4
gacgagtgcaaacgcagattcagtgtaaagctgtggaaaacattcactgactgttttaactgcttgccagtgtgagcgttgatagacgaaaagatcctctgtatgcatggtggtctatctccagagttgaacaagctcgaacaaatacttaatctgagtcgccccacagacgtgcctgatactggattgctctgtgaccttctttggtctgatccttctaatgaagcaacaggatgggccataaatgatcgaggtgtttcatatacatttggtcctgataaagtttctgaattccttgagaagcatgatttggacctcatctgccgagcccatcaggttgtcgaagatggatatgagtnnttcgctagccgccaactcgtaacaaatgtttcagcccctaactactgtggagaattgataa

SEQ ID NO: 40358 - DNA, 308 bp, Zea mays
  unsure at all n locations
  Clone ID: LIB3062-046-Q1-K1-F6
ccagttcgccaacatcatccatatctccaagcagctgcgctacttcgagcagtaccgtaggcgcctggccgcgctgatcggcccggaggcggcgtcccgcgtggtgcgcggcgcgctggtgctcatcacgctgggcggcaacgacttcgtgaacaactactacctggtgccctactcggcgcggtcgcgggagttctcgctgccggactacgtcacctacctgctgtcggagtacgcgcaggtgctggaccgactctacgacctcggcgcgcggcgggtgctggtgcatgnggtggggcccatcggct

SEQ ID NO: 40359 - DNA, 420 bp, Zea mays
  unsure at all n locations
  Clone ID: LIB3062-046-Q1-K1-E3
ctagggttttcgattttagccgccgccgctgctcatctcacatccctcgagaagacgcctgctcctcgccgagcgatgcgatggccgtcttctgcgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagctgangatgatgatgaccttgatctttttggtgatgaaactgaggaggacaagaaggcagctgatg

SEQ ID NO: 40360 - DNA, 212 bp, Zea mays
  Clone ID: LIB3062-046-Q1-K1-F7
ctcaaacaaccattcttttatagccatgacaaccatgaccaacttgtgaacattgcaaaggtccttgcaacatatctgttgaatgcttatttgaacaagtatcacattgagctctacccttaacttgaagctcttgttggaaagcatattataaaaccctggtcaaagttcattaatgctgataaccaacatctagtatcaccttacgccat

SEQ ID NO: 40361 - DNA, 376 bp, Zea mays
  Clone ID: LIB3062-046-Q1-K1-F8
ccctctcgccgcccgtctcccccgcggccgaggagccgccaatagcaaggagagggtttcctcctccctccacggctccaccgagctccccgatccctccgccccaaatcccacacacccggttggccaccgcctcgctatggatttggatctgtggatctccaaggtcaaggagggtcagcacctcgcggagcacgagcttcagtccctctgcgaatatgtgaaggagatcctcatcgaagagtcgaacgtgcaaccagtgaacagccccgtgacggtttgcggtgatatccatgggcagttccatgacctaatgaagctcttcgcgaccgggggccacgttccaaagacgaactatattttcatgggtgatttt

SEQ ID NO: 40362 - DNA, 325 bp, Zea mays
  Clone ID: LIB3062-046-Q1-K1-F9
gtttcagtggattttggccaacccttgctgttttcctccaaaggattcctattattggatggatttttcaacagccgtttgtcacatcggtccttgaccgctacagaggaaaacgagttccggtttagcttactcctgctatatttcaacatacttccctcacaaatatcatgcggttatggatatgttccgtccttgcctttttctttaacttgtttagttggtggtaggattttttgttgttgtgtaaattacccctcatccgtggttttccacagaccagaatgcattttccccgttaatacattgaagaaagttctcatgc

SEQ ID NO: 40363 - DNA, 153 bp, Zea mays
  Clone ID: LIB3062-030-Q1-K1-E10
gcagctcatttctaagaagccgaccgaggccagccgatatcgagcaccaacgacgcagcccattgacgtacggctatgatgcggccgacgtcgacccttgctatggtcgtgccgtcgctcgctgtagccatcctctgcatcctagtccggtcc

SEQ ID NO: 40364 - DNA, 204 bp, Zea mays
  Clone ID: LIB3062-030-Q1-K1-E11
tcttcctcttactcttttatgcattctttaatgcttgatatcaggctagtacttttcctgaaaagtccttaaccgcgcgaacatgggttaatgtctaacctggatagattacctcattactacaatatccatcaagatgaaatccacaccaaacttttccaattattttaaaaaaggttccttccaattcttaaaaatttaccc

SEQ ID NO: 40365 - DNA, 409 bp, Zea mays
  Clone ID: LIB3062-030-Q1-K1-E2
gcgtcactatgaagaacaaaggaagccatattatcattttgaagaaaggcttcctctggtgcctattgaagaagtgcgtcagccacggtttgatgatgaaaggcgccctgcagttagacatgttcctcttgaggatccatatagggcacaagcaccacgctttgcaccagttcctgttgagtctcagcttggccattcgttggctagtgctcagggtgatcacggcagatattatcaaccaccagcacttgcgcctgagcctcgacacattcctcttgttctagagcctcgctatgttccgccagcccatgtgcctactgtgccagagcttcaacatgtcccagctgcatattatcgcacttcggctccatctggcgactcatactatcggcctgttgataatctggtg

SEQ ID NO: 40366 - DNA, 377 bp, Zea mays
  unsure at all n locations
  Clone ID: LIB3062-030-Q1-K1-E3
tgcagcgcggcgagttcctctgccggccgtgggtctcagcggacgcccggaagctcatgggggagctgctggacgggacccgagcacgcgcatcaccgtcgctcgcctcgtcgagacgccgtggtaccggaagccgttgcccgtcctgccgccgctcaacctcaaggagccaaccccggacgcgcgccgcgccacctctgacaaggaagagcccgaggtgctgaacgcgttccacctcatctctttctcggagggcttcgacctgtccccgctcttcgaccagggccgtggcggcggcgtacggaggtctagcgcggtcggcatccgtttcgtgacgcgcgaggccgncagcagcgtggtctcccgtctggagtcgc

SEQ ID NO: 40367 - DNA, 397 bp, Zea mays
  Clone ID: LIB3062-030-Q1-K1-E4
gggcaaggcaaaattaaccaacgagaccggctaacaaccaggcaactcttcttaactgttgcccctttgggcgtgggcgcgcggaggcaggggtggcgtacggcggcggcggcaaccatgaacatcaacgcgaacggcggcatcctgtcgtacgtgaacatggaggggtacgcccgttgggtggccactggcgtggcgtcggccttcttcgcgtccctggagcgcttctactgcatccacctacacaccgtcgaggacgactgcagcgacgaggaccccgacgaggccaaggaccgtcccctcatcttcttccgccccgacgccctacccgagtactactacagccgttccacattctgcgtcttcttcgccaagatgtgacatgcatgatctgatc

SEQ ID NO: 40368 - DNA, 422 bp, Zea mays
  Clone ID: LIB3062-030-Q1-K1-E6
gatcgctccacaaaaccctgctccccttcacacccttcgttcgtacgacgctggccccaaatgatgctccgtcgcctctgcaacaaccaaagaggagcaccatcgtccctgtccagagcgccatcgcctgcagtgacctcgccgcctatgagcgcttcttggaccgccccttccttcctcgagaataatgatcagttcgtggagcccaaaggagctacctatgaagaccctgagcactcatttgttgaaggttggcatctatgcaaccattgattaggagaaagagtcgaagcggatctccaggagttccatgacttcgacgaattcgaagactaggctagtggcctcctagtcagatgcatgtggaaggcccattttatttagtttacgttccgcttgagcactttaaactatgtgatctc

SEQ ID NO: 40369 - DNA, 361 bp, Zea mays
  Clone ID: LIB3062-030-Q1-K1-E7
attcccaggtctagccactcatccttatctctccacaaaaccctcctccgctttacacccttgaatcctactactctgtcccgtaattattctcctgcacctctgcaacaaccaaacattatcaccatcttccctatccacatcgccatctcctgcatttacctctccttctatcacctcttcttatacacccaacttccttactctataataaccatcacttactataaccaacccgatctacctatcaataccctgatcactcatttcttgaaagtctgtcatctattcaaccatctattaccataaacagtctaacctgatctccaggtattccacgacttctactaattccaatact

SEQ ID NO: 40370 - DNA, 68 bp, Zea mays
  Clone ID: LIB3062-030-Q1-K1-E8
attcccgggtctgctcacttcttcctaacaagtaatatggcttggtctggttctcaaccaatgagcat

SEQ ID NO: 40371 - DNA, 355 bp, Zea mays
  Clone ID: LIB3062-030-Q1-K1-E9
gtgattctctcacgtacgaagacaaggatggtttgattgctaggcttcatgatgtcgaggacgggctctatgaaggtggcgaggatgaaactaacggggtttatattgctaagctagaagaacttaaaaaagttggcgatcctattgagctgcgcttcaacgaatgcgagattagaagttctgctattagccaactggtatactgcatcaatagcttcagagaagctgcacagtctaccgaccacaagtttgaacacatagacatgtcagaaaagcgaaaggtcattaatgagtgttcggaaacagacacttggctaatagacaaaaagcagcatcacgatgctctgtcaaagca

SEQ ID NO: 40372 - DNA, 378 bp, Zea mays
  Clone ID: LIB3062-030-Q1-K1-F1
tcctatacaactactccgtaggaggacacatgatgtcattttaatatcttaattcggatcggttctcctgagtcgctgctgctactctcacatcattattctttggatactctactcgctcagatactagaagtatgtgccaccacaaaacacgatgatccacaaggagccaaccacggtactctcacgaaccaacatctaacatcaaagagccactaatgacttaaatcgtaaacctcatgtgaacctccaaattctttgaaatttcccaactatttgagctaatccttgtcaacagaatcagattctctacactaaacttgatccgttaaatgactcatcaaaatcttcacaacagaatccaaacgattatggtcc

SEQ ID NO: 40373 - DNA, 379 bp, Zea mays
  Clone ID: LIB3062-030-Q1-K1-F2
gggatgtgatgctgtcatcgtcatgcccgtgacaacaccagaaatcaagtggaaatgggtggagaggttgggtgcgacagtggtccttgagggggactcatatgatgaagctcagtcatatgcaaaattgcgttgccagcaggaaggccgcacatttgtacctacttttgaccatcctgatgtcatcactggacatggaactatcggcatggaaattgttcggcagctgcaaggtccactgcatgcaatatttgtacctgttgaaggtgctggattaattgctggaattgctgcctatgtaaaacggtttcgcccagaggtgaaattaattgaagtggaaccctaagatgcaaatgcaatggcattatccttgtgtcat

SEQ ID NO: 40374 - DNA, 407 bp, Zea mays
  Clone ID: LIB3062-030-Q1-K1-F5
gccacgtctcctaaggcttcgtctgctgctgttttggagtcctctactggtcatccgtgctaccggatggttctctcggagacggacgtacagtgatattgacatctgcttggagaagtgccgaagtgatactatcggttgatgtgttaagtggcaaagtggcaagaataactccggaaggctcgtgctattcgtggcgtgctcttgcgttagatggcaccaatgttcttgctgtgtcaagtagtcccatctaccctcctttcatcatctactgacgacgtcttgccgtgacaccatctgagggtgaagcacgtatatagacctgggatgaagttactagtccattcatggcattcaacatcaaggttaagtccttgttgcttcatcacagccttagcatacttaaa

SEQ ID NO: 40375 - DNA, 347 bp, Zea mays
  Clone ID: LIB3062-030-Q1-K1-F6
tagctcactcatccttactaataatctcttcttgacctgactaacaccacctagcaactctttctcggctgcaataatttccaatggctcctgctcctcccatcctcatctattctcaacttcaactatcctcacaacttctctactacttctaactcctagtacctggacttcttcttcaacattcagctgcaactaggtgacatcttccttttctcctttcctaaattactctattttcatctcttcttctccctccacatcttactacatcaagttacgctctctcaacatcctctcatattcatctgcataccatcattccacctgcaactgcctcaaaatca

SEQ ID NO: 40376 - DNA, 393 bp, Zea mays
  Clone ID: LIB3062-030-Q1-K1-F7
tccgttcaccagctcgttgagaacgcatactagtgcatggtgctcgacaacgaggcggtctatgacatctggttgcgcacgctcaagcttgccacaccaacctttggtgatctcaaccaccttatctctgcaaccatgagtggtgttacgtgctgccttcgcttccctggtcagctgaattctgacctccggaagcttgcagtgaacctgatccccttcccacgtctgcacttcttcatggttggatttgctccactgacctcgcggggctcccagcagtaccgcgctctcaccgtgccagagctgacccagcagatgtgggactccaagaacatgatgtgtgctgctgaccctcgtcatggccggtacctcacggcatctgctatgttccgt

SEQ ID NO: 40377 - DNA, 297 bp, Zea mays
  Clone ID: LIB3062-030-Q1-K1-F8
tcttcctactccacctacctcccttctcccggatccctcgatcgagaagattctccacggatccgtatcccacgtcaggctgccggagttcttcatcttccctgcctacaagctccctcagtccaaggccacctcatctactgtctccctgcccatcttctacctcttcctcggccgctactaggttcttctctccatcctcgattccgtcaaggagatcggcttcttccatttggtgaaccacagcgtctccctttatgctattcatgacatgtacactgtattccaccaattctt

SEQ ID NO: 40378 - DNA, 385 bp, Zea mays
  Clone ID: LIB3062-030-Q1-K1-F9
cgaaatctgacccgggccacactccgctgctccgccatggcgatccgctccaaggccgggatctcgctgctgctcgcgctgaccgtcgctctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaagatct

SEQ ID NO: 40379 - DNA, 388 bp, Zea mays
  unsure at all n locations
  Clone ID: LIB3062-030-Q1-K1-G1
gcatcaccacgcatttgacgcggacgctcgaggaagcaagcaccgccggagtcggagggaagaagaaaaaagaggacggacgattcgcagctgcagcctgcacaggcggaggcgaggaggaagagagagcccccacgatcggctcgccgggacggccgacgggccgagggtgaggtatagtgcgggcgcgtggtcccgcgcgtggagtcgggatccgtattgctctctagcagtcggccggtggcggcgctcggcgtccggagggtgactgacagagagagaatcgtccatccatgggaggatccgggcgcagcgcgcatttcttggacgcgtgcttnctctgccggaagccgctcgccggcaaccgcgacatcttcatgtacagggg

SEQ ID NO: 40380 - DNA, 142 bp, Zea mays
  Clone ID: LIB3062-030-Q1-K1-G10
tcatcatgctctgcatgctaacaggactcatctcaagcatcactgcagcatgtgcagcgatatcctgaacgacagcaacacctacggcaacatcaacatactgcctacacttcaaagaatcgtcaatcacaacataccactt

SEQ ID NO: 40381 - DNA, 396 bp, Zea mays
  Clone ID: LIB3062-030-Q1-K1-E1
ctccacaggatgctgaacgaggatgagctacgtgatgctgtgctgcttgtttttgcgggcaggcaagatctggccggtgccatgaatgctgctgagattactgacaagcttggattacactccctgcgccagcgacactggtacatccagagcacttgtgccacaactggcgagggtctgtatgagggcctggactggctgtccagcaacattgcgagcaaggcttgaggcctaccttgaatatcaactgcgaactgactaggagctccggatgtatcatggaaactcaggacagaatcgcagttgcaatctgttagatgtcttctaccggcactatatatttttttttgtttgatgtgtaatgatgttactgttcaacgcttattaccctactat

SEQ ID NO: 40382 - DNA, 425 bp, Zea mays
  unsure at all n locations
  Clone ID: LIB3062-030-Q1-K1-B7
tcttccttgaactcttcttgtaggtggccagaaagttgctgtggtgtattttagagctggctatgcaccaaatgattgtccttcagaagcagtatgaatacattggcctttgcctttcgttgaagtctttgttttcagctatgaagactaattgcccaaatataaaattctttcagacatttcagttttttctttaacatatttgagttgttctgagaagggtgggcctgcagtggtgaatcagcctctccgtatttgtggagaaaaggcttgtctcggtttatccctttccttgacccacttatatgggagcctttggcactgaatctgccctttttttgtatttgggtggtttagcatttccttgttacacgttaactntattttctatcttgcaagttgaaacataaaagtcaaattacttt

SEQ ID NO: 40383 - DNA, 274 bp, Zea mays
  Clone ID: LIB3062-030-Q1-K1-B8
tcgaccttgtacttcgtgaccccgggctttaaggtgacatcctactacagctggatggcttcttacgacaggggtcgacttcatcaagaagagcacggagacctcatgctccgtcaccaccaccaccacccaggctccaccggcatccgagaaggcatcctcctcctagcccgtcaaggactagctgtgagcatccaaggtgtggacggctgtggctgcttaagcatgggaggaaaacctggcgctaacttgcctccaacgcctagtttttgcg

SEQ ID NO: 40384 - DNA, 334 bp, Zea mays
  Clone ID: LIB3062-030-Q1-K1-B9
tcttcctcatagattcattaacatcaaaaccacaattctcctaacgtcccctataaattctatctgtctacatttagaggctgctcagttctctagcaacataacaactctatcaagtagattggagatatagatcgtagtggtcatgtatattggagatatagatggtagtgatacacgtcgcaacctatgtgtgacctctttctaactgtacaattccagtgtaacaccaagggtccaaccttaatttccccatttaacctttgtcctactaactgccctgccattgcccgatatctcctgttgctaaggctcaatctctgaaaatcctact

SEQ ID NO: 40385 - DNA, 217 bp, Zea mays
  Clone ID: LIB3062-030-Q1-K1-C1
tcatcctggaactcttcttgtatgtggccagatttttgctgtggggtattttagatctggctatgcaccaaaggatggtccttcacactcagtattaatacatcgtcctttgcctttcgttgaactctttctcctcagctatgaacactaattgcccaaatataaacttctttcacacatttcacacttctctttaacatattcctacatgttctac

SEQ ID NO: 40386 - DNA, 376 bp, Zea mays
  Clone ID: LIB3062-030-Q1-K1-C12
attcccgtctcgaggcactcatactcacactctctttctctctcacttcttgatctcttctatcgggtcaccaacttcagatgttttccctctatggacacggcgaaaatgttacaaccctctccctacccaacttaatctcattacaactcatcccactttcatccgatggcctaatacctaatataccctcaccgataccacttcccaacagacactcaccctgactgcctcactcgacacaccctgcatccactcattaagctctccagctttcttgcttactctcatcttcacctctacactttccatctccctatcacccgctcctttcactctcttcccttactttctttccacattcaccaactttccc

SEQ ID NO: 40387 - DNA, 330 bp, Zea mays
  Clone ID: LIB3062-030-Q1-K1-C2
ccctcgtgctcgtctcactcttcagctccagctccggatctgaaaggccgatcagtcgttggtcgtttcgagtggtcagccagagcttctcggtgagtgcgagaattcgggccggagaactgggaaagcctcgaggagacatggatgggttacccggagagctgtgcctcaagatcttccacctcctggatcaccagtccctcgcctcttctccccaaggaaatggagggcgttgacctcggatgatgaactgtggcccaagctgttcaacgacaggtggggagcggacgccgcagcgttctacgcgccggagggatccaagtcttggaa

SEQ ID NO: 40388 - DNA, 263 bp, Zea mays
  Clone ID: LIB3062-030-Q1-K1-C4
tcccgttcacagcttgtaaggagggagggagccatggttgtcagcacattcactgtctccgggattgagatcgggttcggggtcggctgcttctgcggggtacctttacaattcacatgaatgcctcttaacacgttcggctaggttatctgctgcaactgcaaagtcaagtctctcactatctattgcctcaatgaaatgctctaggttccaagtctcaatcttcaagatcactattccacagctttgcacttccataatac

SEQ ID NO: 40389 - DNA, 407 bp, Zea mays
  Clone ID: LIB3062-030-Q1-K1-C6
ctctgttggaggaggtggtggaagcagcaggggaagaaggcaaaggaggggagaagatgtagtccaccgactgaaagtttctgtgggggagctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagccttgcaatgagtgcaaggggactggagagagcatcaatgagaaggaccgctgcccaaggtgcaagggtgagaaggtcattcaagagaagaaggttcttgaggttcatgttgagaaggggatgcatcacaaccagaagatca

SEQ ID NO: 40390 - DNA, 423 bp, Zea mays
  Clone ID: LIB3062-030-Q1-K1-C7
attccttggtttagacactcatcctcctactaccttcaaatatggcttggtttatatctattctcctccattcaaccgataggtccttaatcaatgttggctgtacatttttaccaaaaataatctccctattactaaaaaatattctacttataaacaataagcttagtctataactcatttatcatataatactaaccattttcacaataatatttataatctccatcataacctttcactctacactcatattaaacatcaatttcacaatcctaaattttatacctacatttctacccatactatccattatttcccaacttattgctacatccttcatgttaaatatctccatttctacatgaataatcttcataataaaaatttcaatgatctttcatactacaacattcttttaac

SEQ ID NO: 40391 - DNA, 158 bp, Zea mays
  Clone ID: LIB3062-030-Q1-K1-C8
tcttcctgctgatacttatccttatcggatgaggtttataccgagtatccaaaaaaaatagttcgctatatttaatttgcttgctgacttaattcccataatccccgtgtacatatctatcaccctgtgaatattctcagtttgtaatagggacgatt

SEQ ID NO: 40392 - DNA, 179 bp, Zea mays
  Clone ID: LIB3062-030-Q1-K1-C9
tcttcctcaaggcaaaaaagatctctgaggtaggattacttcactggcatcaaggatgaaagcaagattgtcgttaagggtcaagaagagcttgacattgatgtgcttgtgcatggcgagcctgatagaaacgatatggttgagtacttccgtgagcagctctccggttttgcgttcac

SEQ ID NO: 40393 - DNA, 371 bp, Zea mays
  Clone ID: LIB3062-030-Q1-K1-D1
gcggcgctgttcacgtccacggttaggatccggctcctggctcggcccaacggggaggtgttcaacgccggggcggtggaggacctgatcgttcggcgggggcgcgtctgctgcgtggtcaccaactgggcgctcgtgtccatgaaccacgacacgcagtcgtgcatggaccccaacgtgatggaggccaaggtggtggtcagctcctgcggccacgacgggcccttcgtcgccaccggcgtcaagaggctccaggacatcggcatgatcagcgccgtgcccggtatgaaggcgctcgacatgaacgccgtctatgacgagatcgtgcgcctcacgcgcgaggtcgtgcccggcatgatcgtcacctggat

SEQ ID NO: 40394 - DNA, 221 bp, Zea mays
  Clone ID: LIB3062-030-Q1-K1-D10
attcccggtcgacgcatcttcctatttatgactgatgcaacctcttctgtaatgagaagaatacttggctgttgtagattgattcatgtaggctgtgcatgctcgttagcctaaatcagctgtgcagtttgaatacttccaaattaaatggtcctctgagactcttcagaggtatcggatcctatttttcatgttcactgatgacttacaggttacatctt

SEQ ID NO: 40395 - DNA, 307 bp, Zea mays
  Clone ID: LIB3062-030-Q1-K1-D12
ctggaggttactgagatcttcaactgttctcaagatgatttgttaactgaagacatgaggatacttgacacgcatggtgaagttttcatttggattggtcagtatgtggaatcaaaagagaaacagaaggcatttgacattggccagaaatacgtggagcatgcaaattctattgaagatctttctccacatgtaccactatataaagtcatggaagggaatgagccatgcttcttcaagacgtacttttcttgggataacacaaaatctttggttcatggaaattccttccagaagaaactctcgc

SEQ ID NO: 40396 - DNA, 204 bp, Zea mays
  Clone ID: LIB3062-030-Q1-K1-D2
ggtcgcgagcctattcacgtaaagggtgaggcgtcgtatcctacgcacttcaatcgggtgggcataaatcgtcgggactagttactactttatcgatcggatttgtctcatactgggagctatcactaattatgctatcttgaatacgaatcattacactcaatcgatcgatgcagatgaagtctattaagccattcagttcat

SEQ ID NO: 40397 - DNA, 279 bp, Zea mays
  Clone ID: LIB3062-030-Q1-K1-D4
taacaacaggtatatcgacgaagtgggattcacgacacaactctcgcttggttcccttgtctggagccatcggtgggcctacgctattgccacacaactctcagatgaggaagatggactcaactataactcctgcgatgctacacaataaaggagggttcctgtctgcaacagtccaaattaacgagagtacgttgttacccacaggcaagccttgttgtcagtcagacatgagccatccaacatctaatgaagtgagcacttcagctcaagctacta

SEQ ID NO: 40398 - DNA, 395 bp, Zea mays
  Clone ID: LIB3062-030-Q1-K1-D5
cagactcttgtgaagagcgccattgtacaagttgatgctgctccattcaagcagtgggacctcactgactggggagtggacatcggtaggaagaagaaggtgcctgttgctaagaaggatgcgactgagggacaagagggtgaggctatagctgaggaaacaaagaagagtaaccatgtgcagaggaagattgagaagcgccagcaggaccgtgcactcgacactcatattgaagagcaatttggcagtgggagattgttggcctgcatttctgcccgtcctgggcagtgtggccgagctggtggctacatccttgagggtaaagagctcgagttctacatgaagaagctccagaggaagaagggcaagggtgttgcatcttagagcattctttt

SEQ ID NO: 40399 - DNA, 295 bp, Zea mays
  unsure at all n locations
  Clone ID: LIB3062-030-Q1-K1-D6
atacagacgaataatctcttcttggcctcactaacaccagctagcaactcttgctctgctgcaataatggcgcggcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgngcgtcgt

SEQ ID NO: 40400 - DNA, 222 bp, Zea mays
  unsure at all n locations
  Clone ID: LIB3062-030-Q1-K1-B6
tcttcctgcttctcctccccctcctgttcgggttctggttcgtgaggttctcctgggttgggtggcntttttgagcggatcgagatggctgcgtcngatgttgagtaccgctgcttcgtcggcggcctctcctgggccactgactaccactccctccacaactccttcatcacctactgctaggtcctcgagtccaagatcatcctcgatcgggagactcat

SEQ ID NO: 40401 - DNA, 371 bp, Zea mays
  Clone ID: LIB3062-030-Q1-K1-D7
cggactcgtgatcgaggacaggatgctcaccaccaacctgctgtccgctgaggtctgcaagctcggcgccgatgcgttcttggcacataggatctcctctgtcaatgccatctccgctctctgcgaggcaacctgatccaatgtctctgaggtggcttacgccgtgggcaaggacacgagaattggccccaagttcctgaacgccagtgttggcttcggtggctcatgcttccagaaggacatcctgaacctggtgtacatctgcgagtgcaacggcctgcccgaggtggccaactactggaagcacgtgatcaagatcaacgactaccataagagccggttcgtgaaccgcgtcgtggcctccatgttca

SEQ ID NO: 40402 - DNA, 315 bp, Zea mays
  unsure at all n locations
  Clone ID: LIB3062-030-Q1-K1-D8
gttcgttatgacgagcggaggtacctctccttctcatccatggcttctaccaatggccatcgtattatgagccatcccatcatcgtcagcttgcgggtcctacatatcaaatctctcatccatatctntctattctatcataatgacctcctgattgagggtcgcattatcggattctatgagtacatgaacttggtcctcgaagactctgatgaaatcaacgtcaagaaaaacactatgaaatcactgggccggatactcctcaaaagtgacaatataactttgatgactaacaatatcaagtgaaaattctta

SEQ ID NO: 40403 - DNA, 334 bp, Zea mays
  Clone ID: LIB3062-031-Q1-K1-C10
catacctgggcaccttgctcacttacacggggccacagaaccatctcatccatcccccattcttgttcggctatccctacaagtacaagacttctccgaacaacgtggctaacacatcgaacttctatgacctaacgctataattacacagctccctggcgccctactacctgtacggatccctgttccgcaactacatcttcgacccgttcggtctctcgaagcccgtcgagtacctgcacttcgagttggactccctggaccacaacctgtccaagaatgatgccagactcatcatcagcacccggttctaatcctccaaaatcaagtccac

SEQ ID NO: 40404 - DNA, 418 bp, Zea mays
  Clone ID: LIB3062-031-Q1-K1-C11
gactcttcaccctagatctcgagccgacgccctttatggttaatgatctggatcatttacctggaccattggaactcatccatggggattctgcactttatgccgacgagcatacaaacgcccaactacacaacatgagctcattcatcaaacccactttgaccctgctgtcgaggaccaactaccagacatattatcagtacgaaccaaccgtcgagtccctcactgctctttcccataccttcgatacgaaacggctgcagctcccaacggtcaatattcacatccccgggcctctctacatgacatacgaagaggcacacgacgtcaattcatctgcacattctgtaccgacatcacccagcacaagattctacccatacaacgataacttctacatcgactaatgctgcatcat

SEQ ID NO: 40405 - DNA, 426 bp, Zea mays
  unsure at all n locations
  Clone ID: LIB3062-031-Q1-K1-C12
ggcttagcgactcgcgacatccatttggtaacgtagcgggcgtcttggagcatgctttatcagggctgcgggcaagctgtccagagaacctcggagtttacacagaaataaagagagacctttgcaccatagcgaaccagatttttgcacttgtgccaacagcatcaggcaattgcagccctcctgtctcgcccatgtaactgggacctgccccggatagacccgttgccttcttgcaggccctgcagtacacgctgtctcggagttttgctgctgttggagcctgatgttatgaagtccggttgaatggtagcatacggaggacgcaagtctgatgtgctgacttgagcttgtatatgcagcgtgcgatcattaattggctagcctncttgtaacctgtgtatatacctgaatgaataatttata

SEQ ID NO: 40406 - DNA, 356 bp, Zea mays
  Clone ID: LIB3062-031-Q1-K1-C2
acgccaaaagcaagagcaaaaaaagaaaggtctcgatgactatggggaactcaagcttctagtacagcgctgggcaccacctcaagttacataagcagaaaccgttaactagacacacacatggacaggatagttctcatgcctacctgacaccagttcaactgcatacatgactctcatactcatgatatggactcgctaaagaatgacgctcctgagaaatggacactagcgaaggctcatggaacaactctcaccctaccatctgatgatcacataggcatcagtgaagttggacacattgcacttgatgctggtcaaatactcgcccatagtgctaagcttgtcgaacaaac

SEQ ID NO: 40407 - DNA, 156 bp, Zea mays
  Clone ID: LIB3062-031-Q1-K1-C4
aggagaataaggataattaaaaacgaactgcccttgtcaatgcttataacaagaagaaagaatctgggaaatcgtcagttttactagatgtgaagccatttaacgattacactgttatgtacaagctcatacaagctgttaggagtgtatagatgg

SEQ ID NO: 40408 - DNA, 269 bp, Zea mays
  unsure at all n locations
  Clone ID: LIB3062-031-Q1-K1-C5
gacacttacacccacgcctccacccactcntcctttcactttttcgtgaacagcaagctcacctacccgtacctgttagctctccatcgcttcgtcgaaggctaacacctacttcccattccttctctatgtctgccattaccctccattgtcccttagctctcctcctcatctctctcctccttctgactctggtcttctccatacactgcctgtacgctcaccaccgctttctgaagctccttcggctgaagcactatatccattcc

SEQ ID NO: 40409 - DNA, 170 bp, Zea mays
  Clone ID: LIB3062-031-Q1-K1-C6
tatacacatgacagacagctgcacgaactgcatactgcctgcatgggattatttaaatataagcctccttgctaatgcgtactagtgaaagctcatggaacagctgtgggcctaccatctgatgatcacatcggctacaggatacaaggttacaatgcacttcatgctag

SEQ ID NO: 40410 - DNA, 459 bp, Zea mays
  Clone ID: LIB3062-031-Q1-K1-C7
gaattccgggctcgaccgacgcaatcgtatgctcttcacgtcactaacaccacctagcaactctttctcttctgcaataatggcggctcgcgtactcatcttcagacacgaaactggtccctgctacaaccccaacaccatcgcggctcactgttcttgcgcggccaacacctactaccataacaacaaggcaactgccgccacctgacacttcacctgcaccggcgccttcactaccagatacccaagttcttcatgctgcttcttaccctaccggagcaagcgtccgctggaaccataaccccgaccactgcaggcaccatgggaggaggaacctgaagtacctccacaggcacacgcacagccgtcgctggcatgtcgacaggcactgacaccggaactgcgggtacaggtttcggcggtctatgaccaggcacatacgctagcatggacactgca

SEQ ID NO: 40411 - DNA, 440 bp, Zea mays
  Clone ID: LIB3062-031-Q1-K1-C8
ccgtttcgggccaggcctacgctttcgcatagactcactgctgatgcttattagagttaccagtattggcctaatgctcactggggagcggtcagaatgcacttcacttacaactcatgtagctacctatggacagtcccgagatgccatcgagctatgaccatgatgatgtgccaccacaactggcacaaacactctataggataatagggctgctcaaaaacgtactgtgcctgctaatgcttctggcaagaataaagaatctgggaaatcgtcagttttacttgatgtgaagccattctacgatgacactgacatggccaagctcgaggaagctgttaggagtgtccagatggaacgactgctatagggcgcatccaagcttgtcccagttggatatggcattaacaagctgcaaatcatgatgaccattgtcgatg

SEQ ID NO: 40412 - DNA, 390 bp, Zea mays
  Clone ID: LIB3062-031-Q1-K1-C9
ggaacgacccactcgaccgacgcgtacaagggaacgacaaggacaaggctttgagcgtcctgcgccaagaacccgatcccggccattggtgaccgacgtatgggcgctcgctggatgccgcccaccgtccaacgccgccgcagtagcagtagcagcccaccagttgcacgcgcatcatgcttctgctcccgtactaggaagacggaaggcccataagagagccctgccactgtcgttcaaaggcgtcaacaccaactgttgccaggaccaccagcttaaggcccccgacctcctcatccgtcggcggcgcgggctaccgtaccgcgcgctcaacctcgtgctcacctccgtctccgtccgcgctgaccggctctggccgtcgcttgtcct

SEQ ID NO: 40413 - DNA, 461 bp, Zea mays
  Clone ID: LIB3062-031-Q1-K1-D1
gcggaataatctcttcttcacctcactaacaccagctagcaactctttctctcctgcaataatgggcgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgtcaacatccccggcaagtgcggcgtcttcgtcggcgtgcccatcagccccaccgtcgactgcaccaagatcaactgatcgatggaac

SEQ ID NO: 40414 - DNA, 444 bp, Zea mays
  Clone ID: LIB3062-031-Q1-K1-D10
cgcacgcatgcgcacacgcaagtgtcaggatacgaaacgggcgacatggctcgcgggcaatgtgccatatcaggggccgtggtggccgcggtgctgctgctggcaacggccgcgacgacctcggaggccgacatcacctgcgggcagctgagctccgccatcgcgccctgcctctcctacgcccacggaacacggtccggcccctccgggtcctgctgtagcgacgtcacgaaccttaagagcgccgccagcaccgccgacgacaggcgcgccagctgcaactgactcaagaacaccgccaggcacgtcagcagcctcaaccgccacaacgccgtcagcataccctccaaatgcagcagtagcataccctacaccatcagcaccttcaccgactgctccaaggtgaactaaaacctagaccacgcgctactacgggcggctgat

SEQ ID NO: 40415 - DNA, 425 bp, Zea mays
  Clone ID: LIB3062-031-Q1-K1-D11
gcagcctacttctgcaggaccagcgcatactaccggtacaggaaacactgtgggtcctgcagactccccaccatctacaccatccacggatactgctgaggatggacggggaatgggtggtaatatgcgccacgttccaaagaacttaatgatttatggtgcggatggaactgggcttgcctcctcttcaaatcaaatggatgacctggagcagtttggtgatgtgggctctttggatgataatgttgaatccttcttatccaatgatgatggagatcccagggatatttttgctgcactcaaaagaagtcctgcagaacctaacccagccgcttcgaaaggttttactttcagtgaagtcaactgttggcgcacaagcaacagcaaaattgtttgctgacacttcgtttcagatggcaagattt

SEQ ID NO: 40416 - DNA, 440 bp, Zea mays
  Clone ID: LIB3062-031-Q1-K1-D12
cggacgcgtgggggcggaggcggaggcggatgaaaaggtcgcggaagcggattctgaggaggagaagagggcggaggaggcggaggaggccgccgcggtggatgaggcggcggtgatcgatggcactgggtcgttcaaggaggatagtaacctgctgtccgagctccccgaccctgagcgcacagcgctcgcgcagctcaaggagctcgtcgccaccgcgctcgctaacggtgagttcaacctgccgtcgacgtcagccaaggaggaggccaagaaggaggatccggcaaaggaagaagctccggcggacaatgaggacgagcccaaggcagaggatgcggctgaccaagagcccgtcaaggaggaggccaagcctgaggagcccaaaacggaagcgccggcagaagcagcgctcgaggaggttaatgacgagacacccg

SEQ ID NO: 40417 - DNA, 331 bp, Zea mays
  Clone ID: LIB3062-031-Q1-K1-D2
tcggcccacgcgtacgcaaaggtaccgaatccttctgcgaggccccagcacctaatgccccaggacaacaaggcaccatggtttgagaggaagcggctagaggacctgctgtcgggctagaagacggcagtggcgggacgcccccggacgtcaggcggactgtcgctgcgggcgggccaactcgtcttcgtcgccgagtacatctgggccatggactacgtgcccgtgttcacgcatctacacaggcttctggtaacaggcattctttcgtttgctgctgcatgctcacctgcaagcgtagttagtgcttttcgaaagggatgcgtacttg

SEQ ID NO: 40418 - DNA, 442 bp, Zea mays
  Clone ID: LIB3062-031-Q1-K1-D3
atggctattattggtattcaactgttgctttttgcattgcttattgtaaacatgcaaagtctggttcaagctcttggaagaaggaggttggaaatgcaactcaggcgccgtgatgttgaatagtggatgagccataggcgactgcctgaagatttgagaaggagggttagacgagccgaaaggttcacctgggcagctactcaaggagtgaatgaagaggagcttttgagtaatttacctgaagacatccaaagggacatacgtcgccacttctttagattccttaataaggtccgattattcaccttgatggattggcctatattggatgcaatatgtgacaaattaagacaaaacttgtatattagtggaagtgacattctttaccaaggtggcactgttgaaaagatggtcttcatagtgagagggaaactggaaagca

SEQ ID NO: 40419 - DNA, 401 bp, Zea mays
  Clone ID: LIB3062-031-Q1-K1-D4
gacagtgcgatagcttacaacactgtacgcttgttgctaagaacaccagcatacacagggatggctagctccatcagctgataagcagatatgtctgaggcaactgaagacctggcgtaagttgtgcaccgcgcaatatcattcgacttcgtttgctccactaagaagatcacgaccgacaactagtacggtaatgggggtggcctgaccataaacttttacatcaacagcctgaaaggtcatggacattggcttataccatatcgacgacaagtacggcgcgaacctcgacggatacaggacactctacaacgatgatgactgatctcacaccgtagacgtctacttcggtagaaccactgaacttatgatctgggccgttacaatcgctgggatcctaa

SEQ ID NO: 40420 - DNA, 292 bp, Zea mays
  Clone ID: LIB3062-031-Q1-K1-C1
attcctgttcgagatgcactctaaggtccaccgctacctctcctgtcgtttgcgtctaggtgcctctctttcgtaacaacagagacagttcaaacaaaactgtgattttggtattttattctttatatacatttattaatcaaacttcatattaaatttattttaatttatattttttttttatctattttttatttatttattttttatttttttatttattttttttttatttattaattttaattttttccttcttttaactttttctttttttatttttttatttttt

SEQ ID NO: 40421 - DNA, 435 bp, Zea mays
  Clone ID: LIB3062-031-Q1-K1-A3
ctacgcgtacgcgcacttcgtgtagatcataccagagttgtagacataatgcgcaaggctggtcagttgcatcttgtgaggccatatatggttgcagttcacagtcacaatgtctgtgctgagaatgaagccttgaatgagctttatgttgaagaggaggactatgagagactccgtgaatcaattgacatgcatgacaactttgaccagatcggtcttgcccagaagcttgagaagcatgaattgctggagatgaggaggattgccggctacatttacaagaaggctggcaggtggaagcaatcgatagctctatcgcagaaagacaacatgtacaaggattgcatggagacatgctgacaatctggtgaccgcgaattgtcagaggacttgcttgtctattgcattgagcatggtaagaacgaatgcttcgct

SEQ ID NO: 40422 - DNA, 470 bp, Zea mays
  Clone ID: LIB3062-031-Q1-K1-A4
acgcgcttgacgtgcgctacataccggcgaggagacgaatggagggagttttgagaagcataaatgggtcggaaagccgctcctgtcaagaagggtgatgccaaggcccaggccttgaaggtggccaaggctgtgaagtctggggcaggcaagaagaagaccaagaagattcgcacatctgcaacatttcaccagcccaagaccctgaagaaggccatggacccgaagtacccaagaatcagcactactgcaagaaacaagcttgatcagtaccaaatcctcaagtaccccttcaccacagaatctgcaatgaagaagattgacgataacaacactatggtctttattgttgacctcatagcagactagaaactgatctagggctgcagatcaagacgatgtatgacattcacgcaaagaaggtcaacaccctgatcaagcctgatgggaagaataaggctatgtgaaac

SEQ ID NO: 40423 - DNA, 353 bp, Zea mays
  Clone ID: LIB3062-031-Q1-K1-A5
cgcgtgcgcgtacgtccagcggatggtaccatagttgtcgacgtcctgcgcagggctgaccatttgcatttgtgcagggcctgtcgtcgtccgttccaagcgcagacaccatgacggagtgcgttgcgatccatgtacgccatgccggaatccaggtctattacacgtgctgtgagctgtactgcattgagcatggcattgaggctgtcggtctgatgcccgggcacaagacccttgtttgacgtgatgatgctatgaacacctgcttcagtgagactggtgctggcaagcacgtgccatgcgctgcgttattgacattgaccccagtgtcatcgattaggtgagaactggct

SEQ ID NO: 40424 - DNA, 462 bp, Zea mays
  Clone ID: LIB3062-031-Q1-K1-A8
gtgcgcgtgactgcatcttccgttttcagagctcagagttttcgttgtttgtttcggatgacgacctgtcgcaccgcgaacgcagccgccgtcgtccgtctcctgctgctgagctctttctgcgccgtcgccgccattgcctgcgaccctcctaatggcgccaagttcgggtacaccggctccgtcggtcccgaccactggggcgcactgagccccagcttcaggcagtgcgcgacagggacgaagcagtccccgatcgacatctacacggtccaggcggtctccaacccggcgctgcagccgctccacagggactacaccgtggccaacgccaccctcgtcgacaacgtcgtcaacgtcgcgctgcgcttcgacggcgacggcggcgccgggagcgtgagcgtcagcaggaagctgtacacgctgaagcaggtgcactggcacttcgcttgcgagcacacc

SEQ ID NO: 40425 - DNA, 445 bp, Zea mays
  Clone ID: LIB3062-031-Q1-K1-B10
ggctcgctttgagaggctagcagatttgcttgcttgagatattttgaagccttataccaaggagcagggttccatcggtatgactgccaatgacgatccatataatgctaatgaaatgagcccaagcgaccaaagacaaaaccatgtttcagcatcgagaaagagacctatttccctcccaagaagtgaagaatcaaaaactgggaagagacagagagagaatggtgatgatatgattccaacaccagagaactatatacctgaagatgctctagaacatgtccaagatagcaagggaactgatcgactagaatcatttacagtgaagaagttaagagtgggtgactacgatgatgaacgaaacattgtttcttcaagcaatatttttgcggataggtacaagggcgatgatgaggaagttgatgttgattagtgaccccatgcc

SEQ ID NO: 40426 - DNA, 327 bp, Zea mays
  Clone ID: LIB3062-031-Q1-K1-B11
aacgccattgcccccgcaatccccttccaccgacggcgcggaccttccgacgacgaagccggtcttgggtggcgtcctctcggcctgcttggcctcagctgccgacactccccacactcgctttccctgggctgcgcgggtgaaggagcgcgcgcctgcgtacatgccggtggttggactcggatctgctgatgggtggggcgccggatggcgtcgttcgctgtgtccggcacgaggctcggggttgtgcagcccagcggctcggcgcgatctggtggcgagcgtacgagtgcggtggacttgtcgtcggagctcttcaagaggaag

SEQ ID NO: 40427 - DNA, 394 bp, Zea mays
  Clone ID: LIB3062-031-Q1-K1-B12
agcaaccagtgactgcatccggggctcgacacagggagcacatctactgggcacccgggctgccgaacccggggccgcagaacgggcgcactccggcccggttcggcttcgcgttgggcggcaaggccaagcctgctccgaagaaggtggccaacacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcaaccctacag

SEQ ID NO: 40428 - DNA, 353 bp, Zea mays
  Clone ID: LIB3062-031-Q1-K1-B2
acgagcgaagtccgcgactgtgaagtttgcaccggagaagcctaaacgtgttgtgacccaaccataggatggctctactcaacgaaagcgatctcgactaaatgctggtgcgaccaatgcattatccattaacgatcaactgcatgatctacgacccatctattgagcccgcgtgacaaaacaccgtatgccgctggcacctacgctgactctgaatgctgagcaagcatatgaccctctcgacgaggactattgatctgtgactcgatatactaccacatcatgcagagctgacccaactaatacaactgctcctgatggactataatgtgtgcagcgtcaccgtgctgacc

SEQ ID NO: 40429 - DNA, 334 bp, Zea mays
  Clone ID: LIB3062-031-Q1-K1-B3
gcatccctagtccaagtatatcaacttagcacgtttgcttaatcacattgatccgctcgtcacgcggaacgggattactgcatagggccaatgtgtgaacgttgaatcctcaacaattccttcatccccaactccaaatgttgctgaaacacataccccatctgctgatgacgaggactatgatcatgctcacctttttggttaggagacctaacattacaagaatgcttcttaacatcgtgctgcagcttccaatgcttcttacaacaataaacaatcttataagtcatcagttttactagatattaaaccatgtgactattatacttacatt

SEQ ID NO: 40430 - DNA, 365 bp, Zea mays
  unsure at all n locations
  Clone ID: LIB3062-031-Q1-K1-B4
cagacgaataatctcttcttcacctcactaacaccagctagcaactctttctctcctgcaatagtggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtccgcggcggaccggcaggccacctgcaactgcctcaagagcatgacnggccggcttcgcggcggcgtcagcat

SEQ ID NO: 40431 - DNA, 357 bp, Zea mays
  Clone ID: LIB3062-031-Q1-K1-B5
cctacgcctgcgcgtctggtccaagtatatcaacgtagcaaggtggtttaatcacattgatgcgctcgtgaggcggaactgaattactgcaaagggccaaggtgtgaaggttgaatcctcagcaattccttcagccccaactccagatgttgctgaagcacaggccccagctgctgacgaggacgacgatgatcatgttgaccttttctatgagtagaccgaagatgagaagaaggctgctgaagagcgtgctgcagctgccaaggcttctggcaagaagaaagaatctgcgaagtcatcagttttacttgatgtgaagccatggcacgatgagactgacatggccaagcttgacga

SEQ ID NO: 40432 - DNA, 262 bp, Zea mays
  Clone ID: LIB3062-031-Q1-K1-B6
ggcgcacacgaatagtctcttctacacctcactaacaccagctagcaactctttctatcctgcaatgggggcgtctcactcctcctgctgccagccgcagctggtcgcggcggccgcagtcctggcagcggcgctgctgctgctggcagcaaaggccgatacggcgtcagcggcggtgagctgcggcgaggtgacgtcgcctgaggcgccgtgcctcgggtacgcgatgggcagcgcggcgtcaccctacgcggcgtgctgc

SEQ ID NO: 40433 - DNA, 475 bp, Zea mays
  Clone ID: LIB3062-031-Q1-K1-B7
gatgcactcggagggccaccgcgaccgctccggtcggttccttcgaggtgccgcgcggtcgtaacagcagatacggtgcatacaaagctgcggttttgggggttgttgctgtttgattattttttttttgtgttatttattatctatttgatggtttgttcttatgttcttttttttttgtttttttttgtattttttttttttgttattattattttttattattttatttattttttattttttttttgtttttttttttgtttttttttttattttattattttttatttttatttttttttcttttattttttttattttattattttttttttatttttttttttttttttttttttttgttttttttttattttttttttatttttatattttttttattttttttttattttttatatttttattttttttttgttttttttttgttttattttttattttagttttt

SEQ ID NO: 40434 - DNA, 205 bp, Zea mays
  Clone ID: LIB3062-031-Q1-K1-B8
acggcaagagcggagagtgactgttcacgatgacaatagggaacttaagctgctagtactggcttgggcatcagctgaagttacatgagcggaaaccgtgagttggagagacactttacgggtggtgctaatgcatcctgaaccagtataactgtctacatgtagctcaaactacagtattggacttgctaaagattggagctcc

SEQ ID NO: 40435 - DNA, 452 bp, Zea mays
  Clone ID: LIB3062-031-Q1-K1-B9
gggcgcggcgaagggggagaagcgcaagtggttccccgacgcgcggtggctgccgccgacaggcgttcagggggggaccctgtggtacgggaacggcgatccgaccacgccgctgtggccgtcgtgcgcggctggggacgactgcgagcggctgagcatggaggagctggacggcagcgaggagatgccgggcatcccggcgctgccagtgtcggccagggacggggagacaatcctcaaggcgatgggcggcgatgtcgcgccacccaagtggcagggcggcgacggcgcgcccgtgtaccggctcggccccggcccggccgtgttgaacctcacctacattggaaacgagactttagcaacaatcgaaaatgtgtttgcggtgatagaaagaaaagaggagcctgacagatatgtgatcataggcaaccatcgtgatgcttggacatttg

SEQ ID NO: 40436 - DNA, 362 bp, Zea mays
  Clone ID: LIB3062-031-Q1-K1-A2
gcgccatgcaactgtggcttctgttttcgtgcgcctagcagatctgtacaataagacggcgaagctgagggggtcaaaatcctactgtgaaaacgccctaaaaatctaccaaaagcctattccagggacttctctggaagaaatcgccactggtttaactgacgtatcagccatatatgagacgatgaatgagcacgagcaagcgctcaagctacttcagaaggccttaacactgtacaacaattctgccggtcagcagagcacgattgctggcattgaggctcagatgggcgtgctgcactacattatgggcaactatggcgaagccctacgacttccttcaacagcgcaattgcaaagct

SEQ ID NO: 40437 - DNA, 305 bp, Zea mays
  Clone ID: LIB3062-030-Q1-K1-G12
cccacgcgtccgctagaagggaaacgagatgaccctgatttccgcaggacacttgcgtggaaagcattccggcatgttgcttcctatgattctgctatctcggagtggttgtggaagcaatctaataaagattcatttcctcccagctttactgtgcccctcacaatgaagtctacacttcgctatggtgagaatcctcatcaaaaggctgccttttatggtgacaggagtctttctctagtaaatgctggcggtattgcaacagcaattcagcaccatggaaaggaaatgtcctacaacaacta

SEQ ID NO: 40438 - DNA, 365 bp, Zea mays
  Clone ID: LIB3062-030-Q1-K1-G2
cagaaacgagagggccggagcagcggcagtcccggcgatcccgccgccggtcgcccgcatacgttcctcgtggctggcttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgttcttcgacca

SEQ ID NO: 40439 - DNA, 406 bp, Zea mays
  Clone ID: LIB3062-030-Q1-K1-G5
gttagtcataagactaatgacgatcaagactatcagaggcggctacaaacaaagctcatgggaaattagagggggaaatgaaatgaccgtgttgaaaacagggccaaagtagctagcaattcaaagaggcaaaatgctgcaaaatataatgcttcatgaggtcagtaaatacatatttggtaattccatgctaatacactgatgctttaagatgcctgagacatctatcttctttgttagttgttttcggtgttgtcaaaatctcacgtgccacaatggatgaaagaacaacatgtataattgggttccaaagagacttgagggctaattcatcacaacctgtaactgaagatcttgtataactgactacatcaccatgcaagactaatgtttatattttattaag

SEQ ID NO: 40440 - DNA, 323 bp, Zea mays
  Clone ID: LIB3062-030-Q1-K1-G6
tagattgagatcctgtagaagaagggtctctcctactctgagatcatcaacgggagcgtgattgagtcgggggactcgctgaacccgttcatgctcgcccgtggggtctccttcatggtggacaactgctccacaacgtctcgcctgggatccaggaagtggtcgcctcgcttcgactacatcctgactcatcatgcctttgtggcggttgacaaggactccccgatcaaccaggacctcatcagcaacttcttgtctgaccctgtccatggtgccattgaagtctgctcctagctgaggcccaccgtctacatctctgtgcc

SEQ ID NO: 40441 - DNA, 427 bp, Zea mays
  unsure at all n locations
  Clone ID: LIB3062-030-Q1-K1-G7
cgccgccgccgccgtttcgcgcacggtaccctagccctcgtcagcggcggcttggaggtcatccagccatggcgttcaagcggaggaatggcggacgcaacaagcacgggcgcggccacgtcaagtacatccgctgctccaactgcgccaagtgctgtcccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgcgcaatccatgcgcacattgtccgtgtccgctctcgtgagaacaggaggaaccgtgagcccccgcagcgcttcagacgccgggatgatggcccaaggcctggtcagggcccgccgngcccaggcggtgc

SEQ ID NO: 40442 - DNA, 181 bp, Zea mays
  Clone ID: LIB3062-030-Q1-K1-G9
attccctctcgacgcactcttccttctcactctcctctcctctctcactgtttcaactccacgcttcactcaaccttaatatgttataatctctaagctctaactatccacaccactccttcatctatccattacccttctcatccacacaaactaccacctcctacttccaaacccccac

SEQ ID NO: 40443 - DNA, 300 bp, Zea mays
  Clone ID: LIB3062-030-Q1-K1-H1
ccgtctgatccagcaaaaccttttcaagcaaggtacgctataaatcctcagcaatgccaggtaggtcatacacgcatgagcttcagaccagacgaataacggtacgcaccactcacgtacacaaatcacttgaagtacattcgttgctctaacttctaacagcgctgaacgactgttaaagctatctagcaactatcagtgatccaacatgtgaaaagccacacttactgtatagaccacacacattgcctgtctacatgagggatagtcattacccatgatacatccaataccacatca

SEQ ID NO: 40444 - DNA, 391 bp, Zea mays
  Clone ID: LIB3062-030-Q1-K1-H11
gccttttcattatctttcccattgtgactgtgatggtgtaatatgcagcatgtgactgggttgtctgggagggaagactgggcttcggatcactggtaccatcctacaacctgggttcatacttgacctagatgtcaaaagtatttagttttaactattgtgtgctaaactatgtacgtggcatgaaagttaaggctgatcgtgatgagtcgtatccttatgctgctatgcttgctgctcaagatgttgcacagcgttgcaaggtatttgtagtgaagcctgcaatttcgtctgtgtatccaaagatgatgtttgcttaattaaattgaagcttacgattatgtaaggctgcttacgttgctgtgggcagataagtgacttggtcttgtgt

SEQ ID NO: 40445 - DNA, 214 bp, Zea mays
  Clone ID: LIB3062-030-Q1-K1-H12
caatgacagagatcgtgttgttgaagcaaaggatgagctccacaggatgctgaacgagtatgaattgagggatgctgtcttgctcgttttcgcaaacaagcaagatctaccaaatgcaatgaacgctgctgagatcaccgataagcttggtctccattccctgcgccaacgccactggtatatccagagcacttgtgctaccacaggagaaggt

SEQ ID NO: 40446 - DNA, 421 bp, Zea mays
  Clone ID: LIB3062-030-Q1-K1-H2
agctagctagctagcaccttaattttcattgttgggaaacaagctagctagctactgggatgcagctgttgttggtcctctgtttttcggactactatctgtcgagttcaggtgaaattgcctttcttttttgaaccagattaaataggtatgttggaataatcctatttttttcctcttgggaacgcaaccagcacacgttcatcaggagtgtttctgtttggcctggctatctgtttcggtttggatacatacagatagcttaccttcttggttcatcaggagtgcaaagttgcaggatctcaagcggcgctgacgatgacgcatcatccctggagcctttcacggtcgagcaaggactagtaagaaggagggccacatgcgtcgtggccccgtgacaactgcttcacgttctctcagg

SEQ ID NO: 40447 - DNA, 240 bp, Zea mays
  Clone ID: LIB3062-030-Q1-K1-H3
attcccttctctagccacgcatcccatatcattctataaatcatatatagccatggttgaacacacaactaactcactactaggcagcgtctattgatgggacgtcagtcctcacactactatcttccgatccaacgacttataaaattcatatctgcaactaaaacaaacttctacgtaacatcaaacctattagatcactatcagaaaccaaacctatacacattcataaccactatc

SEQ ID NO: 40448 - DNA, 151 bp, Zea mays
  Clone ID: LIB3062-030-Q1-K1-H4
taatcctcccattgacgtacgctaggggttcggagcatgccttcccaagaagtgggactgcttccttcgtcgggggggaaaattgggaagactccggtgcggattaaggccgttgtgtactccctgtttgcctttcatcataaggtgattc

SEQ ID NO: 40449 - DNA, 335 bp, Zea mays
  Clone ID: LIB3062-030-Q1-K1-H5
cattcaccggggggggtgcaacgaccataatccaaatggcccgcaagcgcaacttggataagaacaatgaggccaatgggagccagctctagaccaacatgaaggccatgatcatccagagagcacgccgaggccaagcatcccaagacagacgtgtaccagtgcttcccccatctgaagaagtgaaaggcctgaacttagcaaccaatgctgatttgaccagcgggcgttccttgtgttgagggtgttcattccgtgttatcttcccgtcagtcatgcgtcctgtcctatgttaacctacataataaagtgatgtcatgtccacttctagtgaa

SEQ ID NO: 40450 - DNA, 430 bp, Zea mays
  Clone ID: LIB3062-030-Q1-K1-H7
tcggagaaggtgaagcctcatcctctggtgatcactctcctgactcatgtggaggacgggatccccaggtgggagatcgtgcccaccaagcaggacgtcatcgactccgccttcaaggaccccgtcaagcgtgaaaagatcaggaggaaccagctgatctaccaggacaagccgcggctcaagactgcgttggagatgctcaggaccagcatgtacatagaagacagcttgtcacaggtgacgctgccgttcttcgtcctgcacggcgaggccgacacggtgactgacccggaggtgagccgcgcgctgtactagcgttcggccagcgcctacaagaccatcaagctgtacccgttgatgtggcacggcctcacagccgttgagcccgacgagaacgtggaggccatcttctccgacatcgtgtcctggc

SEQ ID NO: 40451 - DNA, 355 bp, Zea mays
  Clone ID: LIB3062-030-Q1-K1-H8
ccttcccaaagctcgcatagatgtgcatattctggggaagctgctgacgatgacggtgacgaatctcggtcggtgacgaaaggagatggtgaagtagggatggtaaaaattgacaaggacagaaatgctggtgtcagcagtgctttcggcttagaagatgaggctgaggaggacaagcgggaatagccatttcttgttcctgatgtcccctaggtcccagaaacaatcgatattttggagcagcaatattgcaagaatacttctttttcaagttacatgtcggttgctgtaaaagtgctgggaattgtaaacatgcgaactctattaaaagaaaaaggataaggaattctaatcc

SEQ ID NO: 40452 - DNA, 332 bp, Zea mays
  Clone ID: LIB3062-030-Q1-K1-H9
tcccactcgtccgcccactcgtcctggcatacctgaattaagttgaacccaatctaggcgagcttatgtgcagtatgcaggtccaacctgtgattgacccattttttctgttgtttctttgcccgtgatgttactgctctggaacttaagtgtgatactgttgtagttacactttactgccctgactatcatgtcaaacggctggatatctttgaaactgtccttgatgaatctggacgtgtattttgtgtgtgtgtatatggtttttgcttcttcaatgtttgtccatggaatatagatatataaaaagctgttgcatcaataattaaaaa

SEQ ID NO: 40453 - DNA, 347 bp, Zea mays
  Clone ID: LIB3062-031-Q1-K1-A1
gctttaggtgttcacgagaaatataatttgccatcaggaaaaccaaagttaacaggaagttcggtgttcaggctggggattaaaacgaggaacatgaagatattgcttcgtagcccggaaaggaacttgggggatttatagcaatattagtgtgacattttccacaagactgagaagaatgtggtaaaacagtgcagaaaggaagatgccaactgtgaccacacacagacagttgaacaacaacagccctttgacgacagacagacagttgagcatgcttctcttcagaaaactgatctatgcaaagagacccatgtttcaaaagcttaaacgcttaccgcaaattc

SEQ ID NO: 40454 - DNA, 214 bp, Zea mays
  Clone ID: LIB3062-031-Q1-K1-A11
atcgacccacgcgtgggctgaaaacagccgtggaaaagttggttctgaaacggtgcttctaatcaaagggtccaaatggcacaggtgctgctgcttactgtggttttgcaaccaaaatactccaaaacaatcctgttgatcaaccaggacctaaaagtaacttggtttccaatgcataacttaaagggtcccatttttccacccatattaaatt

SEQ ID NO: 40455 - DNA, 394 bp, Zea mays
  Clone ID: LIB3062-031-Q1-K1-A12
acatctggaccatggtcactgttaagggttctagtgtcatttatgctaatacaggtagaggcttattatataggtgagagcttggaaactatgcagagtatagtggtgctcctaatgaggaggaggttctgaattattctagagttgttcttgattgtgcaactgctgatcctgatggccgcaagagagcccttctcattggaggtggcatagctaacttcactgatgttgctaccacattcaatggcatcatccgagccttaagggagaaggaatccaagttgaaggcttcaagaatgcacatttatgtccgccgaggtggtccaaattaccaatctggactggctaaaatgcgtaagcttggtgcagaactcggcgttccaattgaggtgta

SEQ ID NO: 40456 - DNA, 395 bp, Zea mays
  Clone ID: LIB3062-030-Q1-K1-G11
gtggagtgtcgcttagcagcgattgttcttgccatcaaacttgggatggataggaaagaggctatctcctgcgttacaaccctctccgatgttgaggggctatgtgtttcttttgctgggagagaaggttcatctgatcctgcagtagctgtgaagaaacttctgcatgaggacccatatacagctggagaaatagagaaaattacaggagaaggcctgacatctgtcttccagggctctcagacgtcattggaagttataaaagcggcaaagcactacaagctatttcagcgtgcgacccatgtctactctgaagcaaggagagtttatgctttcagggatactgtctcttcaaaactcaatgaggaaggcaagcttaagaaacttggtgatct

SEQ ID NO: 40457 - DNA, 260 bp, Zea mays
  Clone ID: LIB3062-033-Q1-K1-B5
gcgacataccatcatcggcacctcgctcttcttctcagctctccccctctagcctcaggtacgtatacacagacacttccgttgatcgattgagtttgaacccaccaggatcaggcttaggattacctcatgtctgcgtcgccggagttttacaggcccattgaagcattggacttttagctgtactgtgcaactcatccggtactgtaccctggctacatctactgttgcataacgcctacggacagcttcatctgcta

SEQ ID NO: 40458 - DNA, 446 bp, Zea mays
  Clone ID: LIB3062-033-Q1-K1-B8
catctctccacacaactaagaagccagcggctgtaacaggagtgaagcaaaaaaatggcatgagtcaacgggatcagagatgagcgaggaaatcgatgtccagcttagtccagaggagaaagaaagtttagatgagatcatcaaggaagctgagagcgacttggagtctgaggaagtcctggatcaatcccttgccattgttgccgagaatgaaggtctggacaaggacgcagctgcaaaactcacaatttacactgtaggtggtgttttgaagaatctgacagagggccccttgagtgttatggataagcacatatatgcaggacacactgtcaaaccatttcccagcctgattggagctggaaagtctggttgtttcgtcatctgaaatatatttgctaaaggtgttgaggcttgagtggtgtacaccggcaacaacaaaaatt

SEQ ID NO: 40459 - DNA, 445 bp, Zea mays
  Clone ID: LIB3062-033-Q1-K1-C1
gaagaaatcgaattcgagctgtcaacttgtgtggttcgaagctaattaagaaaataagtgggcaaagcaacagactgacttcaatgcatgggtttcaggaatgtgctgcattagaggagttatacctcatccataatggaatccaaaagatggaaggcctctctactttgcataacctccgcattttggatgtttcagctaacaagctaacgactatagaaaatatcgaaaccttaaccaggctggaggacctgtggttgaatgacaaccaaataccatctctagagggtatagagacagctttggctggttcgcgggagaagttgacgacaatctatctcgaacgaaatccctgtgcaaaaacttcagattactcgtcgacgttgaggaaaatatttccaaatctcgaacaaattgattcagatatcatagcatgataactagc

SEQ ID NO: 40460 - DNA, 194 bp, Zea mays
  Clone ID: LIB3062-033-Q1-K1-C10
atttccggatggacggcacgcatcctatgctcccttgtattctcaagcccacctaacacccttagaaaagaagagacttaactgcgcgagtgcacgttacgagtggagaacgccacctccgccatcgctaagccgtcgctgtccaagaagccctctccgtcgttccgccttcggaacggcagcctcaacgcact

SEQ ID NO: 40461 - DNA, 167 bp, Zea mays
  Clone ID: LIB3062-033-Q1-K1-C12
atgcggaagctgctagggctactgtgccactacgaagatgcacgtgaacataggggattatagatctgaactcatatacatctacatatctataaggcatactacgtacgcagaatgaggataggtccacagtggatcatatacctgaaccgacatgcttggacgaa

SEQ ID NO: 40462 - DNA, 455 bp, Zea mays
  Clone ID: LIB3062-033-Q1-K1-C2
gcagctgccgcgggagcaggtgcaggtggccaccaagttcgggatacggcatgacgagagcggcacgcggaccgtgtgcggccggccggagtacgttcgcgcctgctgcgaggccagcctgcgccgcctcggcatcgactgcatcgacctctactaccagcaccgcattgacaccacaactcccatcgaggagacgattggcgagctcaagaagctggtggaggagggtaaggtcaagtacatcggattgtcagaggcgagcccggacaccatcaggcgtgcacatgctgtgcacccaatcaccgcggtgcaaatggagtggtctctctggtctcgcgacattgagcccgaaattgtgccgctctgcagagaattgggcattggaattgtaccatacagtcctcttggccgtggattttttggtggaagaggagtgaaagaacaagtgtctgctg

SEQ ID NO: 40463 - DNA, 454 bp, Zea mays
  Clone ID: LIB3062-033-Q1-K1-C3
gtctcccaatttttggcattggtgttggacatagcacatatgacaaagcttcggtccactggtatgtgcaatctcatatccagattaacgagtaccgtgatcgtataattttgcctaggctgacacaacagtttgggcggcctgttaccagctgtataaaagtgctggatatgactggtttgaagctatcagcactaagccaaataaagatgttgacttccatatcgacagttgatgatctaaattaccctgaaaagacagagacctattatgtagtcaacgttccatacatattttctgcttgttggaaggttgtgaagcccttattgcaggagaggacaaaaaagaaggtcaaagttttgactggctgcgggagagatgaacttctgaagatcatggactactcatcactcccccatttctgccgccgggagggctctggatcatcgaagca

SEQ ID NO: 40464 - DNA, 471 bp, Zea mays
  Clone ID: LIB3062-033-Q1-K1-C4
gagatgtttcctgcccacaaggtgattctttcagcccggtctcctgtttttagggcacaactttttggcccaatgaaggatggggacatgaagtgtataaagattgaagacatggaggctccagtattcaaggccttgctccatttcatgtattgggatgagttgccggatattgaagagcttactggtgtaaatacaacttgggtatccaccttgatggctcaacatttactagctgctgcagaccgttatgcattggagagatcgaagttgctctgtgaacttaagctgagcgaagatgttgcaatatatacagtggcaaatactttggcactggctgaacagcaccactgttatcagctcaaaactgtttgcttgaaatttgtagctctggctgaaaagttgaaagctgtcatgcaaaccgatgggtctgattatttgcaacaaagctgcccatcccttctgaccgag

SEQ ID NO: 40465 - DNA, 346 bp, Zea mays
  Clone ID: LIB3062-033-Q1-K1-C6
ggaaccccaagtgaccgcccaaccggaagccaggtctctgttgaaaactgtagcttatgatgtatgttggggatgaggaaggccttgttcgtttacgtcggattgcaaccggaatcattccagctaatcaaagtttatataaattagagaagtaatccggctaggaatcgttccaacccaccaatccgatagaaacgaacaaggcctaactggttatcttgaactgacgttcatgtggcatcgcaatggcacatgaacatacggcgttccatgagtttgttaaccggaatatgaacctaccacctgcggtatttgatccctgaatgttgagtttgcacttctgctt

SEQ ID NO: 40466 - DNA, 443 bp, Zea mays
  Clone ID: LIB3062-033-Q1-K1-C7
acgcgttcgaactgatcgagcagtacaacctgaacgggcacatccgctggatctccgcccagatgaaccgggtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctgggagtacgtg

SEQ ID NO: 40467 - DNA, 449 bp, Zea mays
  Clone ID: LIB3062-033-Q1-K1-C8
agctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtccacacccgtgctggtggccacagcagaccagaccctggaggacgtcgagtgccacttcgaggcc

SEQ ID NO: 40468 - DNA, 343 bp, Zea mays
  Clone ID: LIB3062-033-Q1-K1-C9
tctgcctcctccggctgcatctctgcccatccgagcccaaacctcttaccacttctcagggctctggtaatccacacggcacacgccatcaacgcaggcaaggacaggttcgaactgcctgatgatccgcacacatgatccgcattacgcgtctgctgcaagagcctcacgaacctctagaaattctgcagcaatctggtgaagggccccaagggtacgcgtactcaacgtcaaaggcctccgtgccgtattcccttaccaatgtgccttcacatcaccaccaggaaatcttcctgtggccaaggtaccaacacctgggatcgctttgaaatgaggattcaca

SEQ ID NO: 40469 - DNA, 302 bp, Zea mays
  Clone ID: LIB3062-033-Q1-K1-D1
agacgtacgcgtccgcattgaacatgtactataaccagtatcaccttatctgcttctgcttcgcccatatggatgggttgcatatactcgcaggatggatattcttactggatatgcacgtctcattattgcatcactatcttgaacatacattggttgatcatcatgactaggacaatctgttcttgcttacgtacgtttccctgagcctatctctttactgccaagattatctactactgttcttgactgtaacatctccaactttataaaagcaattaagcaaagagaatcctattcta

SEQ ID NO: 40470 - DNA, 244 bp, Zea mays
  Clone ID: LIB3062-033-Q1-K1-D10
ctgaccctttagccgtactaccggtattttcaatctgtacggcactgattcatctcaaggatgcattcataaagcaggggctgcaagcgcaagcccacaacttcaacgcccacacctcggagctcacgatccagctggcgttcgctcccaacctcaaggacatccgctccatacgaggtccacatccgccacaacgagaataaacagcacagcatgcttagcatttacgaccacatcctctcca

SEQ ID NO: 40471 - DNA, 296 bp, Zea mays
  Clone ID: LIB3062-033-Q1-K1-D11
agccagctcaggagccgagcctggtcagggtagccaagcccatcccggtcgtctcccgacgtcttctccctccggaccgcggctccggcgatggccggcgtcggctccgcgctgcgtcggctctacctctccgtctacaactgggtcgtcttcttcggatgggcgcaggtgctgtactacgcggtcctgacgctgcgtttgagcgggcacaaggccgtctatgccgccgtcgagaggccgctgcagttcgcgcaaacagccgccatcatggaaatcgttcatgggctcgtaaggtt

SEQ ID NO: 40472 - DNA, 251 bp, Zea mays
  Clone ID: LIB3062-033-Q1-K1-D12
acgcagcgctacataacacaggctcatacacactcttgctttaaattaactggagcactgctcagctgaaggcgtcggtcacagatctgggactgcaagaggacgcacacagcttcaaccaccaagctcaaagctgaccttacacctatcgaccgcgccgaatacaaagaacatgagcaagtcctagttctgagacgccttcaatctattgtaaatatacacaacgcatccccttgtctatgtccctactg

SEQ ID NO: 40473 - DNA, 442 bp, Zea mays
  Clone ID: LIB3062-033-Q1-K1-B3
gctgttgttttgagtgtgaaacttgaggaccaagatgcgtttgaacgcgatttctgccagctgaagccttattacatggatacatgtggcataattcccgcctcgccagaggagtacccaattttgggactcaatcttctgaggctgtgggtcagaatagaattgccgaattccacactgagctggagcttttacctgtcaaggcactcgagcatccttgcatcaagcatgctgtagagcttgagcaatccttcatggagggtgcctacaaccgagtgttaagcgctcggcaggctgtgccacatgagacctacgtttacttcatcgaccttctcgccaaaacagttagagatgagatcgctgggtgcagcgaaaaggggtatgattctctatctgtgagtgatgcaaagcaaatgcttatgttcagttctgaccaagatct

SEQ ID NO: 40474 - DNA, 363 bp, Zea mays
  Clone ID: LIB3062-032-Q1-K1-H7
acgacggcggcggcggatcccagtgcggccactagacacgcccgcaccacggcggcgggggcggcgccccgactgtgaggcagcagacgtacaggatctactgcaaggctggagaggaccagtacagcctcgcctcccgcgactgcaaggtctgcctagtgcgcacggaccgtgatgacgacgcgcagcactggatcaaggacatgaagtacagcaccagggtgaaggatgaggaaggctaccctgccatcgtcctcgtcaacaaagccactggagaggctctcaagcattcccttggccagttacaccctgttcttctgacccgtcataatccatacttcctggacgagtctgtcctgtgga

SEQ ID NO: 40475 - DNA, 401 bp, Zea mays
  Clone ID: LIB3062-032-Q1-K1-H8
gcgtccgaagttgtccaggaaagatatagaggctggttgtccagcttgccgtggtctctggggttgtggaccatgcggacgtggtaattccaagggttctacgcctaaggaaccgtcaaaagttgaaaggaagatacttagcataaaaatttccaaccatcaattttacaagcttttacctgtgagacttgaccaggaacagctagatgagttggaactggaagctaaaatacaaggaacaaaaatgtctaatgtctgcgtccaggtggctgaaactggtcagagtgagtcactctactgttataactgtaagctgtcgatgagccgattattgatgtgctgtccgacatgcccggttaagctgtgcctaagttgctgtcagaagattcgtgaaagaaaca

SEQ ID NO: 40476 - DNA, 377 bp, Zea mays
  Clone ID: LIB3062-032-Q1-K1-H9
gaacgacccacgcgtggggaacagacatatgctgacgccttggccaaagttccggaccccgaagacagcactacccaggaggccgatggtccgcatgcgggggtgatactgattccgatatccgtacctcttatcagcactcatgatgctgcgctccaaccccatctgactcctcatcctacgatgcatctcatccagctctcactatctctgctattaacctaacgagcaggagccgacgataccacaagcccttagtcgaccaatacaacaacgcgcgcaacgctccatccttgtacaaggacgacactgacatcgtaacgaggatcatcggcgcaccttcttgccataacgtcatgaacctgcagatccgcgtc

SEQ ID NO: 40477 - DNA, 309 bp, Zea mays
  Clone ID: LIB3062-033-Q1-K1-A1
gcggtccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgtcgccgtcgcaactgccttccgtgatcgtcaggctagccagatcaccttttcccaggacggg

SEQ ID NO: 40478 - DNA, 329 bp, Zea mays
  Clone ID: LIB3062-033-Q1-K1-A10
gaagaaagggagctgaagcggaagcaagcccgcgtcagagccacgttcgtgcaggacctgctgctctctactctattcggcgactgatgacgaaccagagcgagcctaagctattatcactggaagggtggaggtccacgaagaccagcgcggcggtccagaacacctctagtaaggtgcagagttgatgtgggcgtaatgtatctttctaagttattgtaagccggtctcttgtcttcacaactgacgatctgtgtgtggtacgctacgcacgcaagtcgcggttgtgcgtgtacgtctgaactctggagcattggtttgttgtacca

SEQ ID NO: 40479 - DNA, 120 bp, Zea mays
  Clone ID: LIB3062-033-Q1-K1-A11
caataatcgatccttataataacctttctcataacacagacaagtacgtacattacgcgatggttaaaacaaaagttggcgactaatcaccatatacagcgagcctaataccattatcac

SEQ ID NO: 40480 - DNA, 401 bp, Zea mays
  Clone ID: LIB3062-033-Q1-K1-A12
gaatcattctctgctttcaatagcgtctataacaattcgggcctttttggaatttatgcagggactagcccagacttttcatcgaaggctgtggatttggcagcaggggaactcctggagattgcgacacctggaaaagttacacaagaacaacttgatcgtgctaaagaggcaaccaaatctgcagttctgatgaacttggaatcaaggtctatagcatctgaagatattggaagacaggttcttacttatggggaaaggaagcccatcgagtatttcctgaaaacagttgaagagatcactttgaatgacattttgtcaaccgcaaaagagatgatgtctacaccactcacaatggcatcgtgggggcgccgttattcatgttcctagctacgagtctg

SEQ ID NO: 40481 - DNA, 450 bp, Zea mays
  Clone ID: LIB3062-033-Q1-K1-A2
acgcgagaaacacttggagtggcgtactgaagcgcctttttatacattgggtcctttgacaactgatatggcacctggttatgatcacatcacttaaaccatcggtgctgccaacattacagctcttggcactgaactttactgctatgtaacaccaaaggaccaccttggttagcccaatcgtgatgatgtcaagactggtgtaatatgctacaaaatttctactcatgctgactattatgcaaacgtgtatccatatgcacatgctctacatgatgctctttgcatggcaagggatgagtgaagaatgctcgaccaacttgcttcatctatggatccatgaactgctatagactttcatgatgaagcattgccctctcatggtgccaaagttgcacatttctgctcaatgtgtggacccaagttctgttcaatgaaaattactgagga

SEQ ID NO: 40482 - DNA, 204 bp, Zea mays
  Clone ID: LIB3062-033-Q1-K1-A3
gaattccgacccacgcgtacgcgcacgccagttgtacccgtgtctctaaactagtatctacaggttcagtcattcatcaacgtatagggcaatataatcccgaaccatgcgttcatacattcgaccagcaaccctcatagcatttaccactacaattcctatttctttaacgaccaaagagaactcttggactacgaatcaaca

SEQ ID NO: 40483 - DNA, 453 bp, Zea mays
  Clone ID: LIB3062-033-Q1-K1-A4
acgcatgcgttggtggttggagactacaaaggggcagttaaccagtgtcttgcttctaatcgtatggctgatgctttggttatagcccatgccggtggttctgctctctgggaaagcacaagaaaccattatctcaagaacagtatctcgccctacttaaaggttgtctctgctatggtgggcaatgatttaatgagttttgtgagtacctggccactaagttcatggaaggaaactcttgctctgctttgcacatttgcacagaaagaggagtggcatattttgtgtgacacacttgcgtctaagcttctgaatgtcggtgatacactagctgcgaccctctgttatatttgtgctggaaatattgacaaagcttgtgaaatatggtcccgcaccttgaaatctgaagatggtgggaagacttatgttgatcttctccaggatttgatggaa

SEQ ID NO: 40484 - DNA, 359 bp, Zea mays
  unsure at all n locations
  Clone ID: LIB3062-033-Q1-K1-A5
ccgatccctaccttcattaggagagagagaggagaggagaggagaggaggggcacggagatggagagagcggcccccgtgaggagctcccacacctcgacggctggcctgctcgcgtggcctaaccccgatggcgccgggtcgctgccagcacgccggcctaacaagccaccgaaggattcaagaatgttgtgtttggggggcagcttaccgaaggggccgaccggcttaacaagaccaagaggaagaccggcttcttgcccaaggggaaggagacaacacggaccgggatatccaaagccgaaagcgccgtcgncgtcgtcgcaactgcctnccgtgatcgtcaggctagccagatca

SEQ ID NO: 40485 - DNA, 450 bp, Zea mays
  Clone ID: LIB3062-033-Q1-K1-A6
gtgcaatggggttcgtgctggtggtctctctgcccttcatcttcctctccatcctgctcgggttcggctgctacttcctcggcaagcacaggggccgggaggagatgcggaccggcgtcggcgcgcagatctacggcacgccgctgccgccgcccggcgtcgctggagcctcctcgccgccgcctgagccgttccacagcaagaaacaatggtccgaggctgtgtgactaagatttagacgtctctccatccatccattctactactactacatatatgtcttggtggtgatgttggatttatattcttaattctttcttctttaatttcgccctggctgtcttgagagtgtagattgagagtcaaatctgtgcttgtgtctaaagatggtgtgtgtgtgtggatgttgtgatacgattgcaatcacactttatatcttgggaaatttgg

SEQ ID NO: 40486 - DNA, 309 bp, Zea mays
  Clone ID: LIB3062-033-Q1-K1-A7
gtgcaatggggtacgcgctggtgttctctttgccctgcatcttcctctccatcctgctcggcttcaactgctacttgctcggcaagcacaaggaccagcaggagatgctgaccgccgtccacacccacatctacagaacgcctctgccgccgcccgtcgtcaatagagcctcctcacagacacctgagccgttccacagcaagaaacaatggtccgaggctgtttgactaagatttacacttctctccatacatccattctactactactacatatatgacttggtggtaatcttgaatttatatactt

SEQ ID NO: 40487 - DNA, 380 bp, Zea mays
  Clone ID: LIB3062-033-Q1-K1-A9
caaagctcctgctcgctattccgaggatccttggactcgctgaatagctcccgttgcgactcgctgcagttaaagactgccgtggaacgtgcatattccctgaagcacagccgttcccacacaagaacttcgatgacgaggctgccttcctgaatcgcttattcggtggcctcaagtgcggcggcaatgcttatgtgagtggtgactctgccaagcccgggcagaagtggcacgtctactacaccgctgagcaccctgaggagcctgtcggcactctggagatgtgcatgactgggctggacaagaggaaagcttgtgtcttgctcaagaccactgctgatggttactcgctgagcgccaaggatatcaccaatctctct

SEQ ID NO: 40488 - DNA, 332 bp, Zea mays
  Clone ID: LIB3062-033-Q1-K1-B1
acgccagcgtagagacgtcgcttctacagacatttacatctccaatctcctcaccgacttgaagggtacgactgacagctttctacgctccgtctaagatcatcgtcgatcaccactccatcactcaccgacatctaccatgcgaacatcacttacctggaagagctacttctcccgatcctcatgacacacaacagttgacatgtacttgaatggccataaccactcgccttcacctcgtcagcagcagacacagtactcttcagctaccaaccagcgacggcaattccaatgcatcagctcgcaagttcaaacccaccactcacaaaatc

SEQ ID NO: 40489 - DNA, 204 bp, Zea mays
  Clone ID: LIB3062-033-Q1-K1-B11
caccttcagcttggtctaacgcccgacggggacgggtactgctactggtggatcgacgacaaccaagagaactactacaatatgcacgcgcaccatggctgcgaggactgccgcggccttctcgacggcatactgtccgacttcgacgactactactggagcccagcacggccgatgtccccgcctgctccgtaccgcgtcgtc

SEQ ID NO: 40490 - DNA, 203 bp, Zea mays
  Clone ID: LIB3062-033-Q1-K1-B12
cggaattcccggtcgtgtcgtcgcgtatggcctcgcctatgctctacttttaccccatccctgcacagcgccgctcaccgtcaccggaccagggtagcgatcgatggctgaggtacacatcgagccgcccttgatggtggacgacgttcggcacgcgccggagggccgtgagaacgacctcgaggccatcgagctcgcgcgct

SEQ ID NO: 40491 - DNA, 440 bp, Zea mays
  Clone ID: LIB3062-033-Q1-K1-B2
ggagatcgacggctgcttgccgcactcgctccagctgccagccggccacaggcaactatgggcgccggtgccgccgccgcggggcctgctacctttctcccgcgcctcccctcgccacggtctccgtctcctatgctccctcctctcggacggagagcccatcccgtcgccgctccgctctgtctctccgccaagcgccgcgcctgcgccgccatgggctccagctcctcctccaactcaggaaatcaaacgtcactgatgctgccgttcagctttacattcgatgaagattcttctagttccagaaggctatatagatggaaaagggtattgctcaaagtaagtggggaagctcttgccgggaatcacacagaaaacatcgacccaaagattacaatggctattgcaagagaagttgcttctgtcaccaaactaggtgt

SEQ ID NO: 40492 - DNA, 254 bp, Zea mays
  unsure at all n locations
  Clone ID: LIB3062-032-Q1-K1-H5
acantatggtccgttttcctagaggtaatgggtaatggaagactcttcaccttgatacggattgctactcatgaaggggtgaanctgttacccacataacccatatactcaacttagtctactatgcatcaaacaatgagcttgtgaggacacaaacccttattaagaagtccatgtgacaagttgatgctgacccattcaagcagtggtacctcactcactatggagttgacattaataggaataataaaacc

SEQ ID NO: 40493 - DNA, 427 bp, Zea mays
  Clone ID: LIB3062-032-Q1-K1-F8
ctcacgaccacgaaccaaccgacagaaagagggacgaatggcgagctctcagtgctgcgataacccgccgggcctgaacccggcctgcggggagggcaaggtcgtcgacagcttcggcgggttcaaggcctacgtcgccggccccgaggactccaaggccgccgtcgtcctcgtcgccgacgtcttcggattctaagcgccgattatgaggaagatagccgacaaggttgcttcgtcagggtactttgttgtgataccagatttgtttcatggggatccttatgcacctgagaatgttgagaagccctttactgtgtggataaagtcacatactccggagaaagggtttgaagagacaaaacaagttattggggctctaaaggagaaaggagtgtctgctggtggagcttcaagggattgctggggt

SEQ ID NO: 40494 - DNA, 407 bp, Zea mays
  Clone ID: LIB3062-032-Q1-K1-F9
aatcgaccgatgcataggcgcataactccgttgactaagctttcctgctgtacggataatcatacgacgttatggcctaggtaaacgggaagtacttgacgtgatggcaatcatggtttctggaaaaagcactgtgctgaagatcatctctgaactcttaccttatcccctctttgatattgacaaatctgtggtgacagctacacacatgcacttgagccgatgatatattctacgcctacagataagccctctgtaatgatactcttagaatcttcttcacttatctgcatttcatgctacaattagcagttgccaccagatgcactcatgacatgctaactgctaacttcttatatatgaccattggcctatacgattatgtcgatgataccttgtatactctt

SEQ ID NO: 40495 - DNA, 463 bp, Zea mays
  Clone ID: LIB3062-032-Q1-K1-G10
ctgtcgagtacaagaacattagtttcactgtttgggatgtcggtggtcaggacaagatccggcccctggggaggcagtacttccagaacaggccaagcctcatttttgttgtagacagcaacgacagagagcgtgttgttgaggccagagatgagctccatcggatgctgaatgaggacgagctccatgatgctgtgcttttggtgtttgcaaacaagcaagatctgcctaatgccatgaacgctgctgaaatcaccgataagcttggcctgcactccctgcgccagcggcactggtacatccagagcacatgtgctacctctggtgagggtttgtatgacgggcttgactggctttcgaacaacatcgctaacaaggctcgaagcatctaggcatggcttcaatcagtggaagcaaactgcctctaccattacagctatgaagtatatagtcgtgactgtgt

SEQ ID NO: 40496 - DNA, 438 bp, Zea mays
  Clone ID: LIB3062-032-Q1-K1-G11
gaataagtgagatagagaggtttgactgttccaacttccccacgagaattgcaggagagatgaaatccttttccggtgatggttgggttgtacctaaacttgcaaagcggatggacaagtttatgctatatctgataactgctggaaagaaagcattagaaaatggtggactcactgaagaactgaggaacgagttggacaaaaccaggtgcggggtcctcattggttctgcaatgggcggcatgaaggtttttaatgatgcaattgaagcactgagggtctcttacaagaaaatgaacccattttgtgttccttttgcaactaccaatatgggctctgcaatccttgcaatggatctgggatggatgggaccaaattattctatttccacagcctgtgctaccagtaacttctgtatccttaacgcagcaaaccaca

SEQ ID NO: 40497 - DNA, 446 bp, Zea mays
  Clone ID: LIB3062-032-Q1-K1-G12
tgtccatgtttcaatatgttccatcccttgtgattattgacagatgggtggttgagaatcaggttggcaagaagacccttgctattgatgattgtgattccagacaatctgtctatgtgtatggatgcaaggattctgtccttcaagtaaacggcaaggttaacaatatcactgttgacaaatgcactaagtttggaattgtattcaaggatgttgtagcagcttttgagattgtcaactgcaatggcgttgaggtccaatgtcagggtacgtcaccgacaatatcaatcgacaacacatctggatgtcaattatacttaagcaaagattcgctgggagcttcaattacttctgccaaatctagcgaaatcaatgtgatggttccaagtggtggcgctgatggtgattgggtggagcatgcattgccctaacagtacatccatagt

SEQ ID NO: 40498 - DNA, 286 bp, Zea mays
  Clone ID: LIB3062-032-Q1-K1-G2
aacaataactggtataagtgatatggatcctttaaggtggaaaaactcccaatggcggaatggtcacgttgcatgggatgaagcagcaccaagtgagagacgcaccatggtttgcctttgggaggttgaacctgttatcgctccattcttcatttatccctcgccattgttcactgcaaaacgtccgaggcaacctggggtaacagatgatgatagctcagaaatggacaatctttttaagcggaccatgccatggtttggtgaggaggttggcaagagagatctg

SEQ ID NO: 40499 - DNA, 346 bp, Zea mays
  Clone ID: LIB3062-032-Q1-K1-G4
ctaacttcccggccgccgctttccttgccctcgatccacagctcgcgccgttcctgcaagggcgcacccatcgggccgggtacgcactgccgcccaacgatctacgagctgccatggctaactcagcggcaccgggaggaatgaggtcgttcctgcaggccgtgtctacggtcaccgaggaggcgccgacgccactccgcgtcgtccagatggagggcctggctgtactgaagatcatcaagcactgtgaggagtttgcgccagctttagttacaggtcaattgcttggtttggatgttggtagtgttctggaagtgaccaactgttttgcgttccctatcaggga

SEQ ID NO: 40500 - DNA, 333 bp, Zea mays
  unsure at all n locations
  Clone ID: LIB3062-032-Q1-K1-G5
gcgtcggacnctacctccctccctctcccctctctccggcacaggcaatttagccctcgattcgaccccgagtcttgcgcccactaccgggattgcctgcgccaagcgcggatctgaacgctgcgatccaagtagtcgctcgaatccgccatgaaagaggccaaatccaatggcgccgacaaggccgatgccaagctggcggcgaagagcaaggtggcagacaagcccgccaagggcaagaaggggaaggacggcaaggaccccaacaagcctaatagggctcccagcgctttcttcgagttcattgatgaatttcacaaggagttcaaggag

SEQ ID NO: 40501 - DNA, 314 bp, Zea mays
  Clone ID: LIB3062-032-Q1-K1-G6
actgaaaaaggaggacgatgaggacgaccgtacataagtattgtagtaaaaagaaatggtacggtatgttttgacgggtgcctacattgcattgaaggcatacgagcccttacaaacgagcatgatgaaattaatcgctggtctgcttgtacacaacgtcaatttacgttctactgataatctgactgccaatttcgttgacttcataccaaagtgaaaattagtaccgagatgcttgttactggggttctgttcttttcaaatctttataccttatatcctattgtacttctatacctcgtattaataatcta

SEQ ID NO: 40502 - DNA, 253 bp, Zea mays
  Clone ID: LIB3062-032-Q1-K1-G7
gaagaacacagggcacacgcactacacgcactgcacgcagatacatatagagagaggttaggtatagctggcacgggtatttaactaactaactaactggctagctagctagatccgcatagcaaagctaaagcagcaagaagcaaagcaatggagaacactgcgagtgtgctagatctaccagcgcagttcaccaaactcaccttcggaaacctgtacatccgccgggccgggccgggcagcagggagataa

SEQ ID NO: 40503 - DNA, 400 bp, Zea mays
  Clone ID: LIB3062-032-Q1-K1-H1
gacgaggatatccgactactcctggccaacggtatccgccagctggatactcccaaggcggagcggaccgttcaccctctcagggttacccacatggcgagcgatatcctacacctgctcaaggttactcccagggtcaaggcggtgcatatcctacccctggataattccctgcacaaggttgctacaccccagcagatggctcctacccagcacaaggttcctaccacccagcacagggctactacccagcacaaggttacgattgaccagcacagcgatcctacccagcacaacgttcatatcctacacccccagcacaagggtcagttcccccatcacagggcttgtacccatcacaaagattctaccccacacaggcttaccctggcaagttaag

SEQ ID NO: 40504 - DNA, 474 bp, Zea mays
  Clone ID: LIB3062-032-Q1-K1-H10
tgcccggatcgacggacgcgtccggagaaaggtgttcttcacaaatagtgggtcagaagcaaatgactcacaggttggactagtgtggtattataatagggcactgcgaacgccacacaagaacaaatttattgctcgctcaaaatcgtaccatggatcaaccttgattgcagctagtctatcaggtctgccagcgcttcatcagaagtttgatctaccagcaccttttgtcctgcacacagactgccctcactactggcgattccgtcttcctgatgagacagacgaacagttttgaactagacttgccaataattcggagaatcttgtcctcaaacaaggacctgaaacaattgctgctttcattgctgaacctgtgatggacgctggtggtgttatccttactccaaaaacctattttgagaagattcaggcagttctgaagaagtatgacatcttggtaattgcggatga

SEQ ID NO: 40505 - DNA, 437 bp, Zea mays
  Clone ID: LIB3062-032-Q1-K1-H11
aggctcagtcgttgactaccgcgaggacattggatcaggcagatctttatttgatgcaaacatgggcctatgcgagcagcctgcggagttcgagttttacgatccgaaaacaccattcttcacttcccctcggtacttgccaccaacgaactcctataagtgcaagattaaagacgcgatcatttcacacggctgcttcttgcgtgagtgtgccatcgaccactctattgttggtgttcgctcacgcctaaactctggatgcgagctcaagaataccatgatgatgggtgcggattcgtatgagaccgaatacgagatctcaaggctactggcagagggcaaggtgcccattggcgtatgggagaacacgaagataagcaactgcatcatcgacatgaatgccacggttggaaggaacgtctccataacaaacaaag

SEQ ID NO: 40506 - DNA, 434 bp, Zea mays
  Clone ID: LIB3062-032-Q1-K1-H12
cgacggacgcgtccggatggatactatatccatggccagcgggcaatcatcatgtgtgatgtaacctggaagcttgcttacaagaatgggggtacgtggcataaggacctgtgcagggtctgtgaaaacatccacattgcactctgcggtaataaggttcatgtgaagaacaggcaggccaaagccaagcaggttactttccacaggaagaagaatctgcagtactatgaaatttctgccaagagcaactacaactctgagaaacctttcctgtacctagcaaggaagctggctggtgatccgaaccttcactttgctgaagctgatgctcttaagcctacggaagttaccatcgacatggctatgcagcagcagcatgaagctgagcttgctgcagcagctgcacaacctcttgctgatgacgatgatgatct

SEQ ID NO: 40507 - DNA, 268 bp, Zea mays
  unsure at all n locations
  Clone ID: LIB3062-032-Q1-K1-H2
gactcggacgcccacgcgtccgccagactaccccctggctgcaggctcctgcaactgcaatgtcagcactgggnaggctctccggcaggggcgacagtgtctccggcctcatccgcctccgccgtcagatggcccccgcgctcgcggcgccgtcgcaccacgccgctgggacgttgaactgcgccgccttgcccgatgccgccccgctcgtctggggacgccagctccgcccgtcgctcctcctccccggcacactgctcccgtcgtc

SEQ ID NO: 40508 - DNA, 215 bp, Zea mays
  Clone ID: LIB3062-032-Q1-K1-H3
acggacgcgtccaccctctctcgcttaccaaagagcttccactacacaatcctcccaccatctctcaatgtgctggctcccgaccttggcgcagcatacccacaccatatacagatccactattcaaaaaaactactacctcaccaccatcgaccttaattcattcctatttcgcaccaacagttaccaaaacatacatcactggatctcataca

SEQ ID NO: 40509 - DNA, 253 bp, Zea mays
  unsure at all n locations
  Clone ID: LIB3062-032-Q1-K1-F7
cactgacttgatgcnctgtagcttgcggtcttcatagatcaccagtaccttccaggggaggggcctaaacgagggcaccgttggccaatactagtcacacatggcgttcacaatgcctgacctgtaccgcgttgtccacagcattgatctgttctatacaaagttcaacatcttagattactgtcacggacctgtccatctacttcccgtacaccgagtcgcacaagacgctgtcatcccttcaccctgagat

SEQ ID NO: 40510 - DNA, 174 bp, Zea mays
  Clone ID: LIB3062-028-Q1-K1-E5
acaacaaaaatgaccatactcttcctcatcactacaaccactactacattacaactcttgactaactctccctacaatacatattcaatagctacataaatgctgatcattatcacaatcacaagcaccaccacataaacatctaagccatcccctactacaacattgaccttt

SEQ ID NO: 40511 - DNA, 447 bp, Zea mays
  Clone ID: LIB3062-028-Q1-K1-E6
ccagaagcgaaggcggaggcggaggagcggaggtaggagatctcgagcaagccggaggcagaggagatgaaggcgttcgacccgtggccggtcttcttccgccgggagtggaagcgcaactggcccttcctcacgggtttcgccatcaccggattcatcatcacgaagatgacggccaacttcaccgaggaggatctcaagaactctaagttcgtccaggaacacaagaagaagcactgacgaaccaggtgaaggagttgtcagaaacgcatgtttggccagccagttctgttatgcttttgaatgaaaaatttagacccttctttctcgtttccttaatcgaaatgcttgcactctatgttccatttgtaatgtaataagaggcatatggattgaaccaacaacaatcaacttctgattgaaaatatcgatgtgtggcctgaatgt

SEQ ID NO: 40512 - DNA, 414 bp, Zea mays
  Clone ID: LIB3062-028-Q1-K1-E7
cggacgcgtgggtgaaattacagaagccacaagggaacaggtcacaatcatccatggagatctaagtgccttccagaaggaaatggaaacagttcatcttgtagttcgtagtctggaggcaaagcttggacgcctagcttatactcaagatcggacaacacgaggaatatatgatttgtgtgaattcactaaaagattggatcagagcccgaaagctgagactcatcaggttacatcatcaactcctcgccctgctattgaatcctcagagagaattgctagggctggttctttgcccccagctttggaaccagagtctcctagaatagaggcgcctaaggttgtgcgctcatctacaatcatgtcagcatcgggacttaatttgctagcttgaactacaacaccaactaaaag

SEQ ID NO: 40513 - DNA, 416 bp, Zea mays
  Clone ID: LIB3062-028-Q1-K1-E8
cggacgcgtggctgaaattacagaagtcacacgggaacaggtcacaatcatcgatggagatctaagtgccttcgagaaggaaatggaaacagttcatcttgtagttcgtagtctggaggcaaagcttggacgcctagcttatactcaagatcggacaacacgaggaatatatgatttgtgtgaattcactaaaagattggatcagagcccgaaagctgagactcatcaggttacatcatcaactcctcgccctgctattgaatcctcagagagaattgctagggctggttctttgcccccagctttggaaccagagtctcctagaatagaggcgcctaaggttgtgcgctcatctacaatcatgtcagcatcgggacttagtttgctagctggaactacaacaccacctaaaagag

SEQ ID NO: 40514 - DNA, 279 bp, Zea mays
  Clone ID: LIB3062-028-Q1-K1-E9
atgtcacacacacacacacagacaagtgggttccaaagccaagtgtgtgtactatcaggcaggtatctcgggcgggaggaggcagccatcatgtcagaggagaagcaccaccacttcttcaaccaccacaagaaggacgaggagcatcccgccggcgagtacgggtactccgagaccgaggtggtcaccgtcaccagcgagggcgagtacgagaggtacaagacggaggagaaggagcacaagcacaagcagcacctcagcgaggccggcgccatcttc

SEQ ID NO: 40515 - DNA, 336 bp, Zea mays
  Clone ID: LIB3062-028-Q1-K1-F1
gcgcggacgcgtgggtgaaattacttaagctcacagggaacaggtcacaatcatgcatgtgtatctaagtgccttccagaaggaaatggaaacagttcatcttgtagttcgtagtctggaggcaaagcttggacgcctagcttatactcaagatcggacaacacgaggaatatatgatttgtgtgaattcactaaaagattggatcagagcccgaaagctgagactcatcaggttacatcatcaactcctcgccctgctattgaatcctcagagagaattgctagggctggttctttgcccccagctttggaaccagagtcttctaaaataaaagc

SEQ ID NO: 40516 - DNA, 241 bp, Zea mays
  unsure at all n locations
  Clone ID: LIB3062-028-Q1-K1-F10
cccactcgtccggcccaagacgatccttatctactacttggacaagttgcccagaaggtcgttcctttcnctaagggggatcggctgcgacaaggcaggcaaaaatggcggcaaaggctgcaagctcgcaagggtttttgagcataacgaaaagccggcaaggacggcaactcctcactcggcagccatcagcggcttgccgttcttgcaggggaacccatctgcgctctcgcggtcactg

SEQ ID NO: 40517 - DNA, 256 bp, Zea mays
  Clone ID: LIB3062-028-Q1-K1-F12
gtgcgcgacacctgccgcgagatcgggttcacctccgacgacgtgggcctcgacgcggaccgctgcaaggtgctggtgaacatcgagcagcagtcccccgacatcgctcatggcgtgcacgggcacttcacgaagcggcccgaggagatcggcgcgggcgaccagggccacatgttcgggtacgccaccgacgagacccccgagctgatgccgctcagccacgtgctggccaccaagctgggcgcgcgcctcaccg

SEQ ID NO: 40518 - DNA, 433 bp, Zea mays
  Clone ID: LIB3062-028-Q1-K1-F2
cgcgttcagcaaccgctcccgtggacacggcaaggcagggccgggcctctgcgcacggcatccggccggctacagcccggagccgtggccatggcggcggccagccccgcccctagtcgacctcggctctccggtgagctgccctccatatcctggccgctcagtcgttcgccgcgccgatcgcccaggaagatctgcgatgctctcgtcgttgccgaggttggtggccgagtgaggctccctcttctccctttatccctcttcctctctggctgctccctccctccccacaggttcttccccggcgagtagccctgtctgccccctgccaagcagttcgtctcctcccggcgagcccctgcgcggctccccttccctccgatgtgtggccccagcgcatggccatggccgagtccctgcagtcgtgccccct

SEQ ID NO: 40519 - DNA, 306 bp, Zea mays
  Clone ID: LIB3062-028-Q1-K1-F3
cagaggattggtagagatcccgattcaatttcaagagcatatatcaaaacattttgtaaaaattctagaaaactgagggtttctaggtatcggaggtttgaggaggaatttagctctccgcttgtctctgagattcacaggtatttcaccgatgaagactacagttacgcaacgaacttctatattctactacatgctgttgatcgattggctgccaattatagcacattgcctggaatcttcgacaggctgaagactgttgcggcttcagtggcacgtgagatgggtttgaatggagcatcctta

SEQ ID NO: 40520 - DNA, 415 bp, Zea mays
  Clone ID: LIB3062-028-Q1-K1-F4
ggtgggatgattgccgatggcaagtcgcttttttcaatcaatgggaagcctatcggaccgctttgttgggacttccagcttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagcccgtgcatgaggtacttgctgagatg

SEQ ID NO: 40521 - DNA, 338 bp, Zea mays
  Clone ID: LIB3062-028-Q1-K1-F5
atcaataatcagattcttaacaaattctaaattattgatatatcactttttgaccacggtttttacatttggcaccgggttaccttttctattcttaaaacttattttttttgacctctggaaaactgtattttcaggacattctgccacgtctcttattccaaaggctctacattctttctgtcttttaaatatgactatacttctctaaaatgtggagctcatacaaatcagcaagataaaacagataatcccatcaaaaagtgggtgcagaacatgaatagacaattctcaaaagaagatacacaaaatataagtggtatacgttaactatgtct

SEQ ID NO: 40522 - DNA, 397 bp, Zea mays
  Clone ID: LIB3062-028-Q1-K1-F6
caagaatgggatttggtgattgttaatgctttgactgcagcttgttgcaacttgatggttcttggacttttagcaccatgccgttcatatgcgagtacatctcgatttgacttccaaaatgcaattgagaaacttccgaacaacatatttgagaagagctatcctttgagagagtttgatctagcaaaacgaatcagtgcattcttttataaagctgctgagcttagtctggtcgggtttgtagctggctctgtgcaagggggtatgtcaatagtcttgtccgcaagaaaagaaaggaggttatcggtgactattccctctatcagcaccaatgctcttggttatggagctttcctaggactctatgctaacttgccgtatcaattgctatgttgag

SEQ ID NO: 40523 - DNA, 359 bp, Zea mays
  Clone ID: LIB3062-028-Q1-K1-F7
gtcgaattcctccatctaccgcgccggccgacgaggcccgagggggaggaggatgctgggctccgcgaggaggcagcttggatccggtcccatgctacgacaggttttgcgaaagctccgtccggcagccgcggctgaggtagcgaggggctactccgctgctgcgaacgagatgactgtccatgatgcattgaactctgcactggatgaagagatgtctgctgatccttcaggatttctgatgggagaagaggttatagagtatcaaggtgcataccagatttctaagggctagcttgacaattatggtcccaataggattcttgacacacctattacagaagcctgctatactggca

SEQ ID NO: 40524 - DNA, 343 bp, Zea mays
  Clone ID: LIB3062-028-Q1-K1-G1
cgcagagaatccccaagcaaacaaacagggtagagggagaggagaggagaggagaggagaggttgggtctgggacaccgtggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacc

SEQ ID NO: 40525 - DNA, 376 bp, Zea mays
  Clone ID: LIB3062-028-Q1-K1-G10
gtcctgttcctcacagcagcagccatggcggccgagccggagaagcaggcggccccggcgggacaggagacggccgtgcacatcgtgtacgttgaccgccccgaggacgccgaccctgaggagttccacatccgcaccctcacccccgtcctcggcagcgaacagaatgccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacaacactttgggccttatgtgaaggcgtatgagaatc

SEQ ID NO: 40526 - DNA, 168 bp, Zea mays
  Clone ID: LIB3062-028-Q1-K1-G11
ccattaccgtgttcaacattttgatgaatgaagctgtgactcatgatgtaagagccgcagccaatgggatagcggtagcactaatgtccatctctaaagcggttgctccagctgttgcaggattcatattttcgtgggcccaaaggccttaaacagctgcattttttc

SEQ ID NO: 40527 - DNA, 378 bp, Zea mays
  Clone ID: LIB3062-028-Q1-K1-E4
acaatgcacatcttaaggccatgcttgagaagctccgggctaagcaccccaatgtgaggatcatatatggcgattactacactccagtcgtccagttcatgcttcagcctgagaagtttggttttgccagacaactgcccagggcatgttgtggggcgccatcgactcctgagagagcagcttacaacttcaatgtcacggccaaatgcggtgagcctggtgcaactgcctgtgctgatccgacaacccattggagctgggacggcattcacctgacggaggctgcctaccgccatatcgccaaaggctggctatacgggcctttcgcggaccaaccgatcatccaatcctcatgatcatgccgttcctgctgtagag

SEQ ID NO: 40528 - DNA, 340 bp, Zea mays
  Clone ID: LIB3062-028-Q1-K1-C2
cgagggcgtgcctaacgacgagatcgtctccgacctcaaggttctcgttatcaagcccgtcatcccagacagggtgcggggtctagacgacggtggtgcacctcaacccgtctgggcgcttcgtcatctgcgggccccacggtgactcctgtctcaccggccgcaagatcatcatcgacacctacggcagctggggagcccacctcgttggcgccttcttcggcaaggaccccaccaaggtggaccgtaacggggcctacgtcgccaggcatgacgtcaagagcattgtggccagcgggcttttccgacggttgctcgtgcaggtgtactacgccatcgg

SEQ ID NO: 40529 - DNA, 326 bp, Zea mays
  Clone ID: LIB3062-028-Q1-K1-C3
ctttcagtatgacgactgatcttggaaatgtttgtgataagatctgcagacttgaatgctgagttgccacataatatcgggactacatattatatagtcattcaacgcaaggctatttgattatctaatatcgacggatgacacttaaacaaaggagaagcataccaattaggactatagataagaggcatcattgacccgcaaacggatcaagcaaaccaataaggtgaaccagatagagctaaacgtgtcccgcgaacatttgccacagactttacatgcttaatacggagttgtcagacgaactgactgcaaaaatgcattta

SEQ ID NO: 40530 - DNA, 283 bp, Zea mays
  Clone ID: LIB3062-028-Q1-K1-C5
cgagggcgtcaagcatcactgggcgagcaacttcgccttcctcgactacttcaagagggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcccacctcgtcggcgtcgcgctcaagtactccaaggcgccgcacggcgtcctgctggcgaccggcttcggcacgatcacc

SEQ ID NO: 40531 - DNA, 325 bp, Zea mays
  Clone ID: LIB3062-028-Q1-K1-C6
tcaacacgtaccacaattctacacgcattaatagttcatcagatgtcccttcctacactacttgatcaggttttatttacctgctgagccgctcatcaagtggtccaactccaactttaacaagttcatagcatcctaccacgtctacacaccctagctcacggccctgatctattcgaggtagttcgtgctcgccgcgttcttccacagctcaccctatcttttcacattcacgctaacgttctcctaaacgtctctcgccatgacaatacaacctggcttaagaacaatatcacaatcaccaacgacaatggccgtctctcca

SEQ ID NO: 40532 - DNA, 403 bp, Zea mays
  unsure at all n locations
  Clone ID: LIB3062-028-Q1-K1-C7
gcttgcacagcatacgctcccctcttctatattcccttgtctttacttgcccgataggtcccaaactcgaatcgtgtatggtggtagctcctaaatccttcggcgggcagttaacccccaatcattgatccctcaccagcttgggggcggtttcgctccggttcttgcgcttcggctccaggccatggagcagcggaggtggctcgcagtagccgttttgatgtgcctgctggtgctttgctccgggagagaactgaagaccaaacacgtgcccatatatgacccagtgctggcccggacacttgctgaatatacttctgctgtctatactgctgaccttacccaactgtttacatggacatgtganagatgttgtgacttaacagaggggttcaggtgatag

SEQ ID NO: 40533 - DNA, 409 bp, Zea mays
  unsure at all n locations
  Clone ID: LIB3062-028-Q1-K1-C8
gtaacatatgctggctttgcggtcttcaactgccctataaggggtgactctggtgctgttttacaagagctcgtacaatcttcccatgacttggtcatgatcaccggagaccaagcgttgactgcctgtcatgttgctagccaagtacatatatcttccaaacctgttttgatcttgacacggataaagactggcggttttgagtgggtttcgccagatgaaactgatagagctccatatagtgctgtggacgttgcagtgttatcagaatctcatgacctttgtattaatggggactgttttgaaatgctacaaagtactgaagctgttctccaggttatcccttatgtaaagtttttttcacgtgttgctccagaacaaanagaacttgtactaactacattcaaaa

SEQ ID NO: 40534 - DNA, 250 bp, Zea mays
  Clone ID: LIB3062-028-Q1-K1-D1
aggatttgatttgtttatcacgacggctccaattcctgacttgaatgacaagctcggtgggtttgagcgagttatcaagggagaggacatctgttaagagattgaagaagtcgacactgatgagcattaccagctaaaggccttcataggcattatcgatatcgtgctaaaacaggagccttgagcctggatgcacatgatgacgttaaccacatgccgacggacttttctgtagttggaaaatctatct

SEQ ID NO: 40535 - DNA, 396 bp, Zea mays
  Clone ID: LIB3062-028-Q1-K1-D10
caacaggcttgaatcaaatgataccgccagaaggcctccttccgtaaaggcttctttgtctggctcctttggtcagcgcgctccacaccgtgcatccacaagggattcttccccggtccgaagaacgttaccttccaaacaggacaaggaaggtgaccgtgcgaaatcgccaccgatgaagcaccggagtcggagctctgagcgtgatcatgatttggagagggagcgctcggatcgtgaacgtggcagtggcaggtactacaaggatagggagcctgatcggcatgctcgtgagcacagagaccgcgatcatcgtcggtctgattattcgaacagggatggcgaaacacgaggccgtgaaaggagggacagggattctgaccggagtagacatgc

SEQ ID NO: 40536 - DNA, 140 bp, Zea mays
  Clone ID: LIB3062-028-Q1-K1-D11
tctcacacacactcactcagacaattccttttgaaagcctagtgtgtgtactagcaaccagcttggttgctctgcagcaggcactcatcatgtctcatgagaagcaccttctcttcttcaaccaccacaagttacgacta

SEQ ID NO: 40537 - DNA, 350 bp, Zea mays
  Clone ID: LIB3062-028-Q1-K1-D12
gtgaggacatcagcatctgtgcgtctcttgcacgagaggcaacctaccgtatagtacggccgacatggtgctctgcggcggcctagtcgtgccgtggctcgcggcggcggtggcggtggccgcgctggccatcaccgccgtcccggtcggcgccgatgcctacaagaactacaccgtcggcgatgacaagggctggtacgacggcctcagcctgcccggggtcgactaccatgcgtgggctgacggcaagaacttcagcctcggggatttcctcatcttcaacacggacaagaaccactcggtggtgcagacgcggaacgtgacgctgtacgagagctgcgactacaacg

SEQ ID NO: 40538 - DNA, 408 bp, Zea mays
  Clone ID: LIB3062-028-Q1-K1-D2
ctgaaacaaagcatcttggagactgtcgtttctcagatggttccaataccaccagcagcgaggactctgacgaagatgaattggaagataaacacctgcttccgactacttctgttggtgaagacacaattgtaaaagaaattcacagatgaatttctggtgaagccttgcagtgatttctctatgtattctaaaatctaatgggtttcaatactcattgtgcagcttgtcgttcattatgtatattgtcattgtattttaaaatgtcatgtgctctttctgttgtgctctgaaattttgtgtacatttggtgggtagtctgtatttatggttgagttcatttcacttggtgaatgattgaataggtggatgaatgagagacaataaaaattcttatgtagaagcact

SEQ ID NO: 40539 - DNA, 263 bp, Zea mays
  Clone ID: LIB3062-028-Q1-K1-D4
ccgattcccgtcgacccacgctccggcgtggacgttctcgggaacgaggtgcacgttgcacccaacgtcagtgctgcgggtggtaggcatgcgggctctcgcgcgctcctttgcaccccatcaagccaaggtctcactttcctactcccatcgcgctcgagtctcgtaatgctgtgcccgctcgcaggcttcaaatccctgacgattcatccattccattcattccatacagcacactcacagcaaaacgttcttttaccctc

SEQ ID NO: 40540 - DNA, 274 bp, Zea mays
  Clone ID: LIB3062-028-Q1-K1-D5
gcccgccacctccgcatctacttccgccgccggcgcctcggacacaaccaccaaagaggttcctgtcaaaaggaagatcgagaagaagagggagaaggttctttatcatgagagtgtactgaagcggaatccgtttgtgcagccaatcccatcttatgtgccgggcaagaaggataagaagatacagaatgcagaaattgcacgagacacaggtacgagaaaggtgttcctatggaaaatgaatctgtagtatagaactttgacatctgatctg

SEQ ID NO: 40541 - DNA, 383 bp, Zea mays
  Clone ID: LIB3062-028-Q1-K1-D6
agcagaactctctcgacctcatcggcgttggcggagcgcgtgttgaccggagatggggccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaaggggttggcaagagtggcaaagccctgcactacaagggaagtaagttccacagaatcatccccagcttcatgc

SEQ ID NO: 40542 - DNA, 220 bp, Zea mays
  unsure at all n locations
  Clone ID: LIB3062-028-Q1-K1-D7
agcttttccaagaaacctagctagctagctagtaagaggcacaggccggcaccatggggcaccaccattcccaccacaattctcattctcacaaccgtacccaccaccactctcactctcactccggaggaggtggaggcggcngcngcngtggcgccggcggtggaagcagaagcggagtggctaaatgccactgtgattgctcacaccatgatcattc

SEQ ID NO: 40543 - DNA, 394 bp, Zea mays
  Clone ID: LIB3062-028-Q1-K1-D8
gcaagctaaggagagtgtgatcaccaacagctagtgctagtcccccttccttgcatgcatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctaccttgagtcgcaggagacggcggcccaggcagactgtcagcagcgcggcgtggcgctcctgagcgagaccattgtcacacc

SEQ ID NO: 40544 - DNA, 387 bp, Zea mays
  Clone ID: LIB3062-028-Q1-K1-E1
caggagcattcgagaagccgaagaaaattcgaagacgaggagcagctacactgcgggcggagttcgggcatggagggccagttccaggatggcaaggaggaggtcatccaagcatggtacatggatgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggcttaagataagaatttcttttgagaacacttgcatactgatgaagagata

SEQ ID NO: 40545 - DNA, 168 bp, Zea mays
  Clone ID: LIB3062-028-Q1-K1-E10
gtcacacacactctcacaaacaagttttttccaaagccaagtctatctactaccaggcagctatctcacgcgggaggaagctgccatcatctccgaccataaccaccaccacttcttcaaccaccacatcaatgacctgcatcataccgccgtccagctcctctactc

SEQ ID NO: 40546 - DNA, 342 bp, Zea mays
  Clone ID: LIB3062-028-Q1-K1-E11
gtgattttgtcacgtctgaggacaaggaaggtttgattgctaagcttcaggaggttggggggtggctctatgaaggtggcgaggatgaaactaagggggtttatattgctaagctagaagaacttaaaaaagttggtgatcctattgagctgcgcttcaaggaatgggagattagaagttctgctgttagccaactggtatactgcatcaatagcttcagagaagctgcacagtctaccgaccagaagtttgaacacatagacatgtcagaaaagcgaaaggtcattaatgagtgttcggaaacagagacttggctatagagaaaagcagcagcaggatgct

SEQ ID NO: 40547 - DNA, 150 bp, Zea mays
  Clone ID: LIB3062-028-Q1-K1-E3
tcgattcccgggtattacaaatgggcaattggtgatgagctgcgaggagctagctttgcagatcgcagtgttgcttgggcggcgcatttcgggcggagacaccacactgctacactgaggcctgagccatggccactgacaccaaagcgg

SEQ ID NO: 40548 - DNA, 244 bp, Zea mays
  Clone ID: LIB3062-028-Q1-K1-C10
ggagttatgacagtgctgatcccgaggtacaccaccatccccaccaagaaggagcaggtgttgtccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcattctgaacgtgt

SEQ ID NO: 40549 - DNA, 312 bp, Zea mays
  Clone ID: LIB3062-028-Q1-K1-A12
ctttaatgggagcgtttagaagtgacgcacatgttggcacttggagttatcctcccacgatgcttgattgcagtgactggtgtcttcctggagtccctgatgcttggaatgaacttgtgttttcgtatcttttgacaaatggttggcgaaacatgccgggctgaaatttatggcagcattgctcaatctacccccactttttgtattttgatatttgacattaccaggtatactagagaattaacatactcccggtacatgagacagctgcatctgctgtaggtacggtggttcactagacttctgcattct

SEQ ID NO: 40550 - DNA, 393 bp, Zea mays
  Clone ID: LIB3062-028-Q1-K1-A2
gttcgagaagtttggcatgtctccatccaaaggagttttgttctatggtcctcctgggtgcggtaagaccttgttggcaaaggcaattgccaacgagtgccaggctaacttcatcagtgtcaagggtcctgagttgcttaccatgtggtttggtgagagcgaagccaacgtccgtgaaatttttgacaaggctcgtcaatctgctccttgtgtcctcttctttgatgagcttgactcaattgctactcagagaggaagcagtgtgggtgatgctggaagtgcggctgatagagtgcttaatcagctactgacagaaatggatggcatgaatgccaagaaaactgtgtttattattggagctacaaacaggcctgacatcattgaccctgctct

SEQ ID NO: 40551 - DNA, 401 bp, Zea mays
  Clone ID: LIB3062-028-Q1-K1-A3
cgttgcgagcagtgttggtgttggcgacaaacatgatgctgagtgggtacactctattgtggcggacgctggtgcagctaatgataattcttggatcctacttccatacctttgtgctgcattcatggtgtccaacatttggaacggtgctgtttatgatgtcaatataggtggactcagtaacaatttgcactgcctagcaaggtgtgtaagtgctgtgattgggggaagcgaatacactcgggtcgaaagggagcagcgaataaattctctttcaaatgtgcatacagatgagctgcaagaggccgagttaccgagccgtgtctcagcagaagcaaatatcaaatcttgtatgcagatctacgtcaaactgtctgcagggatcgtcctggattcatgga

SEQ ID NO: 40552 - DNA, 384 bp, Zea mays
  Clone ID: LIB3062-028-Q1-K1-A4
atgcctgatatgaacatgcatgctgccataccctcagaagaagactcatgttttaaggatatgcacacagttaaattgaacaaaggacctggagaagatagtatcaagcgacaattacaagctgttgctgaaggggtagccgcatcagttcttcagccaccctttcctgaaaaaacagtggtgttctctggggatcacatcgattcgcatggagcagaagttgatgtcaagttccaggatgaaaggaacaatcagtcagacaaaataagtcaaggggttcaagttttagatgacaacgataaccttcagataataaagaacagtgaccttgaagaattgcgtgaacttgtttctggaacctttggtactgtttaccatggaaag

SEQ ID NO: 40553 - DNA, 313 bp, Zea mays
  Clone ID: LIB3062-028-Q1-K1-A5
cagcaacgctatcgctctctactcacttccaactcgacgctacgactccagggtcaagtatacctgagcgaggtcaatggaatattccaaagatcccagcatactccataatgatagcctgaactgctaccatcacacctaccaactgctcctcgaaacatgacgccctcagctgtatcggccgatgacttaatcgacatccactatgaagattctgatcttttacatttccagctatactatatcctctacatacacctgggacaagacacaattgcaacggccgtacgcacgatgtttcactagacttctg

SEQ ID NO: 40554 - DNA, 412 bp, Zea mays
  Clone ID: LIB3062-028-Q1-K1-A6
agcgagccgcgcgcattccccgtcccgtgccaccggaccaggggaaggaggacgacacgatgtcgtcgtctctctctccagcggcggcagccgcgcccctggatctggacggcaactccgtcgcgcccctcaccatctgcatgattggcgccggcggcttcatcggctcccacctctgcgagaagctcatggccgagacgcgccatgtcgtcctcgccgtcgacgtatactgcgataagatccgccacctcgtcgaccccgcgccgacgcacctcgcggggcgcatctccttccaccgcctcaacatcaagaatgactccaggctcgagggcctcatcaagatggccgatctgaccatcaacctggcggctatctgcacgccggccgactacaacacgcgccccctcgacac

SEQ ID NO: 40555 - DNA, 393 bp, Zea mays
  Clone ID: LIB3062-028-Q1-K1-A8
gtaactgcgacttgcatacgggttcctgtgatgcgcgcacatgctgaaagtgtcaagctacagtttgaaaagccacttgatgagcgcgtatgctcctcaagtaggccttaatgagaactcaaagagagagttctgggaaggcctggaggacatggttagtagtgtgccagttggcgagaagctcttcataggaggagatctcaatggccatgatactgcaagagaaattttgagagcagctcctggtgttaccattattgatgaccgagcttccaatcgctttcctacacctctggaggtatcagacaaagatgacgtagcagtgggtaggattcgtcaggacttgtccctggatggtaaccgagggttggacatatttgtgtgtggtgatca

SEQ ID NO: 40556 - DNA, 342 bp, Zea mays
  Clone ID: LIB3062-028-Q1-K1-A9
caaatagctattgggaagcaaaccggcttgtaactacgatagggttggaatagagaaggtcagccgttcaaaatgtgaggacaagagatgggtaccaaggaatggaacatcaaaatcttcgtccagtgttcgagatgagaagagccaagagtctccggctagtgctaataggagtggacatggtcatagatcttcatttgagcaaaaccgtgcttcgccagctattccgagcaaagtttcacatgcagcttcaaggatatcctctcaagcatcacctcagcccccgaaggttgaaacaccagttccaaaggtggttttaccttcttaatcacaaaaattccc

SEQ ID NO: 40557 - DNA, 187 bp, Zea mays
  Clone ID: LIB3062-028-Q1-K1-B1
acggacgctcaagactgggaccttcaaagagcaattggactgatggacgttggatacacaggaggggagtttgcatcagcggcactgaccaagggaggtgcggattatgccacacgcaaaccgcttgattgttgcttcgtaaaggccaaggagcgggtgcttgaaaccgacggcaactgtcatgata

SEQ ID NO: 40558 - DNA, 398 bp, Zea mays
  unsure at all n locations
  Clone ID: LIB3062-028-Q1-K1-B10
attgggtccttgacctgcgcacctcgctgggattgacctngttgagtcgacgaactgctctagcccttcttcgaaattctggtggttatcgttgccgacatgtacgatttgctggcatcgttggccggaagccatggatggagactgatttgctgttagttgctgctccatgtccaccatctccttggtttgctgttgttctcttcttgacgtggtcccacgacgcgagccctggctggtgcttcggccttctgtcagttgaggcctatgctgcttctgcaggtccttcttacaccctgcaacactaccgtttggtgtgctgacatggaaattggggcagcaggacagctaggtgtgttggggacgcccttaggaaatcgagtcacactagatgctga

SEQ ID NO: 40559 - DNA, 394 bp, Zea mays
  Clone ID: LIB3062-028-Q1-K1-B12
gccaaccatctaccagcgactcagcgagcgagatcagcacacactgcacgcagctagcgaggagcagcagcagcggcggcgatggcggcctccatgatctcctcgtcagctctggcggtggcgcctcatggcctgccggccctcggccgacgcgcctactacttcgccgtcgtctgctccaagaagaagatcaagaccgacaagccctacgggattgggggtggactgaccgtcgacgtcgacgccaacgggagaaacggcatgggcaagggcgtgtaccagttcgtcgacaagtacggcgcgaacgtcgacggattcagtccaatctacaacgaggatgactggtctaccaccggcgacgtctacgtcggtggaaccactgggcttctgatct

SEQ ID NO: 40560 - DNA, 384 bp, Zea mays
  Clone ID: LIB3062-028-Q1-K1-B3
ccgcgacaaaggttacctttcctttagtttggaccaatacctgctgcagtcaccctgtgtgcggtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagcatgagctcgactacctgctgttcatcgtccgggacgtgaaggtgcaaccgaacccagatgaagtcgctgatgtgaagtacgtgaaccgcgaggagctcaaggagctcatccggaaagctgacgctggcgaggatggggtgaagatctccccctggt

SEQ ID NO: 40561 - DNA, 403 bp, Zea mays
  Clone ID: LIB3062-028-Q1-K1-B4
gccccgcattgaggcatggaacagcgacacccttccgatctacgagcccggcctcggggagggtgtgaagcagtgcaggggcaggaacctcttcttcagcactgatgttgagaagcacgtcgctgaggctgacatcatcttcgtctcggtgaacacccccaccaagacccgtgggcttggagctggcaaggctgccgacctcacctactgggagagcgctgctcgtatgatcgccgatgtctccaagtctgacaagatcgttgtcgagaagtccaccgtccctgtcaagaccgctgaggctattgagaagatcttgacccacaacagcaagggcattaactaccagatcctttgcgacccggagttccttgcagagggcactgctattgaggacctgttcaag

SEQ ID NO: 40562 - DNA, 116 bp, Zea mays
  Clone ID: LIB3062-028-Q1-K1-B5
acaaatgatctattgagcgattatgaaaataagtacttatttatgttacgccgtttggagtttagttgtgttggaattggccatgttatttacaatatgatctatacttaaattga

SEQ ID NO: 40563 - DNA, 139 bp, Zea mays
  Clone ID: LIB3062-028-Q1-K1-B6
acaaatcatctattgagcgattttgattctaagtacttatatattttacgccgtgtgctgtttacatctggtcgaattgcccatcttatccacaatatcatctttactaaacttgatattactcctcatgaacttcctc

SEQ ID NO: 40564 - DNA, 117 bp, Zea mays
  Clone ID: LIB3062-028-Q1-K1-B7
attcccacctcaacctacccgtccaacaaatcatctacttaccaattataattactaattacttatatatcttacacagtcagtattttatcaatggtcgtactccccaacctattt

SEQ ID NO: 40565 - DNA, 379 bp, Zea mays
  Clone ID: LIB3062-028-Q1-K1-B8
ctgcaagtctcgctacgtagcagtgcaataaaaaaaagcagccgcaatggcgagcaggaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctc

SEQ ID NO: 40566 - DNA, 418 bp, Zea mays
  unsure at all n locations
  Clone ID: LIB3062-028-Q1-K1-B9
caagagtatggatgccgcaatgataaatttcaaaaatacgagggctatatatgaggagcttgggaagtatggcagtagagaaaatcaactggtatgccgtcagcgcatcgacgaagtggagcctatgattgatttctgttcacataaactaggtggatcatatttacaagcacatgaactcctggatactgctaatgatcttctcaaggcgaagatggaggctgtattgtctgagacangatcacagcatgcagcttccatgactgagnttaactggctaggtcgaacttttcctattacaaatgcatagacccgtgtctctattttgaaagcccatcagcttgagagagacttgagtgctgcagccacagaatcagttgctgctgacaaaaagcttgctatattggataaaatattt

SEQ ID NO: 40567 - DNA, 319 bp, Zea mays
  Clone ID: LIB3062-028-Q1-K1-C1
acggacgatcacgactgcaaccttcaagcggcactaatcatgacttaggttgcagacagatgcggtgtctattcgatggcggtgctcgccaacccatttacgcactatatgatctgctgactgcacgatgactcctatgttacggccaagtagcagatgattaactactacggcatcttgacttacactctcctttcagcgtactacatgtaaaacagctaccctcacttccataaacggacagagtaccactatcatgacatcctgaacattgaattgccatattgatctaatggctagattgtgacgaatgaccacc

SEQ ID NO: 40568 - DNA, 363 bp, Zea mays
  Clone ID: LIB3062-028-Q1-K1-A11
actaccggctatctacctcgggcggcatcaagcagggatgatctcatacgagaggcagcaccacttattcaaccaccacaagaaggactaggagcagcccgccggcgagtactggtactccgagaccgatgtggtcaccgccaccggcgagggcgagtactagaggtacaagaaggaagagaaggatcacaagcacaagcagcacctcgaccaggccgtcgccatcgccgccggcgccttcgcactctacgagaagcacgatgcgaaaaatgaccccgagcacgcgcacaggcacaagatcacggatgaggtcgcttccgcggctgccgtcggcgcctgcggctacgtattccacgagcacca

SEQ ID NO: 40569 - DNA, 415 bp, Zea mays
  Clone ID: LIB3062-027-Q1-K1-C11
acgcgtcttcatactcgcctacctgcgcagctcaaaccattcccccttctgccaatggccgggggcgctcaatcccgtaacgcgacaccatgacggagtgcattacaatccacatcagccaggccggtatccaggtcggaaacgcgtgctgggagctgcactgccttgagcatggcattcaagctgacggtcagatgcccggtgacaagaccattgggggaggtgatgatgctttcaacaccttcttcagtgagactggtgctcggaagcacgtgccccgtgctgtttatgctgaccttgaacccactgtcatcgatgaggtgagaactggcacctaccgccagctattacaccctgagcagctcatcagtgggaaggaggatgcagccaacaactttgcccgtggtcactacac

SEQ ID NO: 40570 - DNA, 410 bp, Zea mays
  Clone ID: LIB3062-027-Q1-K1-C3
gcaaagccaggaccctcccgggcccggtgaccgatcccagcaagctgcccaagtggaactacgacggctccagcaccggccaggcccccggcgaggacagcgaggtcatcctgtacccgccaggccatcttcaaggacccattcaggaggggcaacaacatccttgtcatgtgcgattgctacaccccagctggcgagccaattcccaccaacaagaggtacagcgccgccaagatcttcagcagccttgaggtcgctgccgaggagccctggtatggtatcgagcaggagtacaccctccttcagaaggacaccaactggcccctcgggtggcctattggcggcttccctggccctcagggtccttactactgtggaatcggcgcggagaaatcgttcgggcgtgacat

SEQ ID NO: 40571 - DNA, 329 bp, Zea mays
  Clone ID: LIB3062-027-Q1-K1-C4
gaattcccaccggcacctacgcatccttgaccactgtttaacttcattttatttccgcactatatctccctagatcaggctgggaccatctacatactacatggcaactaaaccaattattgactatccagccatttatgaattaagaacaaccaaaacgtattccaaaaaagcaaatctatgcacacggatgagctgactctgatcctaactcaagttcacgagcaatatctcttaaatgtgcataggcatctgtataagatccacaatgtccgtaacgctttaaacgctaactgacattctaacattcacgaaatgtacaaggatct

SEQ ID NO: 40572 - DNA, 327 bp, Zea mays
  Clone ID: LIB3062-027-Q1-K1-C5
ctcttcttcacctcactaacaccagctagcaactctttctctcctgcaataatggccgctcgctcctcctcgtcccagccgcagctggtcgcggcggcggcggtcctggcagcggcgctgctgctgctagggctgcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatga

SEQ ID NO: 40573 - DNA, 284 bp, Zea mays
  Clone ID: LIB3062-027-Q1-K1-C6
cgtgccgtcgtgctccctgacgacgcgtccattctcaagtacatccgcttctaccggggcttgctgctcgtactcaacaaggcgctcgccgacgacgaccgcgtcaagacctgcacatctccaatcgtcagcaactacatctccttctaaccacgcaaatcgctacacacatgatgagctcactcttgtcccaaaactaatagccgaggcacatctttcagaagtccagagccaactatagatgatccagactggccttaactatccaaaggctatcggacatg

SEQ ID NO: 40574 - DNA, 428 bp, Zea mays
  Clone ID: LIB3062-027-Q1-K1-C7
ggaacaaaaaggaagggcgaggaggacagggagccgagcgcaagagctgaggctgggccgcgaaaccccagacctcgcgccgccccttcccctccgcggcgtcgtcctcgcagtccctctccgatccaagatgtataagctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctacaagttgatcctcaggatattgtcatgcttgtcatatcatggc

SEQ ID NO: 40575 - DNA, 432 bp, Zea mays
  Clone ID: LIB3062-027-Q1-K1-C8
aatatttgttccatgtttgactctatcttattacccccttatgttggcaggacaagggctgaaccacctatttactacatgccaactaaaccaattattgacgatccagccattgttgaaatttaacaaggaaaaggtattcgaagaatggaaatctatgcgcagggatgagctgactcggttccaaaagcaagttgaggagcaatatctctcaaatgtggagaggcagctggagaggatccagaatgcccggaacgctcgaaaggcgaacgggcatgctaacatgcaagaaatggacaaggagctggacacacacagggcggagcatggtccgaagactcggcgagttcctgaggagggcggtaatgatgacgacgaatacgcagaggacatggctgcggaagacgaagtgatggatgaagttctgggcat

SEQ ID NO: 40576 - DNA, 332 bp, Zea mays
  Clone ID: LIB3062-027-Q1-K1-D1
ggaacaaaacggaagggcgaggaggacatgaagccaagcccgtcacctgcagctgggacactaaacagataagcttggaccaaggctttccctatgctcaagatattcaaggatgccatgtcagctccaacttgcatcctctacgactgatgactacctatgagagccgccagaagttgatgccagatccgacgcccaaacagcagcagctcctaaagcacgtctagcacactatgaccccctgtaatgagacctgtgaacgaccactggaacctgctaatgggaagcccaaaacgctcgtaccagatggtgtcacggcagaagttatagcg

SEQ ID NO: 40577 - DNA, 409 bp, Zea mays
  Clone ID: LIB3062-027-Q1-K1-D10
gcgaaggcgaccctccctccttcgctccttccgcgccgcctcccggccgtcgccgccgtggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcaaggccgctggcccgttaaatcagccaggttcatcctggatttgctgaagaatgctgagagtaacgctgatgtgaaaggcttggatgtggacaacctctatgtttcacaca

SEQ ID NO: 40578 - DNA, 378 bp, Zea mays
  Clone ID: LIB3062-027-Q1-K1-D11
tcgaggacgcgtgggcttattgatagagaacggaatagagccatttgtaacaatttttcatggggacgtccctcaagcactggaagacaagtacggtggctttttaagcgacaggattgtaaaggattacacagacttcgctaaagtgtgctttgagaacttcggtgacaaggtgaagaattggttgacctttaacgagccacagacatttacaaccttttcgtacggaacgggagtttttgcccctggacggtgctcaccaagagaaaaatgtgctcaacctattgctaactcactcaccgaaccatacattgctggccacaacatccttcgagcccacgctatgacttgtgacctctacaacaagaattacaaggg

SEQ ID NO: 40579 - DNA, 411 bp, Zea mays
  Clone ID: LIB3062-027-Q1-K1-D12
gacgatacccctatacccaaagcgatagctttgaagatagcggaacggcagatctggatgagggactcgctctggcagctaactacacagcacgcaatggccaccacggcgaccgaagcggcccgctcgcgcttctcccctgttcgcgcagccaagttggaagctgtgctgtctattggtgctcatctaatcccacacccaagaaaggctgcaagtggcggagaagatgctttctttgccaatagcgatgctggcggagtatttgccattgcagatggtgtctcgggatgggcagaaaagaatgtcaatccagctctattctctcgagagctcatgagaaacagctctaatttcctcaatgatgaggcggtcagtcatgatcctcagattcttctcatgaaagctcatgct

SEQ ID NO: 40580 - DNA, 398 bp, Zea mays
  Clone ID: LIB3062-027-Q1-K1-D2
gggcgtgcgctgctgggagtacaggtaccagccgtacatcgtccgcctaagggggggcactcgtaccgacaaggcgcgtcctctctgctacaaggccaagcacggatatgatgccttacccgcctccgtttgaacttttgtggcatgaacacgcctgtgctcaaaggtgttgtctatgttaagcctaatctccaaggtgtcacccatctcaagttccataggaacaataggtctgtctctgactatagagctggacgtaaactctgtcgactgagcgatcttaactcctactgactgaatgatgatcgcacctacaactacttagagatcatgctcgtggacaatacctactaagtcatcaaagctgacccgaggatcaactgactatacaaccctgt

SEQ ID NO: 40581 - DNA, 428 bp, Zea mays
  Clone ID: LIB3062-027-Q1-K1-C1
tccgggggtcgccttcacctacctgacaccagctagcaactctttctcttctgcaataatggccgctcgctcctgctggtgccaaccgcagctggtcgcggccgcggcggtcctggcagcggcgctgctgctgctgggtctgagggggccgggacggcatcagcggccgcgagctgccgccaggcgacatcgtcggtggcgccgtgcctagggtacgcgatgggcagcgcggcgtagccctccgcggcgtgctgcatcgaagtgcgctcgctcaacagacgtgcgtcgtcggcggctgaccggcaggccacctgcaactggctcacgagcatgaccggacagttcggctgcggcatcagcatggacaactgatgcgacataacagggacgtgctgcgtctacatgtgcttgcccatcagcccaaccgg

SEQ ID NO: 40582 - DNA, 359 bp, Zea mays
  Clone ID: LIB3062-027-Q1-K1-A5
cgaattccggctacgactcacgcgtacgggctaggtgaaccttacttattgttttttacacggtgcgagtgatcaagggaccgtgctacctaacacgagcacagagtcccaactcatgctattgatcagctctagaaattaaccgtgtaaaatcaaataaactaggttaaccttgattggccaataatctctctgttattatggcctagttgcaaacaaagtgacagaaacattcattccgtggtgaatcatgaagaatgagcgccgactgctttctttaccacctgcgagtgtatcctgctgcacattgtaacagacgtgcatttactgaactaagtttaatactatcaccgttcttg

SEQ ID NO: 40583 - DNA, 425 bp, Zea mays
  Clone ID: LIB3062-027-Q1-K1-A6
acggcaagggcccctgctcaagcgatctgagacgttacggaaatggaatgagcgttgggtcatattggacccgacatcaggaaagatggaatacaaactccggagaaatgaaactgccattctaggggaccattctgtttgacgcctcgagcaccattactttatctcctgtgaactttcaagggatgccaaaatataatggctgctgcttctacatcggaactcctcaaaagaaggattactttctttgtgctgaaactcctggtgctgcgaaatcttgggtatctacattacatgcaactcagttagtcttacgagctcataaagaggcagtaaattctttggctgggaatggctctccagctacattaggcacagttgctactgcagttgctaatgctaatgcaacagccatggaagctacc

SEQ ID NO: 40584 - DNA, 425 bp, Zea mays
  Clone ID: LIB3062-027-Q1-K1-A7
gctccatacaagatccttctcaccgtcacaatatcaatcatcacatcagcgtgcggctatgggctaccttggctcgccccatgcactccgtgccctgctgatgctgtggaggaaatggccctaccattggccgctctgggaattttaagaactttcagtgcccgccgggctattacaatggtcttgcgtcgttgttcttcaacacaaatgatgacgccatccgcaatctattcagcagtggcaccgagaatgagttccacatgtccactctttttgtgttcttcactgcgatttactgccttggccttgtgacatacggtattgctgttccatctggtctcttcatccctgttatacttgctggggctacgtacgggcgcatagtggggacccttcttggtccaatttcagaccttgatcctgga

SEQ ID NO: 40585 - DNA, 173 bp, Zea mays
  Clone ID: LIB3062-027-Q1-K1-A8
gcggcggcggcggcagcgggtacggaggccgtggcggctacacacccggctactgggcagccggaaccggcactactggaagagccacccggacgccatcatctcgagcatcgggtcggttcgggcagcattcttgggttcctttgcgacctgtgcaaaggcttttttgggag

SEQ ID NO: 40586 - DNA, 139 bp, Zea mays
  Clone ID: LIB3062-027-Q1-K1-A9
cggaattcccggcctgacgccacacatcactaacaccatctagcacctctaaatatcttgcaataaaggcacgatcgctcctcctacggccaagggcacatggtcgcggaagcagacgacctggcagcaacactgctgc

SEQ ID NO: 40587 - DNA, 204 bp, Zea mays
  Clone ID: LIB3062-027-Q1-K1-B1
acgcgatctgcgacgcgcagcctacgtacaccgtctcgcggaagctgacgtcatgccggttcggggctgacatccggtacccggcgaagcgcgcgcgcgtctggctcggcaccttcgactagacgcccataccttggcccgctcctacaacgtgagcactcggaccgtgcgccggcctatcaccaggaccaactttcccgggct

SEQ ID NO: 40588 - DNA, 405 bp, Zea mays
  unsure at all n locations
  Clone ID: LIB3062-027-Q1-K1-B10
ctggtttttccaatactacaaaccaagccttgatgggacagccaactcctaccctgtgcagtatggtcatgcagcctgctcctgtttcaaatccatttgggatgcttccagcaatgcctcacatgtccattggaaatggtggatcttcaccttcagttcaatatggaatatcaagtttgccggttgtggagaagcttcttccaagtagatcattgtccatggcgtttcctaggcatttggcacagagaaggataaaactgctgccgagaaaatataatccaatatctgatggcaaggttccattctttgctgatgatgaagaatctccagcaacaccaaaagcagacgctttntttgtccctagagagaacccatagaatctggtaattcgtccaattgagcagt

SEQ ID NO: 40589 - DNA, 379 bp, Zea mays
  Clone ID: LIB3062-027-Q1-K1-B11
ggccgctttgtcattggtggacctcacggcgatgctggcctcactggccgcaagatggtcatggacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgct

SEQ ID NO: 40590 - DNA, 364 bp, Zea mays
  Clone ID: LIB3062-027-Q1-K1-B12
agaattcgctggaggcgcttttttcgaagtcggagagtacacctagtacgaaaaggtcaagctcccacctaggctatgcgtcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctaatggttctcgaggtgaggaatgtgattggggatagaggactggaagttgttgccgatacatgcaagaagctacgaaggctgagaatcgagaggggggacgatgaccccggccaagaagagcatggaggaatctctcagata

SEQ ID NO: 40591 - DNA, 404 bp, Zea mays
  Clone ID: LIB3062-027-Q1-K1-B3
cggacgcgtgggcggacgcgtggggtttccgcgtcggctagtttggacgcatggcggctgggggagagtagagaccacagcgcgcgaggcgaggagaataagctatgggcgcgccgagtgtcagaaatggacgtcggaagaggaggatgcgctccgcgccggcgtgcgcaagcacggcgccggcaaatggcggaccatccagaaggaccccgagttcagcccggtcctctcctaccgctccaacatcgacctcaaggacaaatggaggaatttaagtttcagtgcaagtggactgggatcaagtaaactgcgggttccaaagataactggaccctcatctttcccatcatctagctcgcagcctctgcttcttccagcggcaaacaaatttactgaaactacac

SEQ ID NO: 40592 - DNA, 429 bp, Zea mays
  Clone ID: LIB3062-027-Q1-K1-B4
agagtatagaagcacgtacgaaacagttgctgcctttatatacccagattgcaatggggtttgctgaattgcatgatacttccctaagaatggcagctaaaggtgtgattaagaaaatgttgtagactgggaagaatcacgctcgttcttctataaaaggctacggaggaggatcgcagaagatgttcttgcaaaagaaataaggcagatagtcggtgataaatttacgcaccaattagcaatggagctcatcaaggaatggtaccttgcttctcaggccacaacaggaagcactggatgggatgacgatgatgcttttgttgcctggaaggacagtcctgaaaactacaaggggcatatccaaaagcttagggctcaaaaagtgtctcattcgctctctgatcttgctgactccagttcagatctgca

SEQ ID NO: 40593 - DNA, 314 bp, Zea mays
  Clone ID: LIB3062-027-Q1-K1-B5
cggaattccgcaggccagacagttctcggactcgtactctcacacttggagaatccatctcgtgctagatggaacatctccgggctggaataaacttcagaccgggtctcacgatgctgggagtataagctatgcccgccactaagcacaattctacgtcgcttgacaaacttgcactgcaccacaatctgcacacgactgattatcactcacagcttatcactacttgcaccaacataacgattctcgtgctaaggtacgtattcatcatctacctacagtcattcggagcgactacatccatgaagctccaa

SEQ ID NO: 40594 - DNA, 416 bp, Zea mays
  Clone ID: LIB3062-027-Q1-K1-B6
gcgaccccttggctcgacggcaagcacgtcgtcttcggccaggtcgtccgagggcgtggacgtcgtcaaggccatcgagaaggttggcacccgcaacggctccacctgcaaggtggtacaaagttgcgctgactgcggacagttatgctagatctttcttatctggtttgttcggacgatctccctacatcatcttgcactccaaattgcgtccgatcctttggatctatttacgctccaattgatcttagagctcatcatagaatggtacctttcttttgaagccacaacaggcagcactggatgggatgacgatgatgcttttgttgcctggaaggacagtcctgaaaactacaaggggcatatccaaaagcttaaggctcaaaaagtgtctcattcgctctctgatctttgtg

SEQ ID NO: 40595 - DNA, 360 bp, Zea mays
  unsure at all n locations
  Clone ID: LIB3062-027-Q1-K1-B7
acgcaagagggagatcatacagcttggtgtaccgttatttcaacctaccacagaggatgctaattgtcacacagaaccaatcccccttgtcctgcaggctgtcattgaccaccttgtntcctttggcgtttaataccagaaagcaggaaaccaaatagtgtcgtcatcaacttcttcgatgaggatgaacattcgcagccctacttcaagcctccccatcttgacaaccccatttgcactcttctgctgtctgaaaccacgatggcatttggcaggtcacttgtcactgacagcaacggtaactacaaaggacctctcacactttcactaaagcaagggtccttactagtgatgcgtggg

SEQ ID NO: 40596 - DNA, 427 bp, Zea mays
  Clone ID: LIB3062-027-Q1-K1-B9
atgaagatcacaggattggactatcaaatcgagaagagtggactgttgtcagctgagatatcaggaataacagaggacgggaagaattggagagttgcagctgacattaagaaaagaacttgtggatgtggacagtggcacatctatggaaaaccttgcactcatgctatagctatattcgtgaaacttacaaaccttaacattgaggactttgaggatgactactattcaattgagaggttcataatggcttatcaatttgtggtcgctccgatgggtgacaagactcaatggccaaaatttgaccctgagtttaaaatggttccttcaaagctagaaaggcctgctggtagaccaagaaagaaaagaatcaaggctagtgcaaaagcaagaaaaagacgcccatatcagtgcaaaacgcgttttc

SEQ ID NO: 40597 - DNA, 426 bp, Zea mays
  unsure at all n locations
  Clone ID: LIB3062-027-Q1-K1-A4
gggaaccccacgcaggcgcagctccgggacatcgcggcgcaggagaagctgaccggacccttcgacttcccgcgcttcctcgacctcatgcgcgcccatctcaagcccgagcccccttcgaccgcccgctccgcgacgccttccgcgtcctcgacaaggacggctccggcaccgtcgccgtcgccgacctccgccacgtcctcacctccatcggcgagaagctcgaggcccacgagttcgacgagtggatccgcgaggtcgacgtcgcgcccgacggcaccatccgctacgacgacttcatcctccgcatcgtcgccaaatgatcccgtcccttctccctcgagtctccgattcgccgatccaccgnccccgcgctcttcgtctgtaatgacttcgtctcccgtccgccgtgatttgattttattt

SEQ ID NO: 40598 - DNA, 448 bp, Zea mays
  Clone ID: LIB3062-026-Q1-K1-G6
gcgatctaaagcagtagaagaatcattgggtgttgttacccagaagctacgtgagactattgaagaaaatatatttgttaggagtaaagcaaaagagaagcacatggagtacgaggaagagatgaagtcccaggaggaaatttttcatggtctaattgaggatattcacaaggccacagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccacgaggacaagaagttgaagctcaagaaagaatacatggatctggagctggagctggagaaggagtttgacgcagccctgacg

SEQ ID NO: 40599 - DNA, 406 bp, Zea mays
  Clone ID: LIB3062-026-Q1-K1-G7
gccgcgcgcacacccaccgagagctcgggctttctttctccgttcctccctcgcgcgctcagggtttcacgatggaggccgaggcggcggccaagagggcgcgggagggcggtgaggacgccaccgcgccggtggcggtggccgaggcggcggtcgccggtgctggcgagcaggcggggatctccgccgtcatcccaagatggttctccgagatcagccccatgtggcccggtgaggcgcactccttgaaggtggagaaagtgctgttccaaggcaagtcagactaccaaaatgtgatggtttttcaatccttcacgtacgggaaggtgcttgtcctcgacggagttattcaggtgacagaaaaggatgagtgttcctaccaagagatgattacttaactggccct

SEQ ID NO: 40600 - DNA, 122 bp, Zea mays
  Clone ID: LIB3062-026-Q1-K1-G8
gccaggcgcacacccacaaaaagctttggctttctttatccagtcgttactcgagcgctcagggtaacacgaatgaagcctgagtggatgccaagaggactcattagagcgatctggacaca

SEQ ID NO: 40601 - DNA, 259 bp, Zea mays
  Clone ID: LIB3062-026-Q1-K1-H10
gggcttcacctcgccagacgagctcctcgaggaagagtgctacgacgagcagctgccggagaagaagcgcggtctcaccccagaggaggtgcttctgctggagaggagcttctaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaag

SEQ ID NO: 40602 - DNA, 423 bp, Zea mays
  unsure at all n locations
  Clone ID: LIB3062-026-Q1-K1-H11
ctaatccgagaatagctggagctgttcgttttcccttccaagaagactaaggcgggggcgaggcgagagtacctgttgcgcgcctgaggcggtgcaatgtcgtcttcctgcataccgaccggcctgcggctggacctggacatggtgaaggcggcggcgtcgccggtgggcgcgcactcgtcgccgctgcgcccggcgcactactcgtcgccgtcgtcgacgctgtcgtcggaggcgtccaacgcctcgtcatcgtcggcgacgtcggtgtcgctcaagcgggctcgcgcgccgcggaagcggcccaaccaggcgtacaacgaggccgncgcgctgctcgcgtccatccacccctccgtgttccccgtgaacaagagccccaagacggcgccgncgcgcccgccgcagctctccgtgctggcg

SEQ ID NO: 40603 - DNA, 389 bp, Zea mays
  Clone ID: LIB3062-026-Q1-K1-H2
ttgctgtccgacggacaacagcattcctgtcagggttccttcgacgacccggtccctgtggagcggggcaacagcaagtggatgcgggtggacaacgtgcgtagcgcggtccccctcgtgtccttcctggagcacggaagctgcaacaggacgcggggggcgccggccttgctcataaggtccgtcgtgcaagagccggtcgaggacgaggacatgcagccgggcggcggcgctcgggccacggccacggtcacgacggcggcgtgcggcctgccggccgagccgacggtgcgcctcgttggcccggaagggaggtgcgtggacgtgccttacggttactactacaacggctaccaagtgcagatggggagctgcaagttcaccagcgc

SEQ ID NO: 40604 - DNA, 447 bp, Zea mays
  Clone ID: LIB3062-026-Q1-K1-H3
gaattcccgggctcatggagacaaacgtcagttttgttgactgctttgatgatcctggtccacatggagcaggtagatattctgagcatatgctacctgaaattgtgaagaaagattggagaaagggtgcgcagtggtttacagtgaaacggcagcatgcgattcttattctcgcggacaccctttactatgggaagttcaagcgttactgtaagccaggaaacgaatggcataactgctattcagacgagcactacttgccaaccctctttaacatggttgatccgactggaatctcgaactggtcggtgacgcatgtcgactggtccgaagggaagtggcatcccaaagtctacagggctgcggacacaagcttcgatctgctcaaggacatcgcgtccatcgacgagagcgtccacgttagcagcaacgcgaagcatgtcgcgc

SEQ ID NO: 40605 - DNA, 453 bp, Zea mays
  unsure at all n locations
  Clone ID: LIB3062-026-Q1-K1-H4
gctggctctccgccgccgtccagcagtccttccagggcgccttcgccgccccggtccctgtgcagcggagcaacggcaagtggatgcgggtggacaacgtgcgtagcgcggtccccctcgtgtccttcctggagcacggaagctgcaacaggacgcggggggcgccggccttgctcataaggtccgtcgtgcaagagccggtcgaggacgaggacatgcagccgggcggcggcgctcgggccacggccacggccacgacggcggcgtgcggcctgccggccgagccgacggtgcgcctcgtcggcccggaagggaggtgcgtggacgtgccttacggctactactacaacggcaaccaggtgcagctgtggagctgcaagtncaccagcgccgtgaaccagctctggacgctcaagagggacggcaccatncggtccaacggcaaatgcctga

SEQ ID NO: 40606 - DNA, 368 bp, Zea mays
  Clone ID: LIB3062-026-Q1-K1-H6
gtcgaatcgacaaatgcgtgcgtgtgcgcagggctgtcgtacaacgtcgcctggtggggcggggccgcgttcccgcctgagaggaagcacgggctgctgggcatgattcgctggagaccttcctggacctcggaaactgtaacaggaccgctggggcgccggccttgctcatactgtccatagtgcaacagccgatcgaggacgacgacatgcagccgagcagtagcactcgggccacggacattgtcacgacggcggcgtagcggctgccggacgagccgacggtgcgcctcgtctgcccggaaggtaagtgcgtggacgttccttacggctactactacaacggcaaccaaattcagatgtggagc

SEQ ID NO: 40607 - DNA, 246 bp, Zea mays
  Clone ID: LIB3062-026-Q1-K1-H7
agccggaaagctcctcaacctgcactcctcgccagcaagcttacttcttgaggctccggggagcagcgccggtgctaggccaccaggtcaagcaaagcccttagttccgccgacgtacgaagaagcttgctggcacggctggttcgaccgcgacatggagacaatcgccttcgaatcaaatccagcgccgacccgaactataatcaagcaaaccgacaacctccggactggcagcagacgcagtcg

SEQ ID NO: 40608 - DNA, 376 bp, Zea mays
  Clone ID: LIB3062-026-Q1-K1-H9
ggcgcagagaatccccaagcaaacaaacagggtagagggagaggagaggagaggagaggagaggttgggtctggggcaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgaaggaaggaaaccttgaagaggcaacaatggtggatgtttggat

SEQ ID NO: 40609 - DNA, 334 bp, Zea mays
  Clone ID: LIB3062-027-Q1-K1-A1
agactaggttaaccttgattattggtctttacacggtacaagtgatcaaggaacggggctacaaaacacgaagagagagtgccagttcatgctgatggatcacttcccggaataaaccgatgtaaaataaaataaactaggttaaccttgattggccaataatctctctgtttttatggcctagttgcaaacaaagtgacagaagcattcattccgtggtgaatcatgaagaatgagcgccgactgctttctttaccacctgcgagtgtatcctgctgcacattgtaacagacgtgcatttactgaactaagtttaatactatcaccgttcttg

SEQ ID NO: 40610 - DNA, 338 bp, Zea mays
  Clone ID: LIB3062-027-Q1-K1-A11
ttcgagcacgcgtcagtcgttctttacagtacatagaaatacctcattttgtaagaccgcctgttttccaaccagacatggccactggctccgaacctgaacgctatgtctttaaaaatctgcaaccgacgactaataacatcacacagcgacagattctaatagggccatgactctcgtccagatgacgtatatccaattacacatgccacgctgctgatacgatctacgagaaggcctcggacacgataccgaatgggaccatgtcgaattattgctgcatactgataaatgctgtaattttcctgggcaccttcaccagccgcggcagcggcagc

SEQ ID NO: 40611 - DNA, 364 bp, Zea mays
  Clone ID: LIB3062-027-Q1-K1-A12
gccacgtcgctggaatccatggtggactttgccaccgccagcctcgggaccagccacgtgagggccgcgtcgacggtcgtggggagggagggctcgccgaggcaggagtacaccgtgacaggcgtgaagcgggcgggcggcgggcgcctggtggcctgccacgcggagccgtacgcgtacgccgtgttcgcgtgccacttgacgcagcagacgcgggcgtactcggtgtcgatgctgggcagggacggcacggccgtggacgctgtcgcggtgtgccacgccgacacgttcggctggaaccccaagcacgtcgtctggacccgcggcggctgagagtggtcgccgtttgcatgcactggtcatg

SEQ ID NO: 40612 - DNA, 406 bp, Zea mays
  unsure at all n locations
  Clone ID: LIB3062-027-Q1-K1-A2
gaaggaacttgctgaaatggaggaaatgaggaaaaagatcagtacaatgacagcagatgattactttgagaagtaccctgaactcaggaagaagtttgatgatgaaatccgntaaacgataactggggatattgaagagattggagagaactcttatgatgccatttccatgtccgtgaagaaccaataagtttcctgtggcctgaattgggtggtttccatagcatgtgcacggggtttgggtggaatgcctacagatcgactgtgtcaagctttcttgattccgtagaaacatgttttgtttgacctcatcatagaggatctccccttttatcgtacaaagattgtgatatgttcttagcttctttctacttgaataagaggatttctgcagacccttttcctc

SEQ ID NO: 40613 - DNA, 284 bp, Zea mays
  Clone ID: LIB3062-027-Q1-K1-A3
taagagactgtcagtgcaccgtcgagctattacaatggtcttgcgtcagtgttcttcaacacaaatgatgacgccatccgcaatctattcagcactggcaccgagaatgagttccacatgtccactctatttgtgttcttcactgcgatttactgccttggccttgagacatacggtattgctgttccatctggactcttcatccctgttatacttgctggggctacgtacgggcgcatagtggggacccttcttggtccaatttcagaccttgatcctggact

SEQ ID NO: 40614 - DNA, 381 bp, Zea mays
  Clone ID: LIB3062-026-Q1-K1-G5
gacaaaaccagaccatcaaacaggtgccagtgccctttcgcatccgccgaattggggaccaccttaataatgatcaagcctgacggcttccaaaggggcctaattggtaaaaccataagccgttttaaaaaaaagggtttttacttaaaggccttaaacctgtgaaccttgaaaaggcctttgctgagaagcactacgccgatctcgccttcaagcccttctttcagggcctcgtggactacatcatctctggccctgtggtggccatggtctgggagggcaagagcgtcgtcacaactggccgcaagatcattggcgccaccaaccccctggcttttgagcccggcaccatccgtggcgactttgctgtcgacattggca

SEQ ID NO: 40615 - DNA, 322 bp, Zea mays
  Clone ID: LIB3062-029-Q1-K1-H7
aaaaacaaataacatacaacataaaaacaataaatgctctgaaacacgaaaaatgtacggacagggatcattaactgtcacattctagttcaaggtccatagatgactcccagtcctcgcaaaacaagcagaacgtcaactgatctcgcgtcgttgctggcacaagtgcaccttcttgcattgcctgcattccaaagtctgatccgaactcttccacagatgctaaggttgtatcgacccatactgacattattcatgcaacggacctgatggaagctaccgttccgatcttggatgacttatacgtgccaaatataaaggt

SEQ ID NO: 40616 - DNA, 415 bp, Zea mays
  Clone ID: LIB3062-029-Q1-K1-H8
gattcgacccacgcgtacgcgtccgaagaagagggaagagcaccaaggaccttcggcgcccgttcaggatccacatcttcgggagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcattcagcagcgtaatggtcgcaagagcctgaccaccgttcaaggattgaagaaagcgttcaactacagcaagatcctcaaagatctcaagaaagagttctgctgcaatggtacaatggtccaagacccagaacttggaca

SEQ ID NO: 40617 - DNA, 254 bp, Zea mays
  Clone ID: LIB3062-029-Q1-K1-H9
accggttcggattcccggctggaacacaccgtccagaaacgaacacacattacttcacacactcataccacatggccgggctaattctcgacgacctatacatagacccacctgcaaactctattgcactcgcactatacaatcaattatacattcatctcaatcagataccaactgcctttatccactcttgagccaatctaagactctcattagcagcatgtcatagactacgacacttcacatcacaacta

SEQ ID NO: 40618 - DNA, 382 bp, Zea mays
  Clone ID: LIB3062-030-Q1-K1-A1
atccagctttgccgagaactgcaacaatggtttcggaagaaaccgcatcacctacacggacacgtgtaccggtcaagatctgaagaaataccacaacatggatgccatcaatgacctggtagtgtcaggggtagcgtcaaggagagccaaccacccaagtggacagaccgatgtaatcgtcttctgtagcggcgggttcgagaatccaggcactgcgaaatcagaaggagagctgctttcccagcttgtggactcgctggacttgtcgggagccaaatacacggtcctctatgcgtcccaaccgtctggtttgctggagagcccttcgggcttgccgctgggtaagcatctcgcggagaagaagactaacggcacgaaaact

SEQ ID NO: 40619 - DNA, 387 bp, Zea mays
  Clone ID: LIB3062-030-Q1-K1-A10
ttcatatttgggcctgatgtgagatctgtgtttctcactatgttcctcatcatcgcaggagtggttgtcttgggtgtgttcgtcgcaaggcatctcataaatgatttccccgatagctggggaatctcagtgatggtagtagtggttgtcttcactgtttatgatttgacgctgcttctttgtacctctggtagagatcctggtataatacctcggaatactcatcctcctgaacctgaatccattgatgggatcaatgatacaggtgttcagactccacaacaatttcgtttgcctcgcacaaaggaagttgttgtaaatgggatcagtgtacgggtaaaatactgggatacttgcatgttgtaccgaccacctcgatgctcacac

SEQ ID NO: 40620 - DNA, 393 bp, Zea mays
  unsure at all n locations
  Clone ID: LIB3062-030-Q1-K1-A11
ccaaagccaagtgtgtgtactagcggccagctagctcgggcggcagcaggcagcgatggtgtcggaggagaagcggcagcacttcttcaaccaccacatgaaggacgaggagcagcccgccggcgagtacgggtactccgagaccgacgtggtcaccgccaccggcgagggcgagtacgagaggtacaaganggaggagaaggagcacaagcacaagcagcacctcggcgaggccggcgccatcgccgacggcgccttcgcactctacgagaagcacgaggcgaagaatgaccccgagcacgcgcacaggcacaagatcacggatgaggtcgctgccgctgcggccgtcggcgccggcggctacgtattccacgagcaccacgagaagaagaa

SEQ ID NO: 40621 - DNA, 339 bp, Zea mays
  Clone ID: LIB3062-030-Q1-K1-A12
atcaatgctgtgctcaaaaaagtgggagcctaatgctcacaagataatggaacatcggatgaagtattacaggttgagaaaagagatggatgaaaacatatcccatcgtgatccgcttcgtcaacgttcacatgcgcaggctgcttacgacaaggccaatacgaatgaacaatcgtcaagtcgctcatcaggaggtgcatcttccataagctttcctggacggatgcctcctggcggttttcctagaaggattcccagttgaggtttcccctggggttgcatgccttgaggtttccctggtggtgttcccggtaatgttcatatgagtaaaatgctgaa

SEQ ID NO: 40622 - DNA, 381 bp, Zea mays
  Clone ID: LIB3062-030-Q1-K1-A2
cgatctctgtggtgaagtctcatatgagtctgcttcgaagaaatgtatgtacatggaggtgggtgatctaggcaggtgggagatgctgcgttcactctccctctggttccctgcctgtgaggtactctccccactcatctctgctgggcttgatagctgccctgttctagaggagatctcaattaaagtggagggtgattgcctgacatgtgcacgccctggcccattattcggcctgagtgatcttgcaagtttcccagcgcttgccaagatgaattcgcgatctgagtgaagccagtagcctatcctctaactggacaagccgtccaaatggacctttttttggggaaccaatttaatttccaggtattggatcaacta

SEQ ID NO: 40623 - DNA, 315 bp, Zea mays
  Clone ID: LIB3062-030-Q1-K1-A3
aatttccagccacgcgtacgatgcatttccccagcttcatccaagtgttgatatcaaaacaggtctctctccacttagggggagattgtctaactatgctgactcaagtcctgaattgttaccagagttcttgcaagttgaagcttttgctaagttcagtaatgctattggaaaggtgatagaagcccaacctgacatgccagttgttggagccgtaactctatatctatcgctattgacttttactctacgtgtacatactgaccggcttgattatgatgaccaagtgctctgtgcatgtgtcaagaaactttc

SEQ ID NO: 40624 - DNA, 277 bp, Zea mays
  Clone ID: LIB3062-030-Q1-K1-A4
cctgaattcccgtttctacccactcttcctgactagttctagatctctagcatcctcccttttttttatctttattatctcaatttagttagttattttaggacgatagtatataatttcttaaccattaccaaaattctttcaaattaaagctccaactaacttaaatattcctatcctaaaacctttttaattacaccatttcatccaaaaacttttaatccgaacctctatatcaacccttcccaactaaaactattccccaacaaactttcca

SEQ ID NO: 40625 - DNA, 354 bp, Zea mays
  Clone ID: LIB3062-030-Q1-K1-A6
attccctacgctagccatctcatccttctcaatatcataaacttcctttgctttataatcacacttaataacactataagccagtttatctagaaagagtgcttccactttaatttcaccatcatcccttctaactacaactttccctatctctcatcatatttataatttcttatattacatttttttttcacatccatctaataaaaaataattttaactttattcatctttacaataaccactataatacatcacaatctctttcactatataattattaacaatattatatatcactaatcacatccacattatattaatctattccttttacattttcctataactcta

SEQ ID NO: 40626 - DNA, 230 bp, Zea mays
  unsure at all n locations
  Clone ID: LIB3062-030-Q1-K1-A7
tccttttcccatcttcatacaacccttagtttcaaaacattgctaacatcaactctatggtacagttcactctaactaggtctgccatcaactcctaaactattaccaacaaatctttcaaacanaatctttaactaacttcantaatactcttccaaaactcatataatcccaacctaacataccatttattaaatccttaactactatattaatctcttcttactttt

SEQ ID NO: 40627 - DNA, 417 bp, Zea mays
  Clone ID: LIB3062-030-Q1-K1-A8
ggaacacctgaggcccttgccttgagaggaaaggctgcagtagcgcaggccagactggcaaatcggctctggcagaagaaattctctggcccaaggtgggaggcgttggccaagaaaggtgccaagaaacaaaggttgttgtgggcatccaccggtgtcaagaacccagcttatcctgacactctttatgtggacagtctcatcggacctgacacggtcaacacgatgcccgaccaagctttgcaagcattcatagaccacggcaccgtttcaaggacagttgatgcgaatgtgtctgaagcggaaggtgtatacagcgccttggagaagcttggcatcgactgggaagaggttggaaagcagcttgagctggaaggcgtggactccttcaagaagagctttgacagcctactcgtg

SEQ ID NO: 40628 - DNA, 400 bp, Zea mays
  unsure at all n locations
  Clone ID: LIB3062-030-Q1-K1-B1
ctttgcagaaagatcaagtgcattgaaggcagttaaaggaagtgaaaaatatgaaatggatggtcaagtactgggagtgtccatggccaaaccattggcagataagaaacctgatcattcacacaggcctggaggaggccctaattatccccttcctccctatggtggtggtggctacatgggagatccatatggtgcttatggtggcggcggtcctgcatacaaccagccaatgatatatggcagaggaccagcaccggcaggaatgaggatggtgccgatggtgcttcctgatggccgccttggctatgttctgcaacaacctggtggaatgccgncttcgtccncaccgcggaagggtagtgaccgaagagacagtggcagangtggcgaagggcac

SEQ ID NO: 40629 - DNA, 307 bp, Zea mays
  Clone ID: LIB3062-030-Q1-K1-B10
cacttgacctgctcacctcgctgggattcaccttcgtgagtctacaaactgctctggccctttcttacagatgcttgtgcttatcgttgcctacatataccatttgctgccatcattatccgtaagccatggatcgagactgattttctgttagtttcttctccatgtccaccatctacttgatttgctgctattctcttcttgacattgtcccacgactcaagccctatcttgtgcttcagccttctatcacttgaggcctattctgcttctacatgtccttcttacaccctgcaacactaccgtt

SEQ ID NO: 40630 - DNA, 158 bp, Zea mays
  Clone ID: LIB3062-030-Q1-K1-B11
ttccctctctacgcatcttcctagacactatctatcctatcctataggtttctgttcacagcatacatcaccactagaagttcactcaacatggtcgacttcaccaacaatatcatatacacctcattctccttcaacaccactaccacccattctcc

SEQ ID NO: 40631 - DNA, 221 bp, Zea mays
  Clone ID: LIB3062-030-Q1-K1-B2
cctgaattcccttctctagccacgcttcccatcactcttcttctcatccacatcgactggttcatattcaacagctcatcaccattgcaagttctcctaaactggtccactctctcaaaacatttacttccgatcttaacaaatccttcctttccactatctaccactcactcaccactcttcactcctactaccctaccctaaattccaatatcctacta

SEQ ID NO: 40632 - DNA, 391 bp, Zea mays
  Clone ID: LIB3062-030-Q1-K1-B3
agccactcgttttagtttttggaaattctctaaacttgagagtaatacttttaagttgtacatgaagtatttgttaggtttaatattgggtgccgaaaagaattgtttttgcaagttactttatacaacactacttgtctcacagtaatgcttctgcaatctactaaggtccactatactctgaagggatgagctgatgatgtgtttcctcttcccagacaattggctcctttcagaagaagtacaacattggatcatttgagctgctgagcaaaactgcgccaattcaggcactttcactcattatactgggcccctttgtggactactatctaaatgggcggtcattgttgaactaccctttttcaggaggggcaactttcttcatact

SEQ ID NO: 40633 - DNA, 304 bp, Zea mays
  Clone ID: LIB3062-030-Q1-K1-B5
tcttggataaagtaaaggtcccaaagtaccaagaaattgtaaacatcctactgggaggtgtcaccacgcgcggtggtcaagtccttgaagttgatggagaaaaagctgttgtacaggtttttgaaggaacttctggaatagacaacaaatacacaacctttcagtttacaggctaggttttgaaaactcctgtctcactcgatatgcttgggctcatttttaatggttctggaaaacctattgacaatgggcccccgatattacctgaagcctacttggatatctctggaaattctattaatcc

SEQ ID NO: 40634 - DNA, 307 bp, Zea mays
  Clone ID: LIB3062-029-Q1-K1-H6
aatttatattgtttgagtgagcagctgacgtctacatcgtccactgcatgctctgaaaccgtagaatgtacgtacaggcatcagaaacggtcacatgctagtgcaaggtccaaagatgactcccagtccttgcaaaacaagcacaaggtcgactgagctagcgtcggtgctggcacaagtgcaccttcttgcagtgcctgcgttccaaagtctgatccgaactcttacacagatgctaaggttgtagcgacccagactgccagtattcgtgcaacggacctgatggaagctaccgtttcgatcttgg

SEQ ID NO: 40635 - DNA, 383 bp, Zea mays
  Clone ID: LIB3062-029-Q1-K1-F7
gactcgcctctgaaagttcggagccgccggcccgtccgtctacctctccgcctgcggtccggaaggccaatagttttcaagtggcaatggccgaccaggctaaccaacccactgtccttcataagctcggtggccagttccacctgcgctcgatcatctctgaaggtgtacggtcccgtaacatatgcccatctgtctcatcttatgaaaggagatttgccacaaggaactacatgacccatagcctttggggcccttcaatgtctgttagcggtggcatcaatgtcccagtgatgcagaccccgctctgtgctaatgctcctgctgagaaaggaagcaagaacttcatgattgatttcatgatgggcggtgtttcagctgct

SEQ ID NO: 40636 - DNA, 438 bp, Zea mays
  Clone ID: LIB3062-029-Q1-K1-F8
gtccaaaaggatatttcttgcccatactgtggatcccggtttgctccttccatcggaggggagctttgtaccatatgtgagcttgccatagttggggcagacgcctcatgcctggtctgctcccctacgcagatgaagtagacgatgttatcttacctcctgctgtccgcatcttcagcagcaccatctcgcaatgatgtctggatgtctcgatctggaagggatgaaacaattcactgaacaccaaacttatcaacgccctgcatggcattccaaattttcgtctggaggggattcatcttggtcttgtctcaattatcgcagctgcgttttcagctctgttttgtaaacatattgatgtacgaaagctgatgtgagtgctggttcactgaaaccgaatttctggtatggcatgccattttaatctctacaggttca

SEQ ID NO: 40637 - DNA, 413 bp, Zea mays
  unsure at all n locations
  Clone ID: LIB3062-029-Q1-K1-G1
gaaagagaaaaaggaaaggaaaggacgaaggatcggctgcgaggtctatggcgtcgacggcggggtacctggctcggcggtcggcgcagaaggagcgggtgcgcctgctctaccgcagggcgctcaaggacacgctcaactgggccgtccaccgtcacctcttctaccaggacgcgtcggatcttcgggacaagttcgaggccaaccgacacgtggataacctggacgtggtcgataggctcatcgacgatgcggaggctcagtacaggaactttcagcaccccgatccctacattgttccatgggcaccaagcggcactaaattcacaagaaacccngcttcacctcaagggatcgagatcatctacaattatggcaaggaggaccaagtaaacaagagtcctgcaagcggg

SEQ ID NO: 40638 - DNA, 404 bp, Zea mays
  Clone ID: LIB3062-029-Q1-K1-G10
accaaaaatacttgaacttcttcggtgtaaagcgatttgagatcgaacatgggtggagggaactcaggcaatctgttgaatcccaagctactatggagttgtttgccggcctctcagccgcctaatcttatcggaagtcatcatcccatgagccaaagactgaaccttggcggctcaatggtcagacagacaacagctagtgcttcggcagctgccccacagacaaggatcgacatgtttatctccggagactctccgaatagcgcgtcggatttgagcttccctaaggtccacagcgagcttagctctagcagctgcagctttgacggcctgctcaacttcataatcaaagtgtagaatgacgatgctgacttcatcgatgacctgcgatgcgactcgtactc

SEQ ID NO: 40639 - DNA, 410 bp, Zea mays
  Clone ID: LIB3062-029-Q1-K1-G11
ctctactaccacatgatcccctagtacctagacctaggagtccatgtacaacggcgtggtgcaattacacatggtccgcgactaaactctatgcctgcaaaacatgatggcattcttagactaggctttcacgaaatatctgttgggaatgcaacacctgtgtggtataacatggtaaaacaaggtctcatcagtgaccctgttttctctttctggtttaaccgacatgctgatgaaggagaaggtggtgaaattgtgtttggtggaatggattctagtcactacaagggtgatcacacctatgtcccagtcactcagaatggatactggcagtttaacatgggtgatgtccatgttgatggaaagtccacttgggtttgtgctagtggttgtgcaacaataacatattc

SEQ ID NO: 40640 - DNA, 416 bp, Zea mays
  Clone ID: LIB3062-029-Q1-K1-G12
ggtaaaggtctggtcatgaggaagggttttaaaggatcatttcctgatgctgcttcgggtgctaagatatttgctgtccttgctggcgtacaaagtttggtagcctgctctttgcgaaaactacgtggaaaagatgatggtatcaatgcaggagtggcaggctgttgcactggccttgcgctgagctttccaggtgcaccgcaaactctgattcagagctgcctgacctttgggactttctcgtacatcatagagacgctaaacaagcagcagcccgcactggcgctaccactggctaaagggattaaggatcaaaaggctggacaaagtgttcttcctcccttcacgctccctcttccgcaggatgcgatggatggattttctaagttccagaactttttgtcgtcgaaatttca

SEQ ID NO: 40641 - DNA, 408 bp, Zea mays
  unsure at all n locations
  Clone ID: LIB3062-029-Q1-K1-G3
gggagataggatcattaagtaatcttacatttctagacctatgtggtgctcagaatctaacggacgatggccttgcatgcatatcaagatgtggacgtctaacatacctcaatttgagttggtgtgtacgtgttactgacactggtattgtagctattgcgcaaggttgtcgagccctcgaactgttaagtttgtttggaatagttggggtgaccgatgcatgccttgaggctttgtcaaaatcttgctcgtccagcctcacaacactcgacgtaaatggctgcatagaggaggagccgggatgacctgctgaagctcttcccatcactgagttgcttcaaagtgcacagctagcatgcacggtggttctcgatggctttgtattctacatctnagaaagggaaagga

SEQ ID NO: 40642 - DNA, 145 bp, Zea mays
  Clone ID: LIB3062-029-Q1-K1-G4
ccatacgttgccttgggcaatcgagctcatcaatctccgtgcaattccacctcccgaagacggcaactgagtccctgcaccgacccaaaccctatcgcgcacccaacttccttcccctttcccggcgtgcggtccggcgctggag

SEQ ID NO: 40643 - DNA, 204 bp, Zea mays
  Clone ID: LIB3062-029-Q1-K1-G5
gcgcaagagatcacgctactactcatgactcgccaacatgcatatatcatggaacgcggcgctacggccactcactgaccggtcctggctgagctcctgctcttcctctacccgacctcgcccatcgacactgtgctctggaccctggacctagaccttttccaccacgtcccgcaagacctccgcgacaagttctacgcctac

SEQ ID NO: 40644 - DNA, 164 bp, Zea mays
  Clone ID: LIB3062-029-Q1-K1-G6
tctctgaaaactctacaaaacgtttttaactttatcgtctcagcgaaacacatgccaagaattggtgttaggacctggtgacctgatcacttcgaggatggagagtggttcagcggtgggtcttgtcgcatgaaattgccctacaacaagggagagttcatata

SEQ ID NO: 40645 - DNA, 443 bp, Zea mays
  Clone ID: LIB3062-029-Q1-K1-G8
aagataatgtattggcaagaatgttagaccataaggaagctatcatatctcattgaggttgggctagcctcttcctaggattccataccttgggcctttatgttcataacgacgttatgcttgcttttggtactccagaaaagcaaatcttgattgaacctatatttgcccaatggatacaatctgctcatggtaagactacatatgggttcgatatactcttatcttcaacgaatggccccgctttcaatgcaggtcgaaacatatggttgcccggatggttgaatgctgttaatgagaatagtaattcgcttttcttaacaataggacctggggatttcttggttcatcatgctattgctctaggtttgcatacaactacattgattttagtaaagggtgctttagatgcacgcggtttcaaattaatgccggataaaaag

SEQ ID NO: 40646 - DNA, 101 bp, Zea mays
  Clone ID: LIB3062-029-Q1-K1-G9
atacgcgccctgtatccggccactaagcgctgtaacattggtgaacacgggctgattaaccgccacactttccatctcccgatcaaccgacattctcgcta

SEQ ID NO: 40647 - DNA, 287 bp, Zea mays
  Clone ID: LIB3062-029-Q1-K1-H1
cggacgcgtgggcggacgcgtgggttctatcgcgagcgccgccctttttttttttttttaatcataagaacttaaggagtggcaataataataatccggaaactggcatgatgcaacaacgttcatatggtgaacaaacagtacatctcttattcaaatctcgtcttttatgcaaatcccaaaaatgaacagcgacgctggacgaagcagactgcaataaggaggaagaaacggccgtacggtcggcatgcactggtatatcatgatcaagccgtgagctccatgat

SEQ ID NO: 40648 - DNA, 415 bp, Zea mays
  Clone ID: LIB3062-029-Q1-K1-H11
gcgaatttccgtcagcttggagcggtccaagcgccctgcgaagcaaactacgccgatggcttcggcggcggcgtgggagggtccgacggccgcggagctgaagacagcggtggcggaggtgattcccggcggcgtgcgagtgaaggggtgggtcatccagtcccacaaaggccctatcctcaacgccgcctctctgcaacgctttgaagatgaacttcaaacatcacatttacctgagatggtttttggagagagtttcttgtcacttcaacatacacaaactggcatcaaatctcattttaatgcgcttgatgcactcaaggcatggaagaaagaggcactgccacctgttgaggttcctgctgcatcaaaatggaagttcataagtaagccctttgaccaggttatacttgac

SEQ ID NO: 40649 - DNA, 118 bp, Zea mays
  Clone ID: LIB3062-029-Q1-K1-H12
gttgaattcccctactctctgtcccgacaccagcggcgaggccaccgcgctcgtccggtccctcaagtccggcggcaggttcgtcggcgaccccggggacgagaagatcgagaagatg

SEQ ID NO: 40650 - DNA, 289 bp, Zea mays
  Clone ID: LIB3062-029-Q1-K1-H2
tcgcggacgcgtgggctgactcgtgggttctatctcgagctccgccctttttttttttttttaagcataagaacttaaggagtggcaataataataatccggaaactggcatgatgcaacaacgttcatatggtgaacaaacagtacatctcttattcaaatctcgtcttttatgcaaatcccaaaaatgaacagcgactctggacgaagcagactgcaataaggaggaagaaactgccgtacggtcggcatgcactggtatatcatgatcaggccgtgagctccatta

SEQ ID NO: 40651 - DNA, 253 bp, Zea mays
  Clone ID: LIB3062-029-Q1-K1-H3
cgagaccatcgacgagcatcttcctgcatctgcaatggctgccgctaccgtgtccgtccaaggcatcgagcttaactaccaggggctagaggtatccgcgcacggccttgactgcatagccatgatctggtgatacaacacgtcctagcccattcctaacatgatcaagatgataaaccacgccatgaacagcgacgctacgactaatcgacactgactacaggtcaagaaacacacgaacgggctccatgca

SEQ ID NO: 40652 - DNA, 302 bp, Zea mays
  Clone ID: LIB3062-029-Q1-K1-H4
tcgcgaagccatagcctatcacattttctcagttgctggatcgaacgttaccaactgtctgtccgtcaaagttgtcatatctggctgagcatacattgtctgagcagatcaaagagctcagtgcatacataagtgttcccgaataccgttacgcttgtggaggtggactccaatcacttaacgcttggtttgctccagagggtacagtgtcaccattgcaccatgatccggattacaacatactagctcatggtttgggcaggaagtgtattagactctatcctgctttcatagctgaggac

SEQ ID NO: 40653 - DNA, 430 bp, Zea mays
  unsure at all n locations
  Clone ID: LIB3062-029-Q1-K1-H5
aggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgtcacctgcaagaactgcgtccccgtgtccacggacaagggggccatcaagtacaggtgccgcgacttccttcccgaaaactgcggctgcaagatccactagagactcatccaattccaccatggccgcgcgccacagcggcacagccgatggatccttccatgttcctncgtccgtccgncttgctacaagcaggcagccacaccaataagctagctctggggtgtgntttgtatgtttgattgggtgtcccttcccagtcgagatggaataaaataaatcatcatgcgccaattagc

SEQ ID NO: 40654 - DNA, 434 bp, Zea mays
  unsure at all n locations
  Clone ID: LIB3062-029-Q1-K1-F6
ctcctcgtcgtcgcctcgctgtctcctccgccgttgcctgcgatcccgatcatggagggcggcagtaccaacctcgacgcggctatagagtcgctcctgaacgtggagaagcagatgaggctggcaggcgatgtcgccggcacgcggaaggccgtcatcgacatcgtcgagctctgctacaagaccggcgcgtggaagacgctaaacgaccagatcgttctcctctccaagaggagaggccagcttaagcaggccattactgctatggttcagaaagcaatggactacattgatttgacaccagacattgacacacgagtcgagctaatcaaaacactgagcagcgtctctgctggcaaaatttatgttgagatagagagagcaaggatgatcaaaaagcttgcanatatcaaagaggagcatggaaagattga

SEQ ID NO: 40655 - DNA, 246 bp, Zea mays
  Clone ID: LIB3062-029-Q1-K1-D7
ccgctgtcttgcatcaccacgagcgtgggctctctcctttctcgactacgactggtccaccgactctgccggctgcggcctgccgaactgcgccaggtgccaagcagccatgtcttcttgggacccttcgccggccactagcaccaccagctcaaagatggcgagcataccgtctctcgacagcatgaatgcgttcccacatgcggaagaccacttcgtgaagaagacttactctttcgctgttgt

SEQ ID NO: 40656 - DNA, 196 bp, Zea mays
  Clone ID: LIB3062-029-Q1-K1-D8
ggagttccgcaagatggccaaggctgtgaataaccaggttagtgacaactactacgggccggatctgaccaagccagctcttgctaggctaagctcggtgtaccgcagccttcaggttgccaagtccggtgtcaataagaagaacaggcagtcctaagcgctaagtctgtgatctgtcaggtggcatgttggtgct

SEQ ID NO: 40657 - DNA, 408 bp, Zea mays
  Clone ID: LIB3062-029-Q1-K1-D9
tcgacccactcgtcactagaccatctcttattgatagagatctgaatatagccatttgtaacaattcatcagtgtgaggtccattaatcactggaagacaactactgtggctttttaagcgacaggatcgtaaaggattacacagacttcgctaaggtgtgctttgagaacttcggtgacaaggtgaagaattggttgacctttaactagccacatacatttacaaccttttcgtacggaacgggagtttttgcccctggactgttctcaccatgagaaaaatgtgctcaacctattgctaactcactcaccgaaccatacattgctggccacaacatccttcgagcccactctatgactgttgacctctacaacaagaattacaagggttcagactgccgcattggg

SEQ ID NO: 40658 - DNA, 448 bp, Zea mays
  Clone ID: LIB3062-029-Q1-K1-E1
caaagttagacgagatggaaatggtcgatggtttcgagatagctctcaagaaactaaccgaatggctgggggagaatattgacaagaacaagactaggatattttttgcaggatcgtcaccaacacattcctgggctagcaactggggtggagaagacaagaacaagtgccttaacgaaacagagccgatctacaaaaccggatacaaagctgcaactacagactacagcttgatggccaaagctaagcactactttcgaacattggagccgaaaggcatacatgttcaaatactgaacatcaccgagctgtctgactaccgcaaggacgggcatcctacggtgtacaggaaacagtttgctcctctgacgaaagaagcaatcgcagacccagccagttacgcggattgcacgcactggtgccttccccgagtttctgatgtctggaa

SEQ ID NO: 40659 - DNA, 203 bp, Zea mays
  Clone ID: LIB3062-029-Q1-K1-E10
tcttcggcaaatatggaagaatacgagtagtggagttgaatcgcgactatgcggttaagtagtccagtgaacatcgggatgcccatgaatcacggtgccaactagatcgctcagatgcagactaaactgtctcagcaaaaaatgcctgacaatcttcttcatttgcaggctataaattcacatcgtcctgatcgggctctaca

SEQ ID NO: 40660 - DNA, 184 bp, Zea mays
  Clone ID: LIB3062-029-Q1-K1-E12
acagcattgaaagtgactgttcatcatcagaaatgtcaagaagttcgatatgcacgagatgttttggaatgccacagaggctccgctttctgcgggatgactgacgccgatgtacacaagcatatccagcacatggtgaagttcattcctcagtatgtcaaggacatggtgcattatatcgaag

SEQ ID NO: 40661 - DNA, 214 bp, Zea mays
  Clone ID: LIB3062-029-Q1-K1-E2
tcgaactgtatgaactcttctgcatgtacgattgttcattgctagatataaatcctctgtcggagactgttgacaacaatcttgaggctgctaatgcaaagttgaactttgatgataatgctgcatttatacagaaagatatattttcacttggtgatacaactcacgattaccctagtgaggccgctgctgtcaaagcaaatttgtactatat

SEQ ID NO: 40662 - DNA, 400 bp, Zea mays
  Clone ID: LIB3062-029-Q1-K1-E3
aggacctgtatccagtgctgcaacccagaatgagaagccactacctctgcaggtgcttgtagcatccaaatctgaagtgcagaagcaggcttccctaactggcagtgcaactaccgaggccttttcagtatcaaggcccttgactgccccacaagtccctgcagcaaaacaaagtgcaccagtcacttcaacagctcagaatgcaccttttctttctcgttcaatgagtgctgttgggcggttggggaatgaaccatctgccaatgctcctagtttcgttccccgttcacgaacatatcgcaatgccatgatggagaaaagttctggtggtggaagcttgttcacaacgtagcaaggttcatcggatcaagcagtttcaccatgggaatcgatgtttaca

SEQ ID NO: 40663 - DNA, 189 bp, Zea mays
  Clone ID: LIB3062-029-Q1-K1-E4
taaaacttatatccaatgcttaagtcccaatatttgattgctctatctcagcacactctcctagtatgcatatctgaatattagaagcaagcttacttaaatatcttttccactaccgacacctacacattcttaaagtacttgactgcctgacatagtccatgcaccagttctttatgcacacatcac

SEQ ID NO: 40664 - DNA, 332 bp, Zea mays
  Clone ID: LIB3062-029-Q1-K1-E5
ggacaagaacgatactaggaagaagaagaagaaggcgccgtgggaagaagaagacagggacgaaggcagcaaggtgactctttcagggctcctcaacttcatcgacgggctgtggtcggcttgcggcggcgagcgcatcatcgtgttcaccaccaaccacatggacaagctggacccggcgctgatccggcggggcaggatggacatgcacatcgagatgtcctactgctgcttccaaggcttcaaggtgctcgccaagaactacctgggcgtgcaagatcatgacggcgagctgttcggggacattcgtcggctgctggaagaagtggaca

SEQ ID NO: 40665 - DNA, 89 bp, Zea mays
  Clone ID: LIB3062-029-Q1-K1-E6
aatcaagatcgatactatgcagattacatttatggcgcctaagactgaaaacgtcgagtaggtactcagcaacgtgagcattgcatacc

SEQ ID NO: 40666 - DNA, 213 bp, Zea mays
  Clone ID: LIB3062-029-Q1-K1-E7
acctgtttcaatactgccacccataattagaagttaactacctcctcatgttcttgtgggatcggaaccttaatatcagaatcatgctttcctaactagcactgcaactaccgaggcctttttattatcaaagaccatcactgcctccacacataaccacaggataacaaacagcaccattcactttaacaactcaaaatgcaccacttattt

SEQ ID NO: 40667 - DNA, 376 bp, Zea mays
  Clone ID: LIB3062-029-Q1-K1-F1
gcgaccaccaccagcacgccatcgcctacgaagacaaggacggcgacctcatgctcgccggagacgtgccctgggatatgttcatctcttcgtgcaagaagctcaggataatgaagggctctgcctctgaggccaggtgatcgctgatccatacataaacagaggctacagacacgccacctgggaacgcggatccaagagcacacacggatcgtacttgacgaggaaagagggaggagcagtgtggcttgagctctccagtgttgtacaaagacatgtttctttctgaacccaaaagggagaaagatgtatgaagcgtgtatataagatcttagctagcagtttggtttcatttgtatgagcgatcgaaggctgt

SEQ ID NO: 40668 - DNA, 401 bp, Zea mays
  Clone ID: LIB3062-029-Q1-K1-F10
caactcgagaaaccagccctactttcatcattgggaagtttgacggaattggtgctctgggatttcctgaaatttctggagtaggagcccctccaatttggcagagcatgaaacagcacatactggtctcaatggaagtgcactctatgggactcaatagagacccggaatcaatgacgcaatacatgcgtcaaagcgattttgtgatggcagtgcccctcggatgatccacggatgccttcgaacattcgtgaaggatcatgttgatgttgcaagcacgagccatgaagctaaatcaaaatcatgattttttgcaaatactcatacaacaaaatggtggctgaagtaaagaagtacggagagaaccttgctgtcttgagttcaagcgaataccttctgtc

SEQ ID NO: 40669 - DNA, 402 bp, Zea mays
  Clone ID: LIB3062-029-Q1-K1-F11
agcaccttcacgtcaaagagtttgagcatctggactgggctgcgaggatgagggtcagcatggtcgtcgcatactgccttcaatacatgcaccatgagctcagtccacctatggcgatccacgacgtgcggtctgacacaaccttcatttcagatgattatgctgccaagattgcagatgttggtgtatggaacgagcttgctgccaaagcgaaggctggacaggaggactgctgcagccgtgctgaatctcctccggatctcccaagcaacgcctactgcttcggcgcgctcatgatcgataccatatccggttgggttcctgacccgtatgatcacaaacccatatgcagctgggcttctgagcatctgaaagactaggactacggcaagctcgtggacg

SEQ ID NO: 40670 - DNA, 377 bp, Zea mays
  Clone ID: LIB3062-029-Q1-K1-F12
acccaacctcatatctcatctcgtcctatatcgtccactagatcggtcggccgggcagctgtgactccggcaagctcggccgtcgaatcctgcgtcatcattcctcgaaacttaaggctactagaagagctagaacgtagatagaacggcattcggatatgggacgacattgctatggaataggagacgcacatcacatatacatgcaaccaaggtctgacagcacatatatgccactttatgcagtgcaaacattacgtaagctcgaacgttacctgctgcagaagatatcattgaatggctagcgaccaatactgtggatttctttaaccaagttaatatgctgcattgcacactcacataatattgcacacctg

SEQ ID NO: 40671 - DNA, 377 bp, Zea mays
  Clone ID: LIB3062-029-Q1-K1-F2
taactgcatcaacttctctccatctcctacttcaacttgctcgacatccatattctctccgggaacgttcactacaatatgttgatctcttcatgcaaaaatctcatgataataaaaggctctacctctaaggccagataatctctgatccatacataaacatatgctacacacactccacctgtcaactctcatccaagatcacacactgatcgtacttgacgaagaaagaggtaggatcagtgtggcttgagctctccaatgttgtacaaagacatgtttctttctgaacccaaaatggagaaacatgtatgaagcgtgtatataagatcttatctagcattttgttttcatttgtatgagcgatcgaaggctgt

SEQ ID NO: 40672 - DNA, 408 bp, Zea mays
  Clone ID: LIB3062-029-Q1-K1-F3
gcgcagagaatccccaagcaaacaaacagggttgagggagaggagaggacaggagaggagaggttgggtctgctacggcatggcgtccgatgaagctgtacggtgcggtgatgtcatgtaacgtgactaggtgcgcaacggcgctggacgaggctgtctccgactactacatcgtgcccatcaacttcgtcaccgcctagcacatgagccccgagcacctagtccgctacccgtttggtcaggtatcagctctgcaagatggtgacttgtacctcttcgaatcacgagcaatctgcaagttctctgctcgcaaaatcaagccatagctgttgaaggaaggtaacctcgatgaggcagcaatggtggatgtttggatcgaagtcgaagctaaccagtacaaccgtgcac

SEQ ID NO: 40673 - DNA, 390 bp, Zea mays
  Clone ID: LIB3062-029-Q1-K1-F4
acggctactccttccctctccccccttctccccctacgtcttcttcccccaggggcatccgggtttggactttttgctcccccacgttgaaccttgatcctcgtgctccctttcttgattctttctccgtaagatctcttgctaggagtagcctgtcccgtgtgcgcgctcgcacggacatgcttgtttccgcgtcttgaaaggcgagaaaaagtggagatgggcgcttgcgcttcggtacacaaggacccggtgctccccaagaagcaatttcttgactcttccaccaaggcgaatgccgtcaacgggaatggtggcggaggcaaccgtgttgctccagttggtgatggcttcggtgatctcaagtacaaagtcgacgcttaagcttat

SEQ ID NO: 40674 - DNA, 349 bp, Zea mays
  Clone ID: LIB3062-029-Q1-K1-F5
gccaaagaccccagggcagcaggaagcaatagaagcgagcgaggcagcggcgtggggcgaggagtggaggacaccgatccccgccggagagcgcgtccatcccaaatggcgactgcagcttcgcccgccgctgcctttccccacatcctctccctctactcctaatcccctcccaatcccccccccccccctctctctcttcctcgccagctggttcgttccgcacccgtcgtcgcattgggtgccgaggagggacgcaatggagcagtacgagaaggtggagaagatcggggagggcacgtacggggtggtgtacaaggcgctggacaaggccaccaacgagacgatc

SEQ ID NO: 40675 - DNA, 442 bp, Zea mays
  Clone ID: LIB3062-029-Q1-K1-D6
cagctgtattgcatcaccacgagcgtgggctctctcctttctcgacgacgactgggccaccgtcgctgccgcgtgcggcctgccgccctgcgccaggtgccaagcagccaggtgttcttggggcccttcgccggcgacgagcaccaccagctgaaagatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcatttccttctttgccatgtgaagtattgagtgtggatgcaattgacatgtctgggaaacat

SEQ ID NO: 40676 - DNA, 409 bp, Zea mays
  Clone ID: LIB3062-031-Q1-K1-G5
tcggaggaatatgatgacattgtgaacgacatgaaggaggaaggacacaaatatggtatcattggagagggttacaattccactgccatgcccgagcggctctgctgttgctggtgtctgaaagatgtttagggctcaaccttggctaagaccggactgcattgtcggaaatacggcaggaacctcatagtagctcgtttctaccttgatgacaaatgcgaagctgatgcagacgactgaaacgatgctagaaccccgatcatacagttactgttatggcacacaatgctgttgattcgaccttatgtagttaacattggtgatcgatccgctgataaattatataagtatcatgcactggtattatataaatcgcagtgtatctgggctgaattggcttgacggttat

SEQ ID NO: 40677 - DNA, 349 bp, Zea mays
  Clone ID: LIB3062-031-Q1-K1-G7
gaactgcagggctcgggctgaaacgtactgtcaagagaggttatggtaccttgaccagatgttcaatggtttatctctggctggaaatcgggtgggggatgacatatgggatgcccttattgcaggactaagtaatacatcagagctttaaggatattcagcgaggtcattgtataacgccttacaagaatatggtaaacagggaagcttactaagagtagctgtttgatgcattggagaatatggtgaaatgctggtgaacaatgaaggcatgctggatggcgaggagccacttacggtcacagaatcagatgctgtggatgctgtagaggtcgatcctaaccgatac

SEQ ID NO: 40678 - DNA, 457 bp, Zea mays
  Clone ID: LIB3062-031-Q1-K1-G8
cccgaccgatcctcgcctgctgcagccatggcgacctccgcggcgctctccaccgccggcaatgccacccagctctgccggtcccgcgcttcgctgggcaagccggtgaaggggcttggcttgagcataggccgcgagcgcgcccagcggagcattgcgtgccaggcggcgagcagcatctccgccgaccgcgtccgcgacatggagaagcggaagctgatgaacctcctgctcctcggcgccatctcgttgcccaccgtcggcatggtcgtcccctacggcgccttcttcgtccctgccggctccggaaacgccggcggcggtacctacgcgaaggacaagctgggcaacgacatcacggtggaggcgtggctcaacacgcacggtcccaacgaccgcacgctcgcgcaggggctcaagggtgaccccacgtacctggtggtggagcaggacaaga

SEQ ID NO: 40679 - DNA, 359 bp, Zea mays
  Clone ID: LIB3062-031-Q1-K1-G9
ggcgcaatcggtctgtacaccaaataattcgacatgcgtgtgatcatctagaccaacctcacgagacccgaggatcttacctgcggccctagacatcaagaacccccagttcaataggaagcttgacagcatgcttgacatcaaccagaagatcattgctgattcatactccgactaaataaccctattgacgaacctgaaaacgattccttttagcccctctatagtgtccaacatcatgatcttctaaatcatgcacaccatccagtctggatcaccataattacccgaatttgagccccggacttgatactgattctgtacaaagatatatcctctagttattcaccctgaatgac

SEQ ID NO: 40680 - DNA, 425 bp, Zea mays
  Clone ID: LIB3062-031-Q1-K1-H1
cgggcttcggtcccagccgccgccgcagcctctcccttccctcacctgggtcctctgtgtgctgaccaagcagcaacgggtgaggcctggccgagccgctctgcctggatgcacctgcaccgaccctagagccactatgagagttcggagcgatggccgagcggtacctatggagggggcgatctgggttcgatctcaggaggcgaggaccaaggcaacgcacaacggcgaccgagtgaacagtatcccgctctgacaccagctcctcgtatagcatcgtccatactagggctgcgtacaccgacatgctactgaaaaagagatagatctttatatacgcaaactggtggagatcgctttggcgaaagaaatgtattgctagcatcaagtctgtcgagacaatacaaccaatacaagcttgtgcc

SEQ ID NO: 40681 - DNA, 82 bp, Zea mays
  Clone ID: LIB3062-031-Q1-K1-H10
cggaacgaccgcactcgtcggcaactgccaggtgtaccacctgcatgaaacattctggtcaatgatggacgtgatcagcacc

SEQ ID NO: 40682 - DNA, 390 bp, Zea mays
  Clone ID: LIB3062-031-Q1-K1-H11
cggacgcgtgggcggacgcgtgggcgaaggatcccgaagccgaagagaaccctaccgagggggcagagaatccgtaggcgcgcctcatacgattccgagatccgtgcctcttatcggcagccatgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtcggcgcgccggcgtgcggggacgtcatgaagctgcagatccgcgtcgacgaggggtccggcaggatcgtcgacgcgcgct

SEQ ID NO: 40683 - DNA, 482 bp, Zea mays
  unsure at all n locations
  Clone ID: LIB3062-031-Q1-K1-H12
accggcccggacggccagctcgggtggttcgacgagaacgaccagctgcagcaggtctccgtgcacgcgctcgccgccggcaagaagggcatcctgttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaagaaggcgggcagttcacgatctctggcgctgaggagatcctgaaggcgctttanaagccgcagcaacgatc

SEQ ID NO: 40684 - DNA, 433 bp, Zea mays
  Clone ID: LIB3062-031-Q1-K1-H2
acggaagtgcgccctgcgtggatttgatctgagggttctcttgatcctactgattggtgtgccaatgtttgatctttgccatatatgtgcatgggcacaaggtgacttacttgctccaaccaatttgggagaagcccccaaagcccttcacaatacttcctcactattaccatgaaaatgtctcgatgggtaacctatgtaagttgcatggatggaaagtcaaggagactgcactccgtgtatttgatgccatgctcttcagcaatgaacttgacatccttgatatccgctggcactagcttagcccgtatgtgtcagaatttgtgctgattgagttcaattcaacttttaccggcatatagaaggaccttcactttacggaaaaccgacaacggattggctttgcagagtcacggttgacctatggcatgat

SEQ ID NO: 40685 - DNA, 358 bp, Zea mays
  Clone ID: LIB3062-031-Q1-K1-H3
gcccaccatggcctgcctcaccgacctcgtcaacctcaacctctctgacaccacataaaagatcatcgcccagtacatatggatcggtggatctggcatggatctcatgagcaaagccaggaccctcccggacccgctgaccgatcccagcaagctgcccaagtgtaactacgacggctccagcaccggccagtcccccggcgaggacagcgacgtcatcctgtacccgcatgccatcttcaaggacccattcaggatggtcaacaacatccttgtcatgtgcgattgctacaccccagctggcgagccaattcccaccaacaagaggtacaactgccgccaaaatcttcaacaacct

SEQ ID NO: 40686 - DNA, 471 bp, Zea mays
  Clone ID: LIB3062-031-Q1-K1-H4
cctgttgcttctatagctccgggccaattacgcccagtgctcacatcttcttcgatcccatgtcgctgccgccgtacgggctgcacccacatgttcgtcgggcccttcgtcaccctctagcagcaccacgctgagctccacagtggttcttgcagaggtctgtgatatactactaggctgaatacacctacacaaagaagagaaaaggggatcttggagaggtttgtgacacactactgtggtgaatagacctatgcacaagagaaaaagggaaagagagaatgttctcaatgaattgaagtccctatgtcaaaaacaagagcaaggagctgttgtacaagtggcttgtggaaggagcatatcatatatttgtaggagataactttacacttgattcatgggcgactggattataggggcattgataaacatcgtttagaatgttgcaataaactttggtaccaaactttt

SEQ ID NO: 40687 - DNA, 460 bp, Zea mays
  unsure at all n locations
  Clone ID: LIB3062-031-Q1-K1-H5
gccacatcctcccctccttcctccttgggttcccagcccgtgcgcccgcctgtcgcaggcgcagcgcagccgccggccatggcctgcctcaccgacctcgtcaacctcaacctctcggacaccacagagaagatcatcgccgagtacatatggatcggtggatctggcatggatctcaggagcaaagccaggaccctcccgggcccggtgaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgncaagatcttcagcagccctgaggtcgctgccgaggagccctggtatggta

SEQ ID NO: 40688 - DNA, 458 bp, Zea mays
  Clone ID: LIB3062-031-Q1-K1-H6
ccggcttgttctctcgcttgccgactattacgccaggtgcccaggtcttcttcgggccgaggtcgctgccgccgtacagtgggtgcccaggtcttctacgggcccttcgccagcgtcgagcagcaccaggctgagctccacagtggttcttggagaggtctgcgatagactactaggctgaatacacctacacagagaagagaataggggatcttggagaggtttgtgacacactactgaggtgaatagacctatgcacgaagagaaaaagggaaagagagaatgttctcaatgaatggaagtccctatgtcaaacacatgagcaaggagctgttgtacaagtggcttgtggaaggagcatatgatatattagtgggagataactttacgcttgattcatgggcgactggatttatagggcgttgataaacatcgtggggagtgttggcatagacttt

SEQ ID NO: 40689 - DNA, 321 bp, Zea mays
  Clone ID: LIB3062-031-Q1-K1-H7
ccacccacgcttgcgccatacaactgatgcttctgttcatcctccctctgctatatctccacaataacacctgtaaccggatcagctcaaaatcctactgtggaaaggccctaaaaatctaccaaaatcatattccatggacttatactaaataaaataccactcttcttaactgacatatcaaccatatatcatactcagaatcaacaccagcaaactctcaagctacttcacaaagcctacaaactttacaacacttatgccctacagcataacaccattactgacattcaaccataaatgggcgttcttcactacatt

SEQ ID NO: 40690 - DNA, 448 bp, Zea mays
  Clone ID: LIB3062-031-Q1-K1-H9
ggaccatgcgccgtccgtggaggcactcgggcccagggtccgccgtcgcggcgcgccacggcggcgcggagctatgcctccgcggggtcggggacctcctgccgcgacgcttcgcccgccgcgcggccggttccgaggaccttgtaatgcggctccagattcaccggaagcttgacaggcacacgggctgcgtcaacacaatgggcttcaatgaggtcggtgacaccctcatatcggggtctgatgatcagaaagtgatgctgatggactgggacactggcaccgtcaaattagagtttcattcaagacatggcggcaatgtgttccaggcacggttcatgccctgctcagacgatcggaccattgtcacttgtgctgctgatggcaaagagaggcttgccaagatacacgatgctcgaaacgtgtccacaacattgcttggtgaaca

SEQ ID NO: 40691 - DNA, 391 bp, Zea mays
  Clone ID: LIB3062-031-Q1-K1-G4
acgtgttgacacatttatagctgcactaaagaagatcgaatcatggatattttctcgaattgttgagacccggtggtggcatacattcacaccacatatgcaatctgctgatataactggtggtttgagaagtactacaaatccagaaaaaggctatggaaggattcctgctgtgggcaaccagcatacaagcaaccatatcaatggacatatggaagaaagcctttaaggaagcgtcagaactgctttgcctagtaagggcagctggtcatgagtgtggatgtttgcctatgttaaccaagtttgtcatgtagcagtgcatagctaggttggatgtcgcaatgttcaatgctatctagcgcgtatcagatgatgcaattctaacagatcc

SEQ ID NO: 40692 - DNA, 445 bp, Zea mays
  Clone ID: LIB3062-031-Q1-K1-F11
gggcgcggaggccgtcgcgctcgggctcggcctctccgacttcccctccgccgggaaggcggtgctggacgacgaggactcgttggtgtggcccgccgcgtcgttcgacatgggcgcgtgctgggccggcgcagggttcgccgacccggaccccgcctgcatcttcctcaacctcccgtgacagccacacacggtcacggcgccgaggctctgctctgcgcctgatgatgagtgcaaggaaatggagcgctttgattcttctgctcttggttgcatctgctaattgatttagcagtggtggtaaggtacacgcacgacgagctgactgcgtggttcttggtttgggccttagtatatgatgatgatgacgatgatactagttgtatgtgtgacgtgagagacgatcgcgacgacgaccttgaattttagtttctgagatgaaaaa

SEQ ID NO: 40693 - DNA, 308 bp, Zea mays
  Clone ID: LIB3062-031-Q1-K1-F12
gggggccatagggctctatcctacctttcctctgtgtcgacaaaacagaagacggcatgagtggacagagggttttccgaccatgcatttcttgagggggggccattgcaggcccttgggtgtcttatgagggagggctcggtttatttcacttggctttgtagaatactgataactagaaaaagtagtaggacctcaccttcgtgtattatgatgatgcacatacaattttctgagtagaatggatgttgaatcatagaactaatgaataatatgaacactcgtcttcgccccaagtgctagtttgg

SEQ ID NO: 40694 - DNA, 398 bp, Zea mays
  Clone ID: LIB3062-031-Q1-K1-F2
acggcacatcagagtcgcatgaggccaagggccttcatcacgtgagagtagacagtaagacttctagcacagctgatgtcagttctgctgattgggagaagaagctggatactttctggcatgaaagactgaatggtcaggaccagctggtcatacttactgccaaggacaaaattgatgcagcagctgctgaagttttagaacctcttgtcatgaaaatcaaggatgaaaagtatggatggaaatatggctgtggagcctagggctgtacaaagctttttcatgctcctgagtttgttcacaagcatttgaagctcaagcatccagaccttgaattagagtcaacgtcaaaagttcgagaggatctttattttcaaaattacatgaatgatcctaac

SEQ ID NO: 40695 - DNA, 449 bp, Zea mays
  unsure at all n locations
  Clone ID: LIB3062-031-Q1-K1-F3
gcgccctaggcaagcagcaagcgcacacgtaaacgtacacctacctcggcgagcaaaagggaaaacgctgggcggagcaacgaagcccgcagccatgccgacggcgacggccacggccacggcagctcctcgccacgcggcgctcttcctgcccctgctgctgctcctgctcggcctccacgccacgtccgccgccgccgcgcgcgcgggcgtcgccgtggacgccgagctcacgtccaccaagccgtccccggtcccgaagaagcccagcgtgaagcccgccggccccggcgccgtgagcccgaccttcccgggcttcggcatccccgggatgggcggattcggcatccccgggatgggcggcggcgggtggggcggcggctacggcgggcccggcggcgggtacgcccgcngcggcgtggtggcgcccaccgtgacgtgctccgaga

SEQ ID NO: 40696 - DNA, 289 bp, Zea mays
  Clone ID: LIB3062-031-Q1-K1-F4
gcaaatcttcgtgaagacacttactttcattaccatcacccttgaggtataatcctcgcacacgattcataacgtcaatggcatgatccacaacaaggagagcattacaccaaaccaacagttgctgatctttatccacaatcatctgcaagatggtaataccttgactaactacaacatacataaagagagcacatctacatctacttctactcctcagagatatgtatcacatgttctgtgaatacatactacttcaacaccatcaccatcgatgtaatatcatacc

SEQ ID NO: 40697 - DNA, 448 bp, Zea mays
  Clone ID: LIB3062-031-Q1-K1-F5
tcggatgtgacccgtcaacaggagttggctgcttacttcacaaactgcaagcttcagagagggcatgggaagcttcgactcgctagtgccatggctctttgcttcaagcagacaaactatgcaactgccgcacactgcgctaggatgctctttgagaacagccgctaggaggcccaagcaaagaaggcccgacaggcgctgcaagcttgccatgacaaggacgattcccaccaactgaactatgacttgagaaatccattcgctgcttgtagccctacgtatgttgctatctatggtggacaataggatgcttcgtgctcatactgaggatcccgatttgcatcttccatctaaggacagctttgtaccatatgcgatcttgctgccgctggggcagatgcatcacgcctgctctgctctcatacacagtcgacgatcagcgatagta

SEQ ID NO: 40698 - DNA, 458 bp, Zea mays
  Clone ID: LIB3062-031-Q1-K1-F6
gatacttgtttggatgcatctgctggtcgaaggcagactgcctcagagatcaggcttggtatggtctctgcatgcaggtggcatgcaaaacagatgtgggagttaaatgcgaatggaaatcttgtgagcagctattcaagattatgtgccacagtggaatcaagggacgaaggaggtaccagtggaggtcgggcatggattgcaactggaagtgaaggagaaatctatctcgcgttcttcaatctcgactccatgagcaggacgatgaccgttgaaatatcagaccttggaaaggttctcggaagaaaccttttggagaaaaacccatgtagctacactgaagtttggagcgggaagaatttcggtcccgtgaaggaagagatttcagcggtggttcattcgcatggctccatggtgttcgaaatcatatgttgagattgcagtactgggcaagttgt

SEQ ID NO: 40699 - DNA, 463 bp, Zea mays
  Clone ID: LIB3062-031-Q1-K1-F7
tcgggcaccttcaaccccgtgcagaaccatgcgcatggaggctttagcagaaggcctgctggggagcggatgccgccgcagagccaaagccacccggagaacagctatcaggctgtgccgtcgtcacagaggatgccgtcgttcttgtgattctacaaggctggccctacgtccgatcgctgtatataaaaagaagtctctcgttcgtgatctgagacagcacattgagcgaagatcgactgcactgcattctccagcgttggaacctgtgtgatgtttatgccgctggtatttcagcgatcttctttgtctctccgatccagcactctggtttcattgagcgctgtagactgtctgtcctaactgatgtcttgcgttcaggaggacgatctggaaacgcgagccgaagctgaactgcatctctagtcgccggtgctaaaagatgccgtccgcttatatgaaa

SEQ ID NO: 40700 - DNA, 413 bp, Zea mays
  Clone ID: LIB3062-031-Q1-K1-F8
gcagatcttcgtgaagacacttactggcaagacgatcacccttgaggtggagtccttagacaggattgacaacgtcaaggccaagatccaggacaaggagggcattccaccggaccagcatcggctgatctttgacggcaagcaactggaggatggtcgcaccttgcctgactactacattcagaaggagagcaccctccacctggtgctcctactcacgggtgttatgcaaatttttgtgaagacattgactggcaagaccattaacttgcaggtggagtcgtctgacacaatcgataatgtcaaagcctagattcaggacatgcagggcattcacatcggaccagcagcgcctgatctttgctggcaagcatctggaggatagtcgtaccctattcgactacaacatccat

SEQ ID NO: 40701 - DNA, 418 bp, Zea mays
  Clone ID: LIB3062-031-Q1-K1-G1
gaccccactgccacgaacgcgggctgcagaacgttagccatccaggcatctacagaagtcgtctcggtcagcgtactctaatgtcctggctatgccagtctagcaatggcggtgccactgaacaaatgacatacacggaacaaccgctagaaagactagactacttacgcacggagcttgatgaacactcatcataagccattaaagacttgctttcagatgcctcgctagtgcgatttattgaatcaaggaactgcaatgatgcataaagctagtgaaatgatgaaagcagctgtgaagtggccgcttgcattcaaacctgaaaacatatgctgggatgatatagcacaggaagcagacactgcaaagatatatagcgcagtattataaggacaaacatggcacaactgttattgta

SEQ ID NO: 40702 - DNA, 277 bp, Zea mays
  Clone ID: LIB3062-031-Q1-K1-G10
ctacaatgtctacatcgtgccaaattttatgatggcaaatatcacattgcttctaacccttatccacacttatctaacaaagtacttctcattcaaagctgtttattacaactatattttcatctaaagtaatatttacaatttccctctcccttatatttaggctctaaactcccctttaatagctctattacataaacacaaaacaagcaacttcttcatttatttccaatattacaatgaacctgatccatggacacatcaatgattaaacctt

SEQ ID NO: 40703 - DNA, 450 bp, Zea mays
  Clone ID: LIB3062-031-Q1-K1-G11
ggatacctgacctcgttgatgtattgtgaagtcctcttggattcagcacatttcatcatgggatcctcgacagaagaaaacgtgaaggctttgctaaaagtccttgtagactgtgccgaagatgccaccaaatcactgggtggtttagtagatcatgcttcagaccacatgcatgatgaaaagatcgtatctagaaccttgtttgtcattaaagaaagactagaattgctacagcaagatgccttagatgcaaaagtgcaagcatttccagaaattgctaagtatcatggggatgacataagtcttgaacctacaactccatcgacctctccaactgttactgatcgatcttttgatgaatacgagaatgtactgacccgatgtcagtgatgagtggtacttcaccgattctgataggtctacacgcaatagctactggaatatttatta

SEQ ID NO: 40704 - DNA, 431 bp, Zea mays
  unsure at all n locations
  Clone ID: LIB3062-031-Q1-K1-G12
gggccccgacaagggcggtgaccccgagaagtttaaggagctcgcacaagcctatgaggtttggggtgatgcagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagtccacccacttaaagtttctctggaagatctttacaatggcaccttaaagaagctctctctttcgcgcaatgtcatctgctccaagtgcaagggcaagggctcgaagtctggtgcctcaatgaggtgccctggttgccagggctcangcatgaaagtcactattcgtcagctgggcccttccatga

SEQ ID NO: 40705 - DNA, 454 bp, Zea mays
  Clone ID: LIB3062-031-Q1-K1-G2
acgcgccctcgtcggcatctcgctgctggagatgctgttcagccactccttcgacgaggtgtacctggcggagctctacaccaaggagtggacatctgacgccaaggctcagtaggacgtgcaagcggatcggctcgcggatgaccgagatcgacaagcgcgtcagtcacacatgaacgcgtaccctcggctaaagaaccgagacggaccagccgagttgccgtacacgctgctctaccccaacacctgcgacaccaaaggcgacgccgacggcatcaccgccaagggcattccaaacagcatatgcatttgagttctgtctgagctgaggacgtacggtcgtcgcactagttgctagcgtttgcccgttccgttccgtgaagcgtggttctcacttgcgcggtattgagcaaatagtccagtactccttatcgaagttggtacgttaggactg

SEQ ID NO: 40706 - DNA, 481 bp, Zea mays
  Clone ID: LIB3062-031-Q1-K1-G3
ctatagttgaaaagttttctcaagagaagttatggtaccttgaccagatgttcaatgttttatctctggctggaaatcatgtgaaggatgacatatgtcatgcccttattgttgtactaagtaatacatcagagcttcaaggatattcagtgaggtcattgtataaggccttacaagaatatggtaaacagggaagtttactaagagtagctgtttggtgcattggtgaatatggtgaaatgctggtgaacaatgttggcatgctggatggggaggagccaattaaggtaacagaatcagatgctgtggatgctgtagaggtcgctcttaaccgctactcagcagatatgacaactggagcaatgtgtctggttgctcttctgaaactctcctgacgatttcctttgacatcagagaggataaaacaaatagttgcccagaataaaaggactgttgtcctttgactacagcaaagatcaat

SEQ ID NO: 40707 - DNA, 438 bp, Zea mays
  Clone ID: LIB3062-031-Q1-K1-F10
ggggactagttctagatcgcgagcggaaatcgagcgggcgaattgaatccggtcccgttcggggtcggccggcgagcgagcggggtccggccggctgggcattggttcgtgctcgctcgatcgatcagaaaatggctcatcgtgtgaacaacgagtacgactacctcttcaagatcgtgctcatcggcgactccggcgtctgcaagtccaacatcctctcgcgattcacgcgcaacgagttctgcctcgagtccaagtcaaccatcggcgtcgagttcgctacccgcaacctgcatatagaccggaagactgtcaaggcacagatatgggacacggcaaggcaggagaggtaccgcgccatcaccagcgcctactacaggggcgcggtcggagcgcttctagtctacgacatcacaaagaagcaaagcttcgacagcg

SEQ ID NO: 40708 - DNA, 408 bp, Zea mays
  Clone ID: LIB3062-031-Q1-K1-D7
gagaggagagtgagcagccagagaacagggtggtagagagatggaggaggaggtagagggcgagggaaggggaaccaaatcttggacgggatcacatagatttctttggtgtaggaaggaggagggcaacaagaggtggttacaggtagactaatagatctactgctgttgagggagttgatgcaaagctgagttgctgtgcgtaggctttatttagagatggctttagctggagttgcccgttcatgttacaagaacattactatgaccatcattggttccgaaaagttgcgtagatcacatgaacgagctaaagattagagatgatacgtgagtataagcaaccataattaatgggataggtatcgatgcttgtcacataattgtcacaactactgttggcaagaa

SEQ ID NO: 40709 - DNA, 462 bp, Zea mays
  Clone ID: LIB3062-031-Q1-K1-D8
cagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcat

SEQ ID NO: 40710 - DNA, 359 bp, Zea mays
  unsure at all n locations
  Clone ID: LIB3062-031-Q1-K1-D9
acaggcacacgtactaactaaactatacatggataatgagctgggggatccttttgggtctacgagaatcatcaggcgacgaangaccctttacacgcacacaggtacaagatcacagatgaagtacatgtcctggttgatgaaaccgcctgcgattacgtattccacgagcaccaccagaagaaaatataccacaaagacgccgatgaagccactgtctagaataagcaacaccacctattcgaatgaccgtaatactccgactgctcacgatccagctagctagctctggtgcacacaaccacacaacatgttaattctgtactgcatgcgtgacgtatttgatcgatcacaataat

SEQ ID NO: 40711 - DNA, 344 bp, Zea mays
  Clone ID: LIB3062-031-Q1-K1-E1
acgcaccaagatcggactatggggcggacagggagggtcggcacaggacatcacggcagagcagcgggcacggcgtctgcacaggatcaccgtccgcgctggcgttgccgtcgactccatcgagttcacctacaccgacgacgctgggcacaggcgcactgctgggcggcggggtggacttggcggcaatgttcgaacgatcgaccttggcgacgcagaggatgtcagggaagtctcgggaacatacagcgcatttgaaggtgccattacgctgacctcgctcaggctcgtcaccagcagcagaacctggggcccctggggggtcgagaacggacgcgtttctc

SEQ ID NO: 40712 - DNA, 416 bp, Zea mays
  unsure at all n locations
  Clone ID: LIB3062-031-Q1-K1-E10
gggcgcacactgccacacggagctagctagctgcaccgatcctctcgctcgcccgttaggtaggggacaggatctagccagccggcgaggagccgccgttgcttcctagctgcacctccgcgcgcggtctgcatgccagtcggtctcgatccacggccggccgaagaagaagacgccgacgatgaaggtgtcggtgctggcgctgtggtcggcggcggcagcgctgctgctggtgctggtggcgcaggcgccgtctgcggcagaaggctcccaccacggcggcgcgggcctcaagctggggtactacaagaagacctgcccaggcgtctagaacgtggtcaagtaccacgtcgacaatgccatcaaggccaaccgctgcgctcgcgccgcgctcgtncgcctcatcttccacgact

SEQ ID NO: 40713 - DNA, 453 bp, Zea mays
  Clone ID: LIB3062-031-Q1-K1-E11
ggcctcaaggtgcttgatctccacaggaaccagcttgatgggggcattccagtcacacttgggcagctcacaaaccttgttctggtagacctctcggagaatcaactgactggggcaatacctccacagcttgggaacctctctaacctgacacatttcaacatgtccttcaataacctatctggcatgattcctcctgagccagtcttgcagaaatttgattacactgcctacatgggcaaccagtttctatgtggctctccattgcccaataactgtgggaccgggatgaagcaccgcaaacgagtgggtgtgcctgtcataatcgccattgttgctgcagccctcatacttattggaatatgcattgtttgtgctttaaacatcaaggcttatacgcgtaagagcacagatgaggacatgaaggaagaagaagaggttcttgtgtctgaa

SEQ ID NO: 40714 - DNA, 292 bp, Zea mays
  unsure at all n locations
  Clone ID: LIB3062-031-Q1-K1-E12
accaccacaataacaactaatatcatcccttctaccaataccattactcctacacctatttcctcacctacaccttcaattactattaccataagtacaataatcatcataatgatcacaatcacaaacaacacctcttccaagccatcaccatctcctccagctccttctcactctacnagaagcactaagcgaataaagacccctagcacactcacaagcacaagatcactgaagatgtctctgccacggcggccgtcgactcctactgctacgtattccactagcacca

SEQ ID NO: 40715 - DNA, 465 bp, Zea mays
  Clone ID: LIB3062-031-Q1-K1-E2
acgcaatcgcgtcccaccgccgctgcacaagacgaggaagaggttcccggtgccggcgccgacactgtgtgggcgatcatgaacgcgctgtgaaactggctgctgaacccgcgccgcaacccgctcgcgcgcctcgacatgaacgccgtgttctcgcgccttacgaaatacgggctgtagtacgatgacctgtacgacccctatttctacctggacatcaaggaggcgctcgggaggctgactagggaggtggtcgacgcccgcatacagcgcctcaagcgcgccatggacctctgcatgaagcatcagtacctacatcgaggacctacaggcacagcaggtcccattcagaggatatttgaatgacatgtcggctatggtgaacaaggaaagcgctgagcgtgaagcactgggagcccttccactttatcagagaacgcttacctaaatcgctggctaaacatg

SEQ ID NO: 40716 - DNA, 436 bp, Zea mays
  Clone ID: LIB3062-031-Q1-K1-E4
acgcccacgcgtccgctcgcactcgcccaacctcgaatgccaagctagcaagagaggcctcgatcgcggaagccagcggcaaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcggtccgagcgccaccaccaactaccccggcgacgtcgttcgagaagcgccgtgcacggccccggctctggctgcgagcgcgagcggcagcaccgagtcgtcgtcgtcgtcgtcgtc

SEQ ID NO: 40717 - DNA, 444 bp, Zea mays
  Clone ID: LIB3062-031-Q1-K1-E5
gacaggcctccgatccagcgcagcacaggtctcaacgcagggtgacgcgaaagaagacggcgcgggagatggcgaaggtgttcagccggctcttcatcaagatcgacatcctgatcctcatgcacatcctcaacgccggccacaaaaccaccattctatacaagctcatgcatcgccacatcgtcaccaccatccccaccatcatcttcaatgttgaaactgatgattacactaacattaacttcactgtctgctacgctgactgtcatgacaagatcagacctatgagcaggcattacttgcagcacacctagcgtctcatccatggtgtgaacagcaatgaccgcaaccatgaccatgaacccagagatgaactccacaatatgctgaacgaggatcagctacatgatgctgtacttgatgcttttgtcaacgagcaagatc

SEQ ID NO: 40718 - DNA, 458 bp, Zea mays
  Clone ID: LIB3062-031-Q1-K1-E6
cggccaatctagcatccgcgcgcggggtctgagagcagagcggcagggcgccatggcggcgtgggtggcgctgagcagcgggcaccggatgccggcggtggggctgggcgtgtggcggatggagaaggcggacatccgcgggctcatccacgcagcgctccgcgtcggctaccgccacctggactgcgccgctgactaccagaacgaagctgaagttggtgacgcgcttgcagaggcattccagaccggactcgtcaagcgggaggacctgttcatcacaaccaagctgtggaactcagaccatgggcatgtgcttgaagcctgcaaggacagcctgaagaagctgcagctagactatctcgacctctacctcatccacttcccggtagccactcggcacaccggagtcggcacgacttctagcgctttgggtgacgatggcgtgctggacatcgaca

SEQ ID NO: 40719 - DNA, 463 bp, Zea mays
  Clone ID: LIB3062-031-Q1-K1-E7
cacacacacacagacaagtggtttccaaagccaagtgtgtgtactagcaaccagctaggtcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccac

SEQ ID NO: 40720 - DNA, 378 bp, Zea mays
  unsure at all n locations
  Clone ID: LIB3062-031-Q1-K1-E9
tccatgctaagacataagtggggaaagcaatacggagaacatcattgcctgcaatcgtacataataataaacaccatgttgtccggctgaaagcctttgctactctgcaatgacntttcacgcgttcattgactgtgttcaatccatgcaagctcaagtcacctgcgccattgtccaccatgtccgacaacatctgccggtgcaacgatgctctaagtagcacgttggtctcctcctcaatgtctccgacctccaacaccaatatcatatgaccgggaatcaaaacactttgtgctaatagtcacaataattgctttcaatatcggacagagtttgttaacaccaaacattttgcaaatgacgacgttgcacaaaata

SEQ ID NO: 40721 - DNA, 387 bp, Zea mays
  Clone ID: LIB3062-031-Q1-K1-F1
gcgctccagcgtcgtccgccgccgccgaaggacggaaggagaagagggtacggccgtctccttgcgggcatgggccacgagaagaagctgtccaacccgatgcgggagatcaaggtgcagaagctcgtcctcaatatctccgtcagggagagcggcgaccgtctcacccgcgccgcaaaggtgctcgagcagctcagcaggcagacccccgtcttctccaaggcgaggtacacggtgcggtcgttcggcatccggcgtaacgagacgatcgcctgctacgtcacggtgaggggctgagaaggccatgcaactgcttgagagccgcctaaaggtcaaggagtaccagctgctcaggaggaacttctgcgacaccgggtgctttggttt

SEQ ID NO: 40722 - DNA, 442 bp, Zea mays
  Clone ID: LIB3062-031-Q1-K1-D5
atggctattattggtctgggactgttgctttttgcattgcttattggaaacatgcaagagtgtgctgcaagctcttggaagaaggaggttggaaatgcaactcaggcgccgtgatgttgaaaagtggatgagccataggcgattgcctgaagatttgagaaggagggttagacgagccgaaaggttcacctgggcagctactcaaggagtgaatgaagaggagcttttgagtaatttacctgaagacatccaaagggacatacgtcgccacttctttagattccttaataaggtccgattattcaccttgatggattggcctatattggatgcaatatgtgacaaattaagacaaaacttgtatattagtggaagtgacattctttaccaaggtggcactgttgaaaagatggtcttcatagtgagagggaagctggaaagc

SEQ ID NO: 40723 - DNA, 389 bp, Zea mays
  unsure at all n locations
  Clone ID: LIB3062-026-Q1-K1-E7
cacgggttgcccggctagaagctcgtctgtttgaagcaaaaggtgaatgggctgaagctgaaagagcctacgcgctgatcctggaaaacaatccatttgaccagattgtccacaagaggaaaattgctatcgcaaaagcacaaggtggtatgtcgatagtgattgattatctcaataagtatctggaattgtttatggctgatcatgatgcttggagagaacttgctgaaacatacagttccttacaaatgtacaagcaagctgccttttgttatgaggagctaatattagcccaaccaactattccactatatcatatagcctacgctgaagttctgtacactatgggtggcttggaaaatctncaaacagctaagaagtattatgca

SEQ ID NO: 40724 - DNA, 212 bp, Zea mays
  unsure at all n locations
  Clone ID: LIB3062-026-Q1-K1-E9
caattgggagggcagctaataaggtaaggggcgacgaaaatggctctaacgaccgcgagcaaggacgacagtggctacggcgacgagcgccggcgcgagctgcacgcgttcgacgacacgaagctgggggtgaaaggcctggtggactcctgcgtcaagtacatcccgtgcatcttncaccaaccgcctgaagccctgagccgacataattt

SEQ ID NO: 40725 - DNA, 204 bp, Zea mays
  Clone ID: LIB3062-026-Q1-K1-F1
tcgccgacgcatgggctggaaaatatgatcacattgatgatatgatacatacgacactttgcttggacgggggaactggtactcagattatgactggtggatttctaactgacaaacaggcatcttatggctggatgttcaatctcaactgatgggcacatttctacacgtatgatgtagggttgcactctggctctacagctt

SEQ ID NO: 40726 - DNA, 399 bp, Zea mays
  Clone ID: LIB3062-026-Q1-K1-F10
aacgaagagggtgtccatggtcaggggccttatcagagaggttgctggctttgctccttatgagaagcgtatcaccgagcttgtgaaggttggcaaggacaagcgcgctctgaagcttgccaagagaaagcttggaactcacaagagggcaaagaagaagagagaggagatgatgggcgtcctcaggaagatgagatcggctggtacgcacactgacaagaagaaataaagcatttcaagttcatgaatgtggcagccagagattatcaactgtgttttttccctacctctagaaactagacatggcaaagtatttttgaccgaaacattggttggtagtaatgtattgaaccacctcgtggtattttgccccaacttccaatgcatcaatggtttgtt

SEQ ID NO: 40727 - DNA, 395 bp, Zea mays
  Clone ID: LIB3062-026-Q1-K1-F12
gtttccgcacatcatatgacactccactatcaacttcagcaatgtgatgcacaccatataagggtacactcatgttggatatgtgctaactcgcaaaagaaactcaggtgcccacacacagtgctaggtttgctattcttcacagttctaatttttagcatttaaccaaagcgcgtttgtctatccttaaaaggagtgtgttttccaatgcttgaacttttgtaataagggtgtgctacatcaaatccagcgtgtttaggatactgctacatacatgaaggtgagctttaggattgtttccttaaagcctcctaaaaattggcattaggaatttttagagatgctgacataccttagatttttctctttttttggggaacattcttgatcaaata

SEQ ID NO: 40728 - DNA, 217 bp, Zea mays
  unsure at all n locations
  Clone ID: LIB3062-026-Q1-K1-F2
cacagctagcccaatcccaaagcaatcttccatggcgccggcgaccttgctactggcgagactggccgtggcgtgcgcgctggcgctcggcgccatggcgcagctgtcgccgacgttctacgacgcgagctgccccagcctgcaagccatcgtgcgggccgggatggccgncgncgtgcagcaggagccgcggatgggggccctcatccttcggcct

SEQ ID NO: 40729 - DNA, 452 bp, Zea mays
  Clone ID: LIB3062-026-Q1-K1-F4
cttcgggatgagcgacacgaggctgtaccataacggccgctactactacgacgtggacgccggcaggtacggctacggccgcgagtcgaaccccatgcggacgcgccccgacgagggagagttcggctccgggtacggccgaccccgcggccccgccggtggcaggcgcggcagtagctacggcgacgcggcgggttaccagcagcggtacggcaacgacgaggagttcggggacggagccatggatcagaacacgaacggcgccttccaggaggaagcaggccaaaacggacgacgatacactccatgagcttgcatcgtgtgtcatgcgtcagagatacactcagtcgtcgtcgtgtgttgctagcgtggttactatcgtgtgctccatctccgagtaatctcccatgggtcgatgcgattgagtacttgtaacttaatcgtgggcagaa

SEQ ID NO: 40730 - DNA, 259 bp, Zea mays
  Clone ID: LIB3062-026-Q1-K1-F5
acgccggcctgatcgagggctacggcaccaagctgcagagggacctcgagggcaagaagacatgggacgacttactagtgcacgtggtcgagccgacggagaagagtggaccacgccgtctggccccggagcctcagctggtacagggaggccaccgaggagtactgccggcgaatgcatcggctgacgcgcgagctgttctagcaactgtcgacggggcctgggctctacgggagccccatggcggacgcattcgggg

SEQ ID NO: 40731 - DNA, 435 bp, Zea mays
  Clone ID: LIB3062-026-Q1-K1-F6
cgacaaaaggcatttgcagaatggattctttacacatctagtggaatttccagtgcattataccattcatgtgatgttggcacttggtgcattctgtcttttcgtgtattgcagtttttggacttctggctttccttcatggctgtcgtgggtacgttcatatatatggctacaattgatgaagtttcaaagagagcaatgcatactgctgtatttatcctcacggctcttttagctgcgactggtgcaacaagatctgcaaatattggaattgttattgccattggttctgttggcctgcttatggggtggctactggagttctctacagcacgaaggtttatatgctggccctcacgaattaaccttaatatgcctcaaagatggccaaaccttagaactttgttccagattactctggagatggtgaacaaa

SEQ ID NO: 40732 - DNA, 423 bp, Zea mays
  Clone ID: LIB3062-026-Q1-K1-F7
caacacccacgccgtgatggagccgttcgtgatcgccaccaaccggcagctcagcgtgacgcaccccgtgcacaagctcctcctgccgcactaccgtgacaccatgaacatcaactccaacgcgcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcgga

SEQ ID NO: 40733 - DNA, 445 bp, Zea mays
  unsure at all n locations
  Clone ID: LIB3062-026-Q1-K1-F8
aactgaagcatcaagtgcagctgcagaatctgaaggagaggatggtgaacatgaatgggaatcattggatacactgaggaagactagacctgataaagagctcaaagaaaagctgagaaagtcaagccagaaagagataactctcaaggatgacattccattgagggatagggctgagctgtatgaaacgtacctgatgttctgcatcactggggagactactaatgtatcatttggaacagctatctctacaaagaaagatgattcagagtttttaatgctaaagcaattgggtgacatacttggtttaactcgcaaagaagctcaagatgttcacattaagtttgcagagaaagcttttgtgcaacaagcggaagtaattcttgctgatgggaaattaacagaggctaaggctgaccagcttgctaagattcanaagcaggtc

SEQ ID NO: 40734 - DNA, 296 bp, Zea mays
  Clone ID: LIB3062-026-Q1-K1-F9
cttgcctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtcttggatgtcgggggtcaaga

SEQ ID NO: 40735 - DNA, 374 bp, Zea mays
  Clone ID: LIB3062-026-Q1-K1-G1
ccagagtctccctggggtggtcggcactagtcgtgaacttgcgatgctgctgtctgtggtcagcgtttccacggcacttaagggtcaacatttaaggaacactccgtcgtgctgaacccaagcactttgattgatggaatgctgaaaaaaaaacatgcgtgtggcccatgaaagcatggcaaggcctcccagaggttgagaacgtgtctccagaaactctgtatcatcttggtatactgatcgatcttggttgaatctaatcttctgttaccgaaaaattctgcggctgtcgggctcgaatctgtagacggctctggcaaggagtcccccgttgctggtttggttaattctttgttgggcgatcgatgaatgct

SEQ ID NO: 40736 - DNA, 419 bp, Zea mays
  Clone ID: LIB3062-026-Q1-K1-G10
gcggatgtgccagaaaagattctttcacaagcacacggaaaagtacgaacagttgtggattttctgtatgagaatgttattgattgcattgacagtgaagctgttgatgatgcatgggctgtggtatcatatttgggtgaggcggattgtcttcttactggtggtccagtcgcatcatacaactcagaaaacatagcacagctcattgctgcctctgttgcggcacggggagttctttttggaaatgctcatgtcacaccatcaaggtggcatacaatccggagcccgaagctctggcaaactggtcaatcatcttgattcaataagggccacattctgaaaggaagatttgattggtcaaagacctgtgggttttggaacttcgctgacttggtcacagaatttaaaccattggagag

SEQ ID NO: 40737 - DNA, 424 bp, Zea mays
  Clone ID: LIB3062-026-Q1-K1-G2
gctggttcgatccaagccctaccaaatcgatggccgacggcggcaactgcgggccgggcggcggcaatgcatcggcgccggtgtgcagtttcgtgaggaaaccacccaagaacatccggaagcgccccgccgcgcccgcggggtctgatgacgacgacgacggcggcggcggcgccctcgccgccgcgcgctccaagaaggggccaccgtcctcaaccgctggcaagctcgttttctccaccgcaggtgcttcctccgaggcgccgcggttccagtacgaatcgtcccggacgatccagtccacggacacccgcgcaactgccacgctcgagacggagacggagtttgaccgcgacgcgcgctccatccgcgagagacagctcaagcaggccgaggagtccctcatgaagaaccccttcgctgt

SEQ ID NO: 40738 - DNA, 159 bp, Zea mays
  Clone ID: LIB3062-026-Q1-K1-G3
gctgggtctctccaacacctaccaaatcattttccttttgctgctactgtcgtccctgcgtgactaatgcatcagcgccgatgcgcaagctcctgagcaaaccacccaataacatcctgaagcaaccccgccgcgcccacggcgtctgacgacgacgac

SEQ ID NO: 40739 - DNA, 200 bp, Zea mays
  Clone ID: LIB3062-026-Q1-K1-G4
aaaaggcaagtgggcagagtcaagcgaaaaccaagcacaagcagtacgaagcacacatgaactcccagcaggaaatgatgcatgcgccaactgaggatattcacaaggccacagaggacaaagaaaagcagcctgagaagcagatgcaggaagagcgctcaaaggccagacgcttcgatgatgatactggaactatgaaa

SEQ ID NO: 40740 - DNA, 439 bp, Zea mays
  unsure at all n locations
  Clone ID: LIB3062-026-Q1-K1-E6
ctgtgacttcgacttcgagccctgtggctactccatgaatgctgttcatggccctgctttgtcgaccattcatgtgaccccagaggacggcttcagctatgcaagctacgaggtcatgggcttcaacccgggctctttctcttatggtgacctggttaagagggtgctgaggtgctttggtccaactgagttctctgttgccgtgaccatcttcggtgatcgggacaatgcgaagacctgngggacgaaactggatgctgaggcctatgcttgcagcaacatggttgagcangtgctgccgtttggtggcttgctcatctatcagagcttcactgttacggncgaaacgacccatgggtcgccgaggtcaggtctgcatgacntcgctggtgacattgtcaagaatcgctcanagagtgatgctccctgggaagctgat

SEQ ID NO: 40741 - DNA, 136 bp, Zea mays
  Clone ID: LIB3062-026-Q1-K1-C9
aagggcgtcccggcgctagggtggtgggggatgctagtcggctccctccgcctcgcctccagctggttcagcttcgtcgacatgtgcgcgctccgcgtcgccgtcttctcgcagactgagatgactgatgttcatg

SEQ ID NO: 40742 - DNA, 269 bp, Zea mays
  Clone ID: LIB3062-026-Q1-K1-D1
acaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaattataccgtgaatgtgg

SEQ ID NO: 40743 - DNA, 413 bp, Zea mays
  Clone ID: LIB3062-026-Q1-K1-D10
gcggggtcataatggagaattggctgaagggaccataaggagcgtggggctggatcccattatggatgtcgtgcaatcaccttgtggctggcctttggaattcgagaagaaacagcaggagatcattgacctgtggcatggatgcaacgtttccttggtccacaggacttactttttcctgctgttcaaaggggacccagccgacgccatttacatggaagtggagcttaggaggttatcgtttctcaagaacacatactccaacggaagcatggggtatgatatggtggcaggcagcttgagcacttctttggtttcaagtgcaaagaaactgcaacgcgagagggagatgctctgcaagcagatgcagaagcggctgacgatccaggaacgggagagcctgtacaccaagt

SEQ ID NO: 40744 - DNA, 391 bp, Zea mays
  unsure at all n locations
  Clone ID: LIB3062-026-Q1-K1-D11
gtggtttgcctacagccttccatggcagggcctgaaagctgggaacaagaaacagaagtatggaaagatcagcgaggggaaagttgctacttcaattgaggctctctgccgtggatatcctaccgaatttgcttcttacttccattactgtcgctcactacgctttgaagatccaccagactatcaatacctgaagagaatgttcaaaaaaccttttattccggaaaggtttcaagttgaatatggttttgaactggacaattctaaagtaccaacatgcccaaataaccacggctccgccacgtgcaattgctccagcagtaggacaaagctctgggatggctcctgtggcaaacaacaatagacattcangcactgaaaagggaaggag

SEQ ID NO: 40745 - DNA, 132 bp, Zea mays
  Clone ID: LIB3062-026-Q1-K1-D12
gcgctaagaacgatcttcattagccggtcaaattttacgctcatcaccagctgctttagcactggtgttttgtaaactatcactgggctcacgattattgaactacagacaaggcagcccgtgacaattttt

SEQ ID NO: 40746 - DNA, 393 bp, Zea mays
  unsure at all n locations
  Clone ID: LIB3062-026-Q1-K1-D2
cgacgccagctgcccagttcttcgccggcgacgagcactccaccagacgagaggggattccgagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttccntcagaaagggcctttgctgatttcgtcctatgcaatctggtgactcacctggtgatcat

SEQ ID NO: 40747 - DNA, 366 bp, Zea mays
  Clone ID: LIB3062-026-Q1-K1-D3
ctacgcggtacgcgcacacagccaaaccattctccccctccgccgcttcgtcgccgcagtacgcaccgggcaagatgaagacgatcctggcgtcggagacgatggacatcccggagggcgtcacggtcacggtggccgccaagctggtcacggtggaggggccccgcggcaagctcacccgcaacttcaagcacctgaacctcgactttcagctgcaagaggccggccgcaagctcaaggtggacgcctggttcggcacccggcgtaccatggctcgcatccggaccggcctcttccaagtgccagaccttatcaagggggtcacccaagggctaccgctacaagatgaggttcgtctacgcccac

SEQ ID NO: 40748 - DNA, 396 bp, Zea mays
  unsure at all n locations
  Clone ID: LIB3062-026-Q1-K1-D4
ggtaaaatgaaacctgaggaggccgttgtagcaaccttatcttccctgccagatgaagttgtcgatacagttgggactgtactgccttctgaagattctgtttcagagaggaagagaaaattggaatttctggagatgcaggaagagcttatcaaggaagaggagaaaaggcaagagaaagaagacaaggcaaaactggaggagccaaaggctactgaagaagatttggctttgaaggaaatgactgagcctactgttagggagaaagaggaactaaagaaagcaaaaacccacgataagaaagagcagctttgtaatatcagtcaagcattggctgtgcttgcatctgtntcttctgttaccaaagagcgancagagtttttaagccctgtcaac

SEQ ID NO: 40749 - DNA, 253 bp, Zea mays
  Clone ID: LIB3062-026-Q1-K1-D5
gcgctacgcggtacgcgcacacagccaaaccattctccctttccggcgcttcgtcgccgcagtaggcaccgggcaagatgaagacgatcctggcgtctgagacgatggacatcccggagggcgtcacggtcacggtggccgccaagctggtcacggtggaggggccccgcggcaagctcacccgcaacttcaagcacctcaacctcgacttccagctgcaggaggccggccgcaagctcaaagtggacgcctg

SEQ ID NO: 40750 - DNA, 410 bp, Zea mays
  Clone ID: LIB3062-026-Q1-K1-D6
cggagtggactactgggcagctccgggttctgcggctgtccccgcagcgcacggcaaagcgccagctggttcagctcgaggagaccaatgggaaaaatacatcctactcaccacagactgtgtttgtatcacgtgcaaattgttcaggatgaaagggagctcaagaagcagaagcggaagcaatccaacagagagtccgctcgcagatcccggctgcgcaaacaggctgagtgcgaggagcttgggcaacgtgctgaggctctgaggtcggagaactcctcgctcagggccgagctcgagcggatcagaaaggagtacgaacagctactttcacagaacgctttccctaagggaaaagcttgggggctgccagtagtgattcgctttctgatatgaacgaacagaacgac

SEQ ID NO: 40751 - DNA, 233 bp, Zea mays
  Clone ID: LIB3062-026-Q1-K1-D7
acgacatccactctcctaggattccctccaccgaggagatcgcagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttggcagcgcgaaatgaaggcggttgatagctccatggtctgat

SEQ ID NO: 40752 - DNA, 376 bp, Zea mays
  unsure at all n locations
  Clone ID: LIB3062-026-Q1-K1-D8
ctacgagccaggagctccttgaggccgtcgaggaagagcggaacgacgtgcaggaaaaccacgcgcgcacaaccaccgttttccgtcacccgctgctcggagatttcgaggtgctgacatatatagatctgatgttcacattcagagtggacagtggaagcttgcttccagtgatggcattggcgtgccagttgccatgccagctgtttctatgcatgattgtgtgctcgatcagtttctgcacagatatgatgcctgatgccaacaccgtttcttcgattccaggtaccggtggatgcagacgacgccgagatcgaggagcggatcatgcagcacctggccgncgncgtcgncattcgccggtcgcaccggcacg

SEQ ID NO: 40753 - DNA, 294 bp, Zea mays
  Clone ID: LIB3062-026-Q1-K1-D9
gtgacactgcaccagaccacccggctccagcgagatccagacccaaaacctcacctcgcagggaacctctgctcggaggggaggggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccactatcggcgtcgagtttgccacccgcagtctccaagtcgacggcaaggtcatc

SEQ ID NO: 40754 - DNA, 415 bp, Zea mays
  Clone ID: LIB3062-026-Q1-K1-E10
gcgaaaatatacaaggaggttaacactttgatggcacatggagacacatcatcgcttcggaaaagtctgacagagaggatgcattgtactataaaaaatgaactaaagagaagacagtccatgtggaattctgtacactgggaactggtggagcctgctgttagtatcagaactttgagggctcgcatgattggcctcgataagaatgacctggataaagcttttatacagcttacacttgagtttgttaccaaaccgaaatttggaagcctttattcaaaaggggccattgtgtctggagaacaatcgaaaggaggacttgggaaagacatttgggtggttgaaaaggcccttttttaacccggagcatattggcctgtatgccgaagaattacactggtaccatatctggttt

SEQ ID NO: 40755 - DNA, 355 bp, Zea mays
  Clone ID: LIB3062-026-Q1-K1-E11
cgacaagtccgacgaggacatgttccagctgatcgccaccgctgcctgcggggactcgctggcgtccaaggcggaggtgttcgcgtgcaccgtcggccgcaagcccagcaaggccaagtactacctcgacgacgcggcggaagtggtgaggctgatgcaagggctctcctacgtctcataagagctggcgcttgcgaaccagcgggatgaagacgaagactcctctttggacgacgtgtgggaataagaaagaaccttccctttccgtgctgcttctgcggtaatgtctggttgtgttgttggctcggctggaactttcgcccaataatttaagggtgtaaatgagggatgcttt

SEQ ID NO: 40756 - DNA, 210 bp, Zea mays
  Clone ID: LIB3062-026-Q1-K1-E2
gacttcgacctctagccctgtttctattccatgaatgctgtaaataaccctgggttggtgaccattgatgtgagcccagacgacggatttagctatgcaagctacgacgtcatgggcttgaacccggactctttctcttatggtgacctccctaagagggtgctgacgtgctttgttccaactgagttctctgttgccgtgaccatcttc

SEQ ID NO: 40757 - DNA, 114 bp, Zea mays
  Clone ID: LIB3062-026-Q1-K1-E3
agcatacagacgaataatctcttcttcacctcactaacaccagctagcaactctttctctcgtgcaataatggccgctcgctcctactgctcccagccgcagctggtcgcggcg

SEQ ID NO: 40758 - DNA, 457 bp, Zea mays
  Clone ID: LIB3062-026-Q1-K1-E4
attcccagcggccggcggcgacctccacgtggtgccattcgccggctacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaagacaatgagcttgaagtccttgagatcatccatcatttcgtcgagatactggaccgctatttttgcagtgtatgtgagttggatttgatattcaattttcataaggcctactacatactggatgagattc

SEQ ID NO: 40759 - DNA, 329 bp, Zea mays
  Clone ID: LIB3062-026-Q1-K1-E5
ggcgcgcatgcagtgggtggcgacgcgaccgagtgcggtggtggtacggcgagcgagcgagcgacacgagctgagtgagtgccctgcaagcccaagctcgtgacagagataggacttcagctcgactcgcgcggtcgccttgcctgctgcacacgagccgtcgccaactcgatcctcaccggtgacccctaccgcagctcatatcatcctgttcttgctcttcatcttactgttaatttcctgccaatttaatcccaccggccatcgttctcctgaaccaaagccatggcgcaagctgcttacggctccagcaagatcgacaccaaagc

SEQ ID NO: 40760 - DNA, 410 bp, Zea mays
  Clone ID: LIB3062-026-Q1-K1-C7
ctgcacctttgcagcaccgctctctcgatcgaatcccaaggaacgaagacgacgacgatggcgtcgtctgcctgcttgctccaagcttccacggccttcgctccacgcttctccctcccgtcccgaccccagcccccgctacacctgcgtctccgcggctcccccaaccgtcgccgtggcatctcactcactgcttcctccgccgcgtccccggaagtcgagaaagagtcctcgccctcgtcctcgccgcaggaatctctgtctgctgtcgcggacagtgtgaaggtgctcaaggtggcagccaagacgaggaaagtacctgccccggaaattctctcggcgctgtccaagatcaagaaggcaaaactcgacacgtcggcattctttgagacactcggtggtaccgagtc

SEQ ID NO: 40761 - DNA, 334 bp, Zea mays
  Clone ID: LIB3062-026-Q1-K1-A6
ctcttttgctcctccgccagcttcatggtggacgacatgcccatcagggacttccgcaacctggagagcaagggggtggcgttccccaagagccagccgatgcggctctactccagcctgtggaacgcggacgactgggcgacgcatggcgggcgcgtcaagaccgactggtcccacgcccccttctccgcctcctaccgcgggttcaaggccgacgcttgcgtcgacgtcacgggcggtcggacccgctgcggcgccaccgtcggcaccgatggcaccggcgcccccgcctacgtcggcggcgccggggactggtacaaccaggaacctgacc

SEQ ID NO: 40762 - DNA, 356 bp, Zea mays
  Clone ID: LIB3062-026-Q1-K1-A7
gatgacttctggtgaggctgtcaagtacaatagctccttggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccaacccagtcaggatctggtcaaggttttggctttcattatgaagaaattaattatttattgaagaaaattttttcaacattccgtttgggccgaaaccttggtcttaaaa

SEQ ID NO: 40763 - DNA, 350 bp, Zea mays
  Clone ID: LIB3062-026-Q1-K1-A8
gaacatgtcagtcccatatttgttggtcgagagatacacagtgaaaaggtaacttggggtagaatttctatggttgatgctgagagaaggttgctggcaaatgctctacaagacatggacaatcagcattttattttgctatctgatagttgtgtacctttgcacaattttgactatgtatatgactacctgatgggtgcaaatctcagttttattgactgcttttatgatcctggaccgcatggaaattttagatattcaaagaatatgttacctgaagtcacagaggctgattttaggaagggttcacagtggttctcagttaaacgccaacatgcgttgatgatcat

SEQ ID NO: 40764 - DNA, 399 bp, Zea mays
  unsure at all n locations
  Clone ID: LIB3062-026-Q1-K1-B1
aatagtctctccaatcttgatcaggatctctcgaattatgcccaacacacggtgcctatatgctctggtcctcaagaatggctgtggtgtgaatcttggtgtggaaatgccacaaaagcaagagcaaagaccattgatctatgcaacaatccaatgacaaaggagccaaagcttcagggtgctagaagaatagttccggagtggactggtcttgacagtgaagcacggcagttcactgcacgaatcttgggtgatgatgtcgagcctgcagatgccacacctncgccatcggaagcaccgaagcctgaagatgatcaggatgtgaaagatgagctatgatcgcaagatgtttccaggcttggtcttactgaatgaaaagttggtgactcgacagtcatc

SEQ ID NO: 40765 - DNA, 336 bp, Zea mays
  Clone ID: LIB3062-026-Q1-K1-B11
cgtcgaccgacctacgcgccacccacccacccactctttaggcttctcgcggcgtccaagcagggagagtgatccgctgggccggcgggctccggaccgcgactctttcgcgccccttcgcagaaggctacatccgtcaccacctactccgacctacaagatcggcgatacgtcgatgtaatgtgaacggcgccgtcacaaagggatgccgcacaagttctaccaccgacgcaccggtcgcgtctggaacgtcaccaagcgcgccatcggcgtcgaagtcaacaagcaattcaatgggcccattatcaggaaacctatccctgtccctattgaaca

SEQ ID NO: 40766 - DNA, 151 bp, Zea mays
  Clone ID: LIB3062-026-Q1-K1-B4
gccgcagcttggatctcgccgtgggccgtgtcgtgtgtttcctcctgctctgctatgtatgtcatcactgacggtgtgtggaggttgggttcatatatatgcttgtaatgttagctggtttgaggtgtggactacgagagtagttttgttc

SEQ ID NO: 40767 - DNA, 430 bp, Zea mays
  unsure at all n locations
  Clone ID: LIB3062-026-Q1-K1-B6
ctcgcgctggccgccgtggcgacggaggtggccgcggcaggaacgacgtacacggtgggcgcgccggacgggctgtgggacatgcagaccgactacgcgcagtgggtgaagagcaagaccttccgccccggcgacaccatcacgttcacgtactcgccggagctgcacgacgtggtggaggtgacgagggccggctacgatgcctgctccagcgccaacaacatctccgccttccgcaccggcaacgacgccgtgcccctcaccgccgtcggcacccgctacttcctctgcggcctcacgggccactgcggcaacggcatgaagatccgcgtcgacgtcgtcgccgccgcggcctcgccgtccgcgccgggccccgncgctgccgncgcggcgccgccgacgacctcgtcgccctgcatcgtcggagtcg

SEQ ID NO: 40768 - DNA, 314 bp, Zea mays
  Clone ID: LIB3062-026-Q1-K1-B8
gagcgaacagagcactgaagcagagcgagcgagctgtccggccaaaccctcacgggcgcctgcacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcagaggccggcggatgggtggcgtggggcctgaaccc

SEQ ID NO: 40769 - DNA, 267 bp, Zea mays
  unsure at all n locations
  Clone ID: LIB3062-026-Q1-K1-B9
cccttgcaagtatagtctcgttttctggttaagacgatgggcaaggacgacgggatcgagagccgcgctggcgggggcgagttcgctgccaangactacacggacccttccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtttgcgtcaggtgccgac

SEQ ID NO: 40770 - DNA, 320 bp, Zea mays
  Clone ID: LIB3062-026-Q1-K1-C1
cgggcaggcaactatgccagtccactgttcctcacagcagctctaacctaatgcattggacaaagttgaatctgagattaaggctattgttgaggcttccaagaagagcccgttgttttctcaattcataaacgacttgtcagtctcaaaatcgaccagggtgaaggctatacccgaaatatttgctgacgctgggttttcagatgttacacagaatctcttggctgtcctgacggacaatggcacgctgaaatatactgaacgcattgcggagagatttgctgatttgactatggaacatatcggggagatcaaagctg

SEQ ID NO: 40771 - DNA, 380 bp, Zea mays
  unsure at all n locations
  Clone ID: LIB3062-026-Q1-K1-C10
acaaaggaacacatggatnccaccttttggattgcaagtccgggcatgacatggaggactactgtgtaacanantacgagtatgtgaagaatcatgagcttggtctctttgccatttttgatggccatttaggagataaggtgccaagttacttgaaagctaacctttttagcaacataatgaaagagcctctcttctggtctaaccctcaataagcaatctagaatgcatactgctctacaaacaagtctattctacaaaataccaaacaacttggaccacctgcttcgacagcagctactgctattgcagttaatcgctaagacatgtggatagcaaatgtatgcgactctccaactgcattgtgtgaaacacgctct

SEQ ID NO: 40772 - DNA, 308 bp, Zea mays
  Clone ID: LIB3062-026-Q1-K1-C11
atcattctgaaaatgaagtcgtctttgggaattggcattcagatattcatctcagtctgccgtctacactaagtggggtaaatgtggcgattcaccacctacattttttgaactatgatctgccattccttcaatgcaaagaagaatctgactgctgtgccaagtcaagtatcgatttttcatttttgtccaatccacgcacataatcatccatattcttgtatacaccgtgcactatgtttacggccaattggttctatgctatgaacgcacattactcctttgttcactgcagctaacaatttaac

SEQ ID NO: 40773 - DNA, 325 bp, Zea mays
  Clone ID: LIB3062-026-Q1-K1-C12
gcgtagcacggtctcctcagacggtcacattttgggcgcagcatcagcagcagaagcagccgtggtcgggaagctcgcgctggtgttcctgttcttcaacgccagctagggaagccagtgcctttcctcctcggcctccttcagcacggcggcgtcctggcagtggccgtcttgcacgcaggcgaggacgcgctccttccggtgcgagatcgtgtccatgcgccacgtcgacaccagcagcatgcgagaggagcacgacgggtacaagacgagcatgaacccagcctacgtcgtccacaactgctactccagctccatatccgac

SEQ ID NO: 40774 - DNA, 306 bp, Zea mays
  Clone ID: LIB3062-026-Q1-K1-C3
gcgctctgcttcacctcactaacaccttctagctactctcactgtactgcaacaatgggcgctgggtcctcctgctcgcaggctcagatcgtcacggccgtggctgtactcgcagcggtgctgctgctgctggcggcgggggtcgagacggcgtttgcggcggtgagcagcggcgaggtgacgtcgtcagtagcgccgtgcctcgggtacgcgatggacatcgcggagacgccctccgcggcgtgctgcaccgaggagcgctcgctgaacagccgcgcgtcgtcaacggcggaccggcaggccacc

SEQ ID NO: 40775 - DNA, 222 bp, Zea mays
  Clone ID: LIB3062-026-Q1-K1-C4
gaggggtgcacaccacttgctggggctgctttctgcttcagatgtgcctcaagaactccaaagtaaggagatcatgcacaacctgcggcagtaccagctacctttgcagcgctatatggccatgatggaccttcacgagaggaacgaaaggctgttctacaagctgctaattgataacatgcaggagctgcttcctgcgggttatacaccaactgtaggtga

SEQ ID NO: 40776 - DNA, 276 bp, Zea mays
  Clone ID: LIB3062-026-Q1-K1-C5
ctctgcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcaaccgggtgcgctcgctcaacagccgcgcg

SEQ ID NO: 40777 - DNA, 334 bp, Zea mays
  Clone ID: LIB3062-026-Q1-K1-A5
accgcgcggcgccggtccctgtcccggtcccggccctggcgcccgccgtgtccgtgcagagctgggccgagcgcgggtactccgttgtcaccgtgcagtgcggcgaccggcccaagctgctgttcgacgtggcgtgcacgctccacgacatggactacgtcgtgttccacggcaccgtggacaccgcggccggccgcgcgcgccaggagttctacatccggcgcgccgactgcagccccatccggtccgaggccgagcgcgaggttctcacccaccggcttcaggcagccatcgagcggaagtcgcttggaggcgtgaggcttgagctgtgcgc

SEQ ID NO: 40778 - DNA, 118 bp, Zea mays
  Clone ID: LIB3062-026-Q1-K1-C6
gaattaccgggagaggagtactgcccccatcatcatctacctcgccaaaggaattgaggcctcgctggatccactcccacggatcataagtcccacgcagatgattagcaatgcaact

SEQ ID NO: 40779 - DNA, 216 bp, Zea mays
  Clone ID: LIB3062-034-Q1-K1-F4
agtcatcactgacagtgtgtagaggttgggttcatatataagcatgtaagttactggttcaggattaacctacagccttgacggcactcccacacactctggaaccagtccatcaacattgatactcatagcttgttctcctataatcattctcctactaaacacatacttttacaatacaagacctatcatagatatttcataaaaaatactcac

SEQ ID NO: 40780 - DNA, 474 bp, Zea mays
  Clone ID: LIB3062-034-Q1-K1-F6
gtacggattagcaccaaaaggcacaagcattgtcctgtacagaaatcatgaaattagaaagcatcagtttgttgctggtactgagtggaccggtggcctttacgtttctcccacaattgctggaagcaggccaggtggattgatagcgggagcttgggctgctatgatgtctctcggactgaacggctacttggacagtacaagccgtatcatggatgtttcaaagaaaatacaaagagggattggagagatcccagggttgtttgtgatagggaaaccggatatgaccgttgtggcgttcggctcagacgttgtcgacatatttgaggtgaacgacataatgtcatcaaaaggttggcatctcaatgctctgcagagacctaacagcttgcatatctgtgtgacccttcaacacacgactgtgtacgaccaattcctgaaggatctgcaagactctgtcaacactgtgaaagc

SEQ ID NO: 40781 - DNA, 422 bp, Zea mays
  Clone ID: LIB3062-034-Q1-K1-F7
cacgccacaaaatcctctcctactccggcagttctgctcgccgccgcctccacgatgacggaggacgtgcagatgaacgactcggagccccagcctgcggcctcagctcccgccgtcggggcgccggcgctctccacactacaccatctgaaggagatcgcgtccgcgatcgaggccggttctctgtccaaggaggtccgacggatctaccgcgccttgcgcctcaccgtcgcgctccgtctccgcctcgccgcgcgggacgtctccggcttcctcgccttcgcgctacccgcgtcctccgaagcctacggacgcctcactgccctggtgcccaaggaagatgatactgagatggatgttgatgctgcagctccagcaactcagatttcaatcaaacatggtcctcctgagattgaaatata

SEQ ID NO: 40782 - DNA, 408 bp, Zea mays
  Clone ID: LIB3062-034-Q1-K1-F8
gtgaaaaatgggccttttgatggcctgctcggattctcccagtcgagcataaagtggagtgttgcaggttatgcatccattcctctttccagggcgcaacactttcggcccttttgataggctaccaagcacagggcaagttgctgagcaatcatccaccaattaagttcatggtctcaatatctgggagcaagttcagagacccaatcatctgtgatgtcgcttacaaagacccgatcaaggtgaaatcagtgcacttcattggagaaaaggactggctcaaggtaccttccgaggagctggcttctgcctttgatgagcctctcatcataaggcatcctcagggtcacactgtccctaagcttgacgacgtgtctgtgaaacagctttctgaatggagctcacacg

SEQ ID NO: 40783 - DNA, 407 bp, Zea mays
  Clone ID: LIB3062-034-Q1-K1-G1
atgctttgaagcctttcatgtgtgatgctcctaagcaggaacccgagcctttacggtactgagccgaaaagaatcacataaattatgacattcctcttgaagtctggattaagccgaaagatcaaaatgacgcatcaattgtcacaaaaactaatttcaagcatctgtattggacgctgacacagcagctagcacaccacaccatcaacggatgcaacatgaggccgggggatatatttgcgactggcacactgagtggacctgaaccggactccctcgggtgcctgctggagctgacatggaacgggcagaaggagataccggtggggagtttgacccgcaagttcctagaagatggagatgaagtcatcttgacagggatttgcaagggtgaaagctacaacatt

SEQ ID NO: 40784 - DNA, 130 bp, Zea mays
  Clone ID: LIB3062-034-Q1-K1-G10
agagagagagagagagagagattgagactcgatccaccgacagaccgtcatgggctgggggctgtacggtatattcatatcacaactcttgagtgtatacacaaacacaaaaccatgacgctcgttatac

SEQ ID NO: 40785 - DNA, 165 bp, Zea mays
  Clone ID: LIB3062-034-Q1-K1-G12
aggctacgacgctcacgcagtacagacaaggacgtggagcttattctaagtatagacctaaagaaagagagttgaagatgagtgtaccttgacatgctgttcacttgttatcggaagacatgtcatctattattaatactgctgattctgaatcttcctcacctg

SEQ ID NO: 40786 - DNA, 326 bp, Zea mays
  Clone ID: LIB3062-034-Q1-K1-G2
acgccgctggccgtggcgccatgggcatcctggaccacatgtcgcatgtatacagcgtgactgggacgaacgaagcgctcaagctcaagaagaagcgaccgctgcagacggtgaacatcaaggtgaagatggactgcgaaggttgcgagcgtcgcgtgaagagcgcggttaattcgatactcggcgtgactagcgtgactgtgaacgctaagcagagcaagtgcacatgaaccggatacgttgagcccggcaaggtgctgcagcgcgtcaaggccaccgacaagaacgccgacatgtgcccctacgtgccctacacgctcaccacc

SEQ ID NO: 40787 - DNA, 339 bp, Zea mays
  Clone ID: LIB3062-034-Q1-K1-G3
cttcgaggggtcctagccgctcctgcgacagctgcggcaagggggacgactactacggcaggtggatcgtgctcacctgcaacggcgtcgaccacgctcacggcggcacgcccaccatggggggattctccgacgtcctggtctcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcgtgcctggcggcctcggccacgtcgccgtcaagttcggcaaggccttcgggatga

SEQ ID NO: 40788 - DNA, 394 bp, Zea mays
  Clone ID: LIB3062-034-Q1-K1-G4
gatcgtcatctacacgagagaggaagtcgtaaggatgaacccaggtgccctgaagtcaaagtctgaagatagtctatctgactcgctgggaagaggggtagcttccagagatccccgaggaggcgggtctacttcggctctcgattccgagaactgctagtttgttcagtcagtgaggcctttggaagtgaagcagacaaaaggcgtgaatcttgcggtgtaaagtgtagttggtacattgtgtgtatgcctgcgggtaagccctgcggtacccagtttgtgtcctggcgccagtttaccatttaagctaagtttttgggtgtgccttgtgctggggtctgggctctagttattgtagcagagcaggcaatgcatgcaagaaactgatgatgcg

SEQ ID NO: 40789 - DNA, 449 bp, Zea mays
  Clone ID: LIB3062-034-Q1-K1-G5
cggcgctttgcggaaacttcttggagagagagagagagagagagacggccccgcagcggcggaagcggagatgggggcgtcggatctagaccggcagatcgagcagctgaagcggtgcgagccgctcacggaggcggaggtcaaggcactgtgcctcaaggccatggagatcctcatcgaggagagtaacgtgcagcgcgtcgacgcccccgtcaccatttgtggagacatacatggacagttctatgacatgaaagagctgttcaaagttggaggtgactgcccaaagacaaactatttgttccttggggattttgttgaccgaggattttattctgttgaaacttttttgcttcttttggctttaaaggttaggtatccagaccgtattaccttaatacgaagaaaccatgagagcagacagatcacacatgtttatggattctatg

SEQ ID NO: 40790 - DNA, 313 bp, Zea mays
  Clone ID: LIB3062-034-Q1-K1-G8
gcgcatagctatttaccaaaatcattttctagcattgctaaacccatgagaccttaagtcacagtctcaatatagtctatgtcactcgctcccaagaggtctaccttccagagatcatccataagtccgctctacttaatctctcgactccgagaactgataacatactcagtcagtacaacctttataactgaaacatacaaaacgccttaatctacctctaaataatgcagatggtacattctatcaatgcactacacttaaccctatcctacccattttgttccctggcaccagtttaccatttaaacta

SEQ ID NO: 40791 - DNA, 364 bp, Zea mays
  unsure at all n locations
  Clone ID: LIB3062-034-Q1-K1-G9
tgtcctggcgtctcccttgccagatccatcgacgcnctgtggccgaccctgccgtcgtgcccgttcgaaggtgcggcagccggcaggcgagcgatttcattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccatanaacttcagatttgggatacctgctgggcaagagcgcttcangacaatcactagcagctactaccgcggagctcatggaatcattatt

SEQ ID NO: 40792 - DNA, 395 bp, Zea mays
  Clone ID: LIB3062-034-Q1-K1-H1
atttacaattctgttaagatttatctataccttactatcaccaaagtcctgttagacctctagggcttgtctaatgattactttaactttctcaataaattcctttcctcattcaaatggtcagatgatgaatcatctacaatttgtgattctaattattatgctttttcttcaatcatctagtttgttaaatcgcctaatctctttcaatgtgatttatctcaacattccttctttttcacatcttgagaaggactaaaattatcatttgttttattaacttcttaatatattcctttctaagaatctttattcctacttattattttaaatttcatacttctactttcttaaatttattaatcttattcatttcttatttttatcctatattt

SEQ ID NO: 40793 - DNA, 205 bp, Zea mays
  Clone ID: LIB3062-034-Q1-K1-H10
gagaaagacaaggaggtggagcttgttcgaagaagaaaccttaagaaagggtgttgaagagtatgttaccttgtcttgatgttcagttgttatcgtttgacatgtcagttattattattattgctgttgctgtatgttcctgttctgtttgtttcacgtgtaggtatggtgttggcaattggagggatattctagataacaatgc

SEQ ID NO: 40794 - DNA, 352 bp, Zea mays
  Clone ID: LIB3062-034-Q1-K1-H11
aagagtcgggactgatgtcggtccagtatatcaatggattccaagccgcatatcaagtggtttgtatgctaaactaatttaacggaggtgaccttgcagagtatgctgaggcatcaaaaaatctaaccgtcaagaggcctgctgacgtatctgctgccgaaggcgcacggctgcccatcgccgacgtcactgccctccaggcgctcaggaccatcgactccaagttcgactgtactgtcaaggccatgaacgttctggtcaccgcggcatcaagtggcgtcggcctctacgccgtgcatctcgcgaaacggactgttctccacgtcactgccacctgcggcgcgcgtaacgt

SEQ ID NO: 40795 - DNA, 449 bp, Zea mays
  Clone ID: LIB3062-034-Q1-K1-F3
ctggttttagcttgcatatcctctgtttaggccagagttgagttgtgttccaactgccaaggtcttgtttgcggaatcgccggcctcgctcaatcgatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcatacagtcttgccatcttaactgatgcggctcaccttctttctgatgtggcagcatttgccatatccgtattctctctctgggcttctggatgggaagcaacaccgcatcattcata

SEQ ID NO: 40796 - DNA, 237 bp, Zea mays
  Clone ID: LIB3062-034-Q1-K1-D3
ctcatccctgacccccgtaccgcatcgtaaaccctagtccccggcggcgaccttgggtcctgcgcttctctctgactggtgcgcgcttagacgaggagctgcggcgtccaagaccaatcgaccatggctacccgtatccagtttgagaacaactgtacaaattgggttttctcccatctgactaatgcttactgtctggtaacgattggagggtcatagaacttttacagtgccttt

SEQ ID NO: 40797 - DNA, 445 bp, Zea mays
  Clone ID: LIB3062-034-Q1-K1-D4
cgcgcaaccgagcgcctctgtggcggtggcaacagccgtggtccacgcgcctccggcacgggcaacggaggaggaggagggcaatgcagagaaggagcaagaacatgatgagtctgctattagcttggacgaggcctacgcgctagcccatcgccatcgcacgaagccgctggcgtcgccgccgccgtcagcagcagcctctgccaccgctgcgttgccgacggagcacaagaaggtggtggcggactggcggagggtacccaaagcaggggaggcgcttgaggggaaggcggagttgaacgcgcgcgcagacctgttcatccggcagttccgcgaggaactcaagcttgagaggctcaactccgtcctcaaccacacccacgcccttggctccccaacggcggcgctgtaaccggtgtgctccattgttcacatgggcattttt

SEQ ID NO: 40798 - DNA, 351 bp, Zea mays
  Clone ID: LIB3062-034-Q1-K1-D7
aattcccgggaaaatctttgtgcaacggctaaccgactgcggagaagagcatcttctgccgtttccttctgcacgtctaccccgggaggaactgtgtccactgagatgtggcttgacagccagaaagtgcactaccaaacgaaggccaatgatcggaaccgagctgtcctctctggatatgtgttgctccagcacatcccctcgtcattgtaagtaaaagttttgtttcttaaaattggtgcccgctgaaagcattttgcttggctgtgataaattgagcacgaggtgttctgccactgtaatgatagccatgtatgggtctgcacataacacattcgtactgtattgata

SEQ ID NO: 40799 - DNA, 344 bp, Zea mays
  Clone ID: LIB3062-034-Q1-K1-D9
ctgggaatcagttggtcaccccggccacacgaaacttcacctacacacgcacggagccaaaaacaaatgcgggagcgatttcatgactgatcagctgtagcatgccgcagcgtcgcagaaagagatcgtgattgatgactgtttcgtagtccattcagctgcttttggtaaatatttaagtagctgcagatcttagtttgtagcaggctggtttttgtggacctcaaccttgagtaatattctgtgaggttttctgtgctgatttttcaccgtcagcacacccgttgttctgctggctgttcggagttcgtggatagagggtaaaatatataaaaagtagtttt

SEQ ID NO: 40800 - DNA, 365 bp, Zea mays
  Clone ID: LIB3062-034-Q1-K1-E1
agctgacgcttgggcggacgcttggttcgaactccaaagtgaatttccattctaccggatccagttctcacctcaatctggcgagaagcgaagccggacgaggagggtgcgaggagatcgcgagcagccggagccggtgcctgatccggacgcctagtagatgaagaccttcgatccgtggccgttcttcttccgccaggagtggtagcgcaattggcccttcctcacggggatctgcatcacctgcttcatcatcactaagatgacggccaacttcaccgatgatgaccttatgaactccaaattcgtccaggagcacactaagctctgaccaaccaggtgtcgcccgaattgcctgtctggac

SEQ ID NO: 40801 - DNA, 312 bp, Zea mays
  Clone ID: LIB3062-034-Q1-K1-E10
aggcactgtcacaaaggggggttactctactcacattctagaccatgaaaggtatcgggtcaaagtacccgacggctaacctttgtcaaaagcagcacctcttctgcgtgctggaataaccgcgtatactccaatgatgcgactcaacattaaccaacctggatagtcactttcattcattgctattacacctctacttcatatgtcatggacaactggtcaagcattatctcttcaggtaacacctctcagtactagtgaatcacaaagcgatggatccaccaatctacgatgcgcacatagtattgacta

SEQ ID NO: 40802 - DNA, 167 bp, Zea mays
  Clone ID: LIB3062-034-Q1-K1-E12
ggaattacccactcgacccaagcaaccaacgaactcttgctccgattactagctatcttacgtcgacaatcgcatgggtactagtaagcatgaagacgccgaacgcggtagctgccttcctgttgtcagcgacactgctagcttgatccacttcagctgcaatcacc

SEQ ID NO: 40803 - DNA, 411 bp, Zea mays
  Clone ID: LIB3062-034-Q1-K1-E3
ctcaagttccccaggaagttctggcctgaatggaaaggaagggagttcttcctctgctcgggcagcaggagaggttactacggagtgtggcaggagttcgagaagcagtaccctgacgccaatgtcctcctggtcaccgtgaccgacgaggagtcgaggcgcatcgagcagcagtcggacgagcagaccaaggcggagatcatgcaggtgctgcggaagatgttccccggcaatggacgtcccggacgccaccgacatccttgtcccgagatggtggtccgacaggttctacaagggctccttctccaactggccagttggcgtctaccgctacgaatacgaccagcttaaggcaccggttgggagggtatacttcaccggtgagcacaccatcgagcactacaatggcta

SEQ ID NO: 40804 - DNA, 322 bp, Zea mays
  Clone ID: LIB3062-034-Q1-K1-E4
acggccagtgcgcgcacccaccgccgccacggtccagatctcccatccaaactgctggggccagcatcaagagcgcgggtgctacggcgaccgatactcgtctgacacagctggtggttgcctttgcgactatcacacacctaatccatctgctgctctcctggctataccgcttcacaacccagcgcgcgctcatcgatatccctctgatattattgcccaagcttacaccagagcggatgcgcacggcatgtccattgatcactcgctagctgtcgctctaatgagctactatcctattataccgtgacttgcgacatct

SEQ ID NO: 40805 - DNA, 431 bp, Zea mays
  Clone ID: LIB3062-034-Q1-K1-E5
ctagaagtcttgattaagcctaaagatcaaaatgttgcactaattgtcacaaaaactaatggcaagcgtctgtattggacggtgactcagcagctaacacaccacactatcaatggatgcaacatgaggccgggggatatatttgcaactggcacactcagtggacctgaaccggactccctcggatgtctattggagctaacatggaacgggcagaaggagataccagtgggcaatttgacccgcaagtttctagaagatggagatgaggtcatcttgacaggatgctgcaagggtgaaggctacaacattgggtttggaacttgcacttggaaggtcctgccggcacttacctgagccaacacgtgtttacatcaattctcgagtccaaacactcaacaatctaacaagatgctatgtatctgaacaac

SEQ ID NO: 40806 - DNA, 460 bp, Zea mays
  unsure at all n locations
  Clone ID: LIB3062-034-Q1-K1-E6
ggcaatttaaatcttgaacacttgccacaggattatagtggatccgcgttgacactggttgagtcagttatcaagtcttgttgtcttaggtaacctcacagagtttgagagaggagttctctggctttcagaaaatctgacatttgatgttgatgctcggattaatctttttgagtgtaacataagacttcttggggggcttatttctgctcatattcttgcaaaagactacagcagccagtttaagcatgggctgtatcaagatcaattactacgtcttgctgaaagtttaggcaatcgttttctaccggcatttgagacacctactggattgccgtattcatggattaatcttaagtatggggtgatggaaaatgaaacaactgaaacaagcacatcanggtgtggctcccttatacttgaaatgggtgtgttgtcacgnttgacttgtgattctaga

SEQ ID NO: 40807 - DNA, 450 bp, Zea mays
  unsure at all n locations
  Clone ID: LIB3062-034-Q1-K1-E8
cgccaaaaccccccgagccaacacctactacgccgccgcgccgccgcgtcaaacaacggcgagagggcgcctatggcattcacttcccaatccctaatcttccgggcacccgcctcgccctcttgtgcccgcataaccccgtcatccggtcgcgtcaccctccgggaccacagcgccgttttcccgctcgtcgcggcggcctccacctcgatggcgtcctcggagagcgaagataagagggaaaccaagctgtggggcgggcggttcgaggagggcgtcaccgacgccgtggagcgcttcacggagtccatatcctacgactggcagctctacaaatacgacataatgggcagcaaggcccacgcctccatgctcgctggccagggtttgataacagctactgatagggatatcatcttagaggggctngatcagatagagaggctgatc

SEQ ID NO: 40808 - DNA, 396 bp, Zea mays
  Clone ID: LIB3062-034-Q1-K1-F1
agaggatcgatctgctggcggcgtctaagctggagaaaggcggcgccaccgccgagggcggcgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtgatcgccgagggccacgagaggggttgctactgggtgcacgcctggaccgagggacccgatggggtgatca

SEQ ID NO: 40809 - DNA, 215 bp, Zea mays
  unsure at all n locations
  Clone ID: LIB3062-034-Q1-K1-F10
gttgaccgcttgctagaagacggctcattggatgataatgttgaatgggttctatcgcangatgacatggatcctagggacaacttgagtcgatccatggatgctagtaaagggtttggaacttccgatggtgccaaagcacgttcaagcacatccaaatttttctgctgccacttctcacctgatggtaaactgcatgctactggaagtccata

SEQ ID NO: 40810 - DNA, 196 bp, Zea mays
  Clone ID: LIB3062-034-Q1-K1-F11
gaggagcacaggaagctcctgtacgggctaaggcatctggacaaggctcacgtggatgtcatcttcaaaggcttcgtcaccaccacgacatccacccatgtggccagccacccccagaaatactttctattgcagacccacccccggatgaaaaaacgcccttctagcctattctacttttgtatcacagactaca

SEQ ID NO: 40811 - DNA, 143 bp, Zea mays
  Clone ID: LIB3062-034-Q1-K1-F12
ccgagccttacggtcctcgcccgcagctggcagcaggtcgcccgctgccgcgcctgggacatgggaggccatcgaggagctcgacgagctcgcctggctccatacctccttcatcaaactcgacgagcccatcaagaccatcc

SEQ ID NO: 40812 - DNA, 421 bp, Zea mays
  Clone ID: LIB3062-034-Q1-K1-F2
aagatcggcaaggctggacaagagacccacgatgcctccacagagtttgacaggggcgagggggacatcactcccatgggtggcttcccccactatggtatcgtgaagggtgactacctgatgatcaagggatgctgcgtgggtccaaagaagagggtggtgaccctccgccagtccctcctgaagcagacttcccggctggcgctggaggagatcaagctcaagttcatcgacacatcgtccaaatttgggcatggtcgcttccaaactaccgatgagaagcagaggttctttggtaagctcaaggcgtaaggtgctgcagtgcatcgacaagtcccatttgtcaaaatcatcaaactgtgaaactcttgcttgttaccttgctgtaccaagttttgtagcatgatgatttgggagcatg

SEQ ID NO: 40813 - DNA, 383 bp, Zea mays
  Clone ID: LIB3062-034-Q1-K1-D2
gtgttggtgcaaacaatgagatcgcagatgttgatcggttaccgttggccgtgagggagttgggaagctgtgacctttatccacaaagtttaaggcacaatccgaatgggagatttgtagttgtatgtagtgatggagaatacataatatacacagcacttagcatggataaacagatcatttgggtctgcacttgaattcgtttggtcaactgatggagaatatgccatcagagaaagcacctcgcggataaagatatacagtgaacatatccaggagaagaaaagtataaagccatcctttttcgctgaacggatatctggtggagtgttacttgctatgtgtacaaatgactacatctgcttctatgattgggctgaatg

SEQ ID NO: 40814 - DNA, 77 bp, Zea mays
  Clone ID: LIB3062-034-Q1-K1-B3
aattcccgggcgtgaggcttcaatgtcatacgtttggattaagccactctgtgatcctctcattcaagctgatccca

SEQ ID NO: 40815 - DNA, 262 bp, Zea mays
  Clone ID: LIB3062-034-Q1-K1-B4
acccataatcgtgatgcctactgccggaattatacaatccacatgtccgttacattgcagctctatctgtctgtatctcctgctcctgatcaggattaaacgaatccatctgcttactgaatcctctgacatcagacctcctagactttttacgacaggacgcactcatcttcatgacaattgtcatgatccataccaactagtcctacgatccacgcattggagcattcatgcaccagttggaaaatattatcctcttaca

SEQ ID NO: 40816 - DNA, 439 bp, Zea mays
  Clone ID: LIB3062-034-Q1-K1-B5
ggaacatacaccaagttcgattggagaggcgtcgctcctcgagacacctacatcgcgaatctcctcaaggacttgaagggtgcgctgacagcgtccaaggctccctggaagatcgtcgtgggtcaccaccccatcagcaccgcctgcgggcatgggaacaacactgagctggaggagttgcttctcccggtcctcaggacacacggggttgacatgtacttgaatggccatgaccactgccttcagcgcgtcagcagcagagacagtcgtcttcagctactaaccagcggcggcgggtccaaggcatgggctggcaagttcaagcccaccctcgacaaagtggagttcctctacgacggccatgggttcatgtcgatgcgcctgagcaggacggaagcccgcctcgcgttcttcgacgtcgctggcagcgtcctgcact

SEQ ID NO: 40817 - DNA, 452 bp, Zea mays
  unsure at all n locations
  Clone ID: LIB3062-034-Q1-K1-B6
ccagcttctgcattttgcggtgtcggacgtgagcgatgacgtgcggaggaccgctgtgttggctctgggcttcgttctctacaacgagcctgaacagacacccagaatcgtgtccctactgtcggaatcatacaatccacatgtccgttacggtgcagctctagctgtcgggatctcctgcgccggaacaggattaagtgaagccatctccttactggagcctctgacatcagacgtcgtcgactttgtacggcagggcgcgctcatcgccatggcaatggtgatgatccagaccaacgagtcctacgatccacgcgttggagcattcatgcgccagttggaaaagataatcctcgacaagcacgaggatgccatgagcaagatgggcgccatactggctttaggcatnctcgacgccagtggcaggaatgtcaccatcaagctcaagtcga

SEQ ID NO: 40818 - DNA, 429 bp, Zea mays
  Clone ID: LIB3062-034-Q1-K1-B8
cgacggagaagaaggacgacgcggtggtgcagccgcagaccttcccgcccttcgaccgcctgggcgggggcgcgtccccggcgttcggcggcctccccggcggcagcattcctggcagcagcattcccgggttcagcatgcccggcagcggcagcagccttcccgggttcagcttgcccggcagcggcagcatgcccctcttcggcggcggctccccgggcttcagcggcttcggcggcatgcccgggtcccccaccgccggctccgtccccgagcacgccaacaagccctgaactccgtctgtccgtccgatccgtcgctggagcgaggtcgggctagccagcgtgcgtggtagtagagtgatggtactgtaatacgtcgtcgtcttcatgcatgcgtgtgtcgtgggtttccctagctccatacgag

SEQ ID NO: 40819 - DNA, 384 bp, Zea mays
  Clone ID: LIB3062-034-Q1-K1-B9
ggctcgtaccaagcagactgctcgcaagtccacgggagggaaggctcccaggaagcaggttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaagcataccttgttggcctgtttgaggacaccaacctgtgcgccatccatgctaagcgtgtgaccatcatgccaaaggacattcagctggcaag

SEQ ID NO: 40820 - DNA, 430 bp, Zea mays
  Clone ID: LIB3062-034-Q1-K1-C1
tggggttgttcttattcctgagggtctggtggagagtattcctgaactatatgctctgctgcaggaaatccatggcctccatggcaaaggtgtttctgttgagaatatctcttctcagctttcaccctgggcatctgcactctttgagtttttgcccccttttatcaggaagcagctacttctccatcctgaatctgatgattcagctcaactttctcagattgagacagagaagcttctagcccagttagttgagactgagatgaacagacgtttgaaggagggcacttacaaaggaaagaagtttaatgcaatctgtcacttctttggctaccaagctaggggagcactgccttccaagtttgactgcgattatgcctatgtcttggggcatgtgtgctaccacatcttaactgccggtttgaacggt

SEQ ID NO: 40821 - DNA, 52 bp, Zea mays
  Clone ID: LIB3062-034-Q1-K1-C10
ggaactacccactcgtcccagcatgcgaaatcactaagatcactatacctct

SEQ ID NO: 40822 - DNA, 413 bp, Zea mays
  unsure at all n locations
  Clone ID: LIB3062-034-Q1-K1-C11
cgcaccgcgcctgtccaccctgccagcgccgacgccgcgccgtctcagcaactgtcaccgtcgctatggcccgtatcaaggtgcacgagctccgggggaagagcaagacggacctgcaagcgcagctcaaggagctgaagtctgagctctccctcctccgcgtagccaaggtcaccggcggcgcacccaacaagctctccaagatcaaagtggtgcgcacctctatcgcgcgcgtgctcacagtgatctcgcagaagcagaagtcggcgttgcgggaggcgtacaagaagaagaacctgctccccctcgacctnncgcctaagaagacccgtgccattcgncgtcgtctgaccaagcaccagctttctctgaagacggagagggaaaagaagcgtgagaagtactttcccatg

SEQ ID NO: 40823 - DNA, 267 bp, Zea mays
  Clone ID: LIB3062-034-Q1-K1-C12
ctgcgcctctacatttcttctctctctgctcctccgtctccgcctgatccatccaaggcagggatggccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacata

SEQ ID NO: 40824 - DNA, 428 bp, Zea mays
  Clone ID: LIB3062-034-Q1-K1-C4
cttggatgtttctgaaaaggcggaccttgtgtcagacagttctttcatttgtttggcctagttttgcactggcagtctgcttatttccagtttacccataccaatgcaagattgttgtactgtactcatgtgctggagctctacttttcattgtctccattcttttgctaagagctgccatctttggcatcttatgggttctccttgggaaacgcgtgtggttcttccccaatataaatgcagaggagacaacatttagagaactggttcgtttttggcctgaaaaagatgaaggagagcggccaaagtggacatcaagacttttctatgctcttgttgctctattggtgatattactgcttatgcaccatgctccggacgaagcaactagagccaggtaccaaaagaaggtttctaacataattgat

SEQ ID NO: 40825 - DNA, 430 bp, Zea mays
  Clone ID: LIB3062-034-Q1-K1-C6
gagggcatgaacggcaaggagctcgacggccgcaacatcaccgttaacgaggcccagtccggcggcggccgtggaggcggcggtggcggatacggtggcgggcgccgtgatggaggcggctacagcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgatgttgcccatctgtggttttgaccgtaagctcgctcctctgatgttggtagtgatgtctaa

SEQ ID NO: 40826 - DNA, 429 bp, Zea mays
  Clone ID: LIB3062-034-Q1-K1-C7
ctccgccactgatctgctctgttgctggtgactaggagcagtagcgagagggattctggagggccgagtcgaagaaccacacggcgcataaccaatcgttcaaggcgcacaagaacggcatcaagaagcccaagcgccaccgccagacctccaccaaggggatggacccgaagtttctgaggaacttgaggtactcaaggaagggcaacaagaagagtggcgaggctgattccgaggagtaagatgatggtgattgagtttgtggcgacaaatgcatctcttgtatcgctaagagtcttatctgtgaacttagttctcacttttgtgtgactgtgatcaaaggagatccatcaattggtaccgaagtgtattttatgtcttgttggttacctggaaattaattaaaaccatcagttgtatccttttgag

SEQ ID NO: 40827 - DNA, 444 bp, Zea mays
  unsure at all n locations
  Clone ID: LIB3062-034-Q1-K1-C8
cggacgcgtgggtatttatgatgagtgtgcgtctgttttatatcaggaaatagactatatggaggaggcatttaacgctgaaaaatttgctgaaaacttcaaaaaattggattatgtgaaggttcctgaaatttactgggcacacactactcctcaggttttaacaatggaatatgtcccaggaattaaaattaacagaataaagcagttagataagttaggagtcgatagaaaaagattaggtcgttatgctgttgagtcctaccttgagcagatcttatcccatgggtttttccatgctgacccgcatccaggaaacattgcntgtgatgatgtcaatggagggagacttatcttctatgacttncggatgatgggaagtatcagtcataatatccgggaaggattgcttgaagnatctatggagtttatgaaaaggatcct

SEQ ID NO: 40828 - DNA, 396 bp, Zea mays
  unsure at all n locations
  Clone ID: LIB3062-034-Q1-K1-C9
cttactcctgcgtctccatcttggcccaaccgagcccaaacctctccccttttctccggcctctggtagtccacacggcagacgccgtcgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccaagtcctcgagcgccttcccgacggcggcgccgacagccacgtctactacacgcaggaccgctacgtgttccacgccaagcgcaccgacggcatcaccgcgctctgcatggccgacgacgccgncggaagaccgattcccttcgcatttttggaggatattcat

SEQ ID NO: 40829 - DNA, 342 bp, Zea mays
  unsure at all n locations
  Clone ID: LIB3062-034-Q1-K1-D10
cggacgcgtgggccggacgacgggtacaagaagctgtacggcacggggtcgctggagggggcgtccatagagcagtggctgcaggcggaggcgcagagcttcgacgcgccgagctcggagctggcgttccagctggcgttcgcgccgcacctcaaggacgtgcgccccgacgaggcccgcgtcgccgagaacgagaagaagctgcacagcatgctgggcgtctacgacgacatcctctccaagaacgagtacctcgccggcgacgacttcacactggccgacctntcccacctggcaaactcccactacatcgtcaaactcctcgacaggggcaggaaagct

SEQ ID NO: 40830 - DNA, 314 bp, Zea mays
  Clone ID: LIB3062-034-Q1-K1-D11
gcgcagagcctgattcatctccattcgaaacaccctatcacccacactctcacttcgtccgcagcctgaatcctcgtaacgatggctcgcacgaagcatactgcgcgcaagtccacgggcggcaaggcccctatgaagcagctgtcgaccaaggcggcgcgcaagtcagcccctgcgaccgtcgtgctaaagaatcctgaccgtttccgtccgcgcaccgtggcgctgctctagatccgcaagtaccacaatagcactgagcttctcatccgcaagctgtcctttcagcgcctggtccgcgagatcgcgcagga

SEQ ID NO: 40831 - DNA, 296 bp, Zea mays
  Clone ID: LIB3062-034-Q1-K1-D12
tcccgaatcgacgcaagcgcacgaatactgtgtgcgtatagcagactaaagtccaaagggccaggatgctcgggcaactcatgtaaagcgcttcaaaaatatgccaatggcagacatggagttggctctgcctgagaagaaaaacccgagcctcacacctatggactgggttcaatttattgtctctgttgtcattggacttgttacactcatcacttcactggacatgcctaaagctgatttctgagttgtaattgcaatactatctgcacttgcatgatattgcgcgaagatct

SEQ ID NO: 40832 - DNA, 389 bp, Zea mays
  Clone ID: LIB3062-034-Q1-K1-B2
cacacgaatgccgacctgatcaagttagaactgactgcactgttcagatattggcgccagtgcaatctcgatacatgccctaatccatccatggagccattagttgatgctgttcaaaggcacttcacggcccaccaattggatgagttgcatgtcattgtcagctttttgcaagctgcaaagaagctgaagacaactatgaaagtggcctgacagtgaagcatgaagttcaactaacagattcaagataggatgcagcatgtttgatgaatgttgccgtgctatgtaatatatatgcatgaagttcttcagattcaagtagtaatggacaactagactatgttaacctcatctgatgtatatattcagtatcccgtctaaagatgttt

SEQ ID NO: 40833 - DNA, 190 bp, Zea mays
  Clone ID: LIB3062-029-Q1-K1-B9
tcggtcacaagccaaccatagtctcgtttctagccaagctaatcaagttaggggtagagactcattccagggctggttggctcctactaatgcagctgactacacatcaggctacattcctagttcggagcactcatccatgtccattgccggcactctcctacacattctcagactactctctcgatag

SEQ ID NO: 40834 - DNA, 388 bp, Zea mays
  Clone ID: LIB3062-029-Q1-K1-C1
gcacatgataattataggagtaaattgaatacttgctgtttggactgtgttcagttttagtgtgcaggtagtttagtgaagtaaaccatgttttctgtagaaatgttatataggaaagttgtagatcacttctttatcttgcttgtgtataaatttcatgaccacaggtttagtagtttaggagttatgatttttccaagtacagtatacgaatctatccagattctgtacagatttcgaaaactgtcttgtttgattaagttaaacttagaatcagttcttagtaattataaagaagttgtagtacttttcttaagctttccaaaaaatttggatcaccctttttggggatctataaattaagttagtgcttgttgagttaggatct

SEQ ID NO: 40835 - DNA, 346 bp, Zea mays
  Clone ID: LIB3062-029-Q1-K1-C10
taggaactcatcaattacctaataaattttgcaacttctgaatgagtaatacggcttagtcataatactacatgccagaatattatgcattatactctcacaaactttgcctgttctaaagcggcttctgaggtcatcttacaaaccccagttagctacaacaagcatatcaccactcctagccacacagctaacatgatcaacctttcaaccaaaattattagccaagatcatctaattcatgtgatgcctacaatagcaaactcatatgcttctattactgcctacaaattccacttcctttgatcatatatcagtgatgatgacatcttcagctcatatctaa

SEQ ID NO: 40836 - DNA, 317 bp, Zea mays
  Clone ID: LIB3062-029-Q1-K1-C11
gcacaccaaggagagtacgtggaggagcagccatggcttcatcggtggccgccgcggggagcacattcctgggcacccgcctggcggacccggcgccacataacggtcgcatcgtggcccggttcgggttcgggttgtgcggcaaggcgaagcctgctccgaagaaggtggcgaagacatcgacctcctctgaccggccgctgtggttcccctgcgccgtggctcccgactacctggacggctcgctggtcggctactacgggttcgacccgatcggtctcggttagcccgtggagtacctgcagtacgagttggac

SEQ ID NO: 40837 - DNA, 209 bp, Zea mays
  Clone ID: LIB3062-029-Q1-K1-C12
taacaaccaatgacagcacatcaagtactagaaataactttataaaaaatctggctagggagcataatccaagactcacgaactaaaaaaaaagccgcaatattactgcctcatctttttccagatcgatgtcaccttcagcagcaaatcagatcaatgcatgaaaagaatgtcagctaatacatatgacatactctaacaggccatta

SEQ ID NO: 40838 - DNA, 170 bp, Zea mays
  Clone ID: LIB3062-029-Q1-K1-C2
attcccattcgccgacgcctccctcacacgatacttataataatacattcaattcttacttccactactgtcttcagttatatagtgcccgtaccttaattcagtgaaccatagttttcaacctacatattacatcggaaatgtgaccatcactcccaaatcttccttat

SEQ ID NO: 40839 - DNA, 441 bp, Zea mays
  Clone ID: LIB3062-029-Q1-K1-C4
agatcttcttcatcgcctggtcaccggcggcgtcgaggatacgggccaagatcctgtactcgacttcgaatcagggcctgcggcggctgctgtactgggtccactacgaggtgcaggccacctacccctacgagatgggcttcgacgtcatcagaggccgttcgcaatgagcgtgatctgcgtatgtgtgatgagctgagcctcccgatgatgcctgtcggtctgacgaggcttctcgtgtgttcgctttaccccccagttttaccaccggttattcctagagatggtgcagtgcaacgtcttcgtgtgctgatgcttatggttggagttaccgggttagaatgcttattgagtggcagccgattaattgaacgtacagcttcgcgacgtacaattccactgattcttgaattatatttaattgatgaaatagatgccatt

SEQ ID NO: 40840 - DNA, 288 bp, Zea mays
  Clone ID: LIB3062-029-Q1-K1-C5
aaagaaaagagctcccaagttgaacccgctgaagcagcacaaaatccttctgatcgagctgccacttgcgttcctgcataccaagaagttggtggtgctagtgcctcgcaaagtgccattgaggcccagaaagctactgctgcggcatctcagctcactcgcagtggttcatcaagggcaatggaaaatgcacaggacggctgggagaggaagtaacgagatagagttcgttttttttttatcgtctatgcctacatcttatggatgcatatgatcctgcctgacgat

SEQ ID NO: 40841 - DNA, 336 bp, Zea mays
  Clone ID: LIB3062-029-Q1-K1-C6
agacagcgtatgattgctccattccgttagcaccactagttgctgatgttatatgttgccggcaagttaatagcttgatgaatattttccaagctgcatatggcagtggaaatggtaccctagttctcaatcaggcttcagcaaatgcttgtttctctgacattatgaacatccttgcaagcaaaggggcaaacaccaacatccctgagttatgtactctgaggccatcaaatcttactgatgtttcttgtactgtgaaggatattagctcttttgagaaaatagtcaacatcagtaaactccaagatgcatgcagcaatgttgacccactgaaag

SEQ ID NO: 40842 - DNA, 237 bp, Zea mays
  Clone ID: LIB3062-029-Q1-K1-C7
agacagcttatgattgctccatttctatagctccactagatgctgatattatatgggtcccgcaatatcataacttgatacatgcattccaatctgcatattacagctgtaaatgttactctacgctatgaatcatatcgtcaacataatgcttgaaaactctcacattatgaacatccttgcatgcaaaggatcaaacaccatcattccttaattatatactctttaaccatcaaa

SEQ ID NO: 40843 - DNA, 390 bp, Zea mays
  unsure at all n locations
  Clone ID: LIB3062-029-Q1-K1-C9
agcaactcatcagttacctaataaataaggaaaattctgaaggagtaatatggcttggtcatagtactggatgccaggatattgtgcattatatgcgcacaaactttgcctgttcgaaagcggtttctggggtcatcttgcaggccccagtaagtgacagggagtatagagcaactgtctcggaaacagctgaaatgatagacctggcagccaaactgattagcgagggtcgtggaatggatttgatgcctagaaaagcaaactcagatgctcctattactgcctacaggtaccactccctttgttcatatatgggtgatgatgacatgttcagttcagatctaagtgaagatcagctgangcagagacttggtcatatgtcaatcacac

SEQ ID NO: 40844 - DNA, 334 bp, Zea mays
  Clone ID: LIB3062-029-Q1-K1-D1
gtgatgcgctgtgtcaagaactgctccaggctagggcgaaccttgagtttgagaagaaggcgaagccagagctgactgcgcaggttcaggcaatggagaaggatcttgtggctatggctcaggaggcggagaagctgagggctgatatcgcgaagagaaacacacctactagtttcagcagccgtggaacgtatggagcctcgttgtcgactcctgggatgggtttgcaaggcatgtatgatggcggcggctattctatggctgggagccgctacggcagtggcactggggcttggagctcgcacgatccccatggctacccgcatctttaact

SEQ ID NO: 40845 - DNA, 394 bp, Zea mays
  Clone ID: LIB3062-029-Q1-K1-D10
gcaaaggtttgccagtgttctcacttctgcacctgcggggaggaagtgggtgtcagaggagcttgctgtggtggctgagtcaaaggaggttgctggggatatgatcactgaaactgtgcttgatcacgttcttggtgagaagacgttcgagaaatttggaaagtggttcatctcgcttcatttttcggaccagttggcaggatcctacaagaaggtccttacattcaagtttgtattgccagatgcaagcaacatgtcagagatgacaagattggtttctcttgtgccatactacattgatttggcagggcgttataagctcaagtctcatgctcgctctaaaactgatggagctagaacgaaggctgctcatgaagctattagggaactacag

SEQ ID NO: 40846 - DNA, 369 bp, Zea mays
  Clone ID: LIB3062-029-Q1-K1-D12
atacccgagtacccaacgcgctagctagttctattgccgcaccccatatctggatgagggactcgttctttcagctaactacactgcacgcaatggccaccacggcgaccgaggcggcgccgtctcatgagcagcaggccaaccgcaacggcgagcagaagacgcggcactccgaggtcggccacaagagcatgctcaagagcgacgacctgtaccagtacatcctggacactagcgtttaccctgctcagccctaaagcatgaaggagcttcgcgaggccaccgccaagcacccatgggacctgatcactaccttcgacgacgagcttcaggccctgaacatgctcatcaagctcatcgacgccaata

SEQ ID NO: 40847 - DNA, 431 bp, Zea mays
  Clone ID: LIB3062-029-Q1-K1-D3
gccttctagaaccatctcgccgccgccacaccacaacccgtcgaagcgaagcaagcaatgggcggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgcctccgccgccgccttcctcttcgccgccgtccgccactgagccgatggggcctcgtgcctgcaggctacctagcagtactttcgacgctgctgccgccgccggctagatctatttattggagtgctatccagtagtactagtagtagtgagatttcttcggtgctgtcgtgtcgtcgtcgcattttggtcggatctggttttcttggtgcaaggagggtttctat

SEQ ID NO: 40848 - DNA, 446 bp, Zea mays
  Clone ID: LIB3062-029-Q1-K1-D4
caaagaagttgagctttaagaggaacgtggtgtcattgtcatcagagctcaagggtgtgaggagcaagcttgcttcctaggagcagctgtttgtaagggaatctcaaactggaaagcttgcggagacaaaaacaaggagcatggaagaggaagtaatcaagctgcataaatgcttacaggacaaggatgaacaactgcattcattcacaagtagcacggaacaggaacccaactgaaccttcaacttgcttgttctgggagatctgtgagcaagcgagtgctcctcataatgggtattcgacatgagccccatccctgccacagacttgggaaaggcacaatgatttttatggtgacatgaatacattcctcttcaaattatatctttaagcatccatttttcgccctactggtgcaaacaagaatttgcaatgggtaggttactg

SEQ ID NO: 40849 - DNA, 428 bp, Zea mays
  Clone ID: LIB3062-029-Q1-K1-B8
aggtcatccactcccgctgggccatgctgggcgcgttgggctgcgtgttcccggagctgctggcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaagccttcgcggagctcaaggtgaaagagctcaagaacggccgtctcgccatgttctccatgttcgggttcttcgtccaagccatcgtcaccggcaagggcccgctcgag

SEQ ID NO: 40850 - DNA, 372 bp, Zea mays
  Clone ID: LIB3062-029-Q1-K1-D5
caagatttcattggccagtgtgtaagagttgatcctgagagccggccttctgcatgacaacttttggagcacccattcgttaacagaccactgcgggcttcatttgaatcttcatctcccccagccatctgattgtactattgatatagtggggtgtttctcgttgtgagaccaatgcgcaagtcacgtgttggctttcagagcagaagcaggacaggattcaagaacgaggtacagtccttgcattgatgcaagcagcgacaagggtcttccgcttcggtggaggaaactacgtcacgcggtgcggcggggcaatcttcccgtgagagggtttctgtagaaagagctgcacgacttactgatccatggggc

SEQ ID NO: 40851 - DNA, 210 bp, Zea mays
  Clone ID: LIB3062-029-Q1-K1-A1
ctcttcgatgcctgatatgaacatctgctgtctactctagaagaagactcatgtttagggatggccacagtaaattgaacaaaggacctggagaagatagtatcaagcgacaattacaagctgttgcttaacgggtagccgcatcagttctttatccaccctttcctgaaaaaacagtcctagttctcttgggatcacatctattcatat

SEQ ID NO: 40852 - DNA, 272 bp, Zea mays
  Clone ID: LIB3062-029-Q1-K1-A11
gtgaacggcgtcggcgggcgcaggttcctcgtgcagtgggtgtggaaccccgtgctgggctactgctccggccccaacgcgctcgaccagtagctgtttggtttcggtttcgtttcatctcctactaggatggaatggaatgggattttactacgtaccagtgaatcgaatcctctagcgcatttggattttcctctcctctccccggggaaatccatgggatgcttctgtatagagttgttattatcaatgaattaatgccactttcggtg

SEQ ID NO: 40853 - DNA, 397 bp, Zea mays
  Clone ID: LIB3062-029-Q1-K1-A12
gaagctagcgcttatagcttgtcagccatggccaccgccgccgcgtctagcctcctcgggtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgt

SEQ ID NO: 40854 - DNA, 411 bp, Zea mays
  Clone ID: LIB3062-029-Q1-K1-A2
caagaaattcatcgcctgcttaaaagtttctggagaagactcattggctctgtcacttctgggggacgacagaggcataaacccactagatgttagcatcatggctccagattatgtcactttagctgaagattccatccatgttgaagcaaatggtcacaatgagacacaagtgagagtttctgtcaatgatgatgcaaatagcacgacaatagtcatcaaagttgcagaaaaatcctgcaacatcagcattcacagtgcaatcacaagggagacggctggcagtggcagagtcataaagatgccacttacgccaacatacacgctactgccagtcttccttcttctcgttgcggtggcagtgtgcatcgtggtccggaagtggcgcaaccaggacggcgaccctgcgta

SEQ ID NO: 40855 - DNA, 237 bp, Zea mays
  Clone ID: LIB3062-029-Q1-K1-A3
tacaaacttcttcacaatactcattttatctctcacttcttgtgtacagcacacccttaaaagcattagatcctaccatcattactccacattaccacactttaactcaatatttcatccacttttaagcccatgatcacaatgagacacaatttataacctctgacaataatgatgcatataacacgaccatattcatccaaaattcataaaaacccttcaacattatcactcaca

SEQ ID NO: 40856 - DNA, 340 bp, Zea mays
  Clone ID: LIB3062-029-Q1-K1-A4
ctctaacccaatcattacttaccaagttctgtcctattcatatctagggctatccttcaaatacattcctattcatcatcaaattccaattcataactccattcatcgtctatctcatcttctacactatctcaatcaaaacacttttgatcaccataaaactattttaataccttataaacttcaaaatgaacctttacttacctaccaaactattcattattattctcatatcgctaataaaatctacatgttaaatatttcaaaacttcaaactcaagaacttattacacttcataaagctcatcttataactttatacaacccatacataatatca

SEQ ID NO: 40857 - DNA, 320 bp, Zea mays
  Clone ID: LIB3062-029-Q1-K1-A5
atgcctgatatgaacatgcatgctgccataccctcagaagaagactcatgttttaaggatatgcacacagttaaattgaacaaaggacctggagaagatagtatcaagcgacaattacaagctgttgctgaaggggtagccgcatcagttcttcagccaccctttcctgaaaaaacagtggtgttctctggggatcacatcgattcgcatggagcagaagttgatgtcaagttccaagatgaaaggaacaatcagtcagacaaaataagtcaaggggttcaagttttaaatgacaacgattaccttcagattattaagaa

SEQ ID NO: 40858 - DNA, 384 bp, Zea mays
  Clone ID: LIB3062-029-Q1-K1-A6
gaaccaaggagcaacttggttatactgtggactctagcccaaggatgacttaccggatgctggcctattgttttcgagttatgtcctccaaatacagtcctatttatctgcaaagtcggattgataacttcattgatggtctatctgctctgctggacgagctcagtgaagagacttttgagcaccatagaagtggtttaatagctgataaactggaaaaggaaccttcacttagctaccaaactagtgattattggtctcagatcgctgataaaaagtacatgtttgatatgtcaaaactggaagctgaagagcttaagacagttcaaaaagctgatgttatagcttggtacaacacatacataagatcatcgttcccaaagc

SEQ ID NO: 40859 - DNA, 403 bp, Zea mays
  Clone ID: LIB3062-029-Q1-K1-A7
gccatgggtaaagacaagccttacccctggatctgtggttgctaccgagtacttgaaacatagtggccttcaagattatctgaaccagcaagggttccatgtcgctgcgcatggctgcgccacttgtgtgggcaactctggtgacctggatggatctgtatccgctgctatcacagaaaatgatatcgttgctgctgcggtgctgtcggccaaccgaaacttcgaagggcgtgtgaaccctctcactcgggctaactaccttgcctcgccgtctctggttggtgcctatgctcttggcggcactggtgacattggttttgaagaagaacccattggaattggaaagggtggcaaggaaattttcttgaaggacatatggccttcaaaccaagagatcgatgaa

SEQ ID NO: 40860 - DNA, 402 bp, Zea mays
  Clone ID: LIB3062-029-Q1-K1-A8
cccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggaaatgatgcacgccggcgcgtcccgctacgacttcgaccggttcggcgtcatcttccgtccgtcgccgcgccagtccgattgcatgatcgtcgccggcacgctcaccaacaagat

SEQ ID NO: 40861 - DNA, 280 bp, Zea mays
  Clone ID: LIB3062-029-Q1-K1-B1
gaacacgcacctcaagaagcggctcgccaagatgggaatcgaccccgtcacgcacaatgcccgcgccgacgtcgtggggggctggtcttgcgccggcaacaactctggagcgcgctacaaggccgtcgtgcacctcagtcacactgcgcagtgggagagcgcgcgcctcgaggccgatgcgcgtctggcgcgcgaggccaggctgcgtgcccttgccttgccaccgtcgccagggccgggacccgcttttagcgggctcgagtcgtcgacatcgactctg

SEQ ID NO: 40862 - DNA, 227 bp, Zea mays
  Clone ID: LIB3062-029-Q1-K1-B10
gcaatactacaaaccaatctttgctttaacatccaactcctaccctatcgattatgctcattcaaccttatcctggttcaaatccactagatattcttccaacaatgcctcacatcttcatttaaaatactggatcttcaccttaatttcaatatccaatatcatcactgccagctgatcactaacttcttccacctatatcatcttccattgcataatctaatcat

SEQ ID NO: 40863 - DNA, 344 bp, Zea mays
  Clone ID: LIB3062-029-Q1-K1-B11
cagcaacttattaattacctcttaaatttcgaaaactctaaaccaataatatggctaagtcatacttctggatgccaggatattatgcattatatgcacacaaactttgactcattcaaaaacgtttatagtgtcatcttgcatactcaactaactgacagtcagtataaagacactcttccggaaacatattaaatgatacaccttgcacgcaaactaattaaccactgtccacgaacctatctcatgcctagaaaagcaaactcatatgctcctattactgcctacagataccactacctttgttcatatataactcatgattacatcttcaattcacatct

SEQ ID NO: 40864 - DNA, 246 bp, Zea mays
  Clone ID: LIB3062-029-Q1-K1-B12
attcccgctgcagggactcctaccaggtctgggtctgctggctcttcgacctgatgagctgcctgtacaaggagggggacagcatgatggtcagcctcatggcggtggtggcgtcgtacgtctactcctgggtatcatagccaccagattcatcaagccatcagcatcgtatagctgcacaaggcgtccctcgagcttatgactctgccgattcggtccctgcagtatgatccacttgtcttactc

SEQ ID NO: 40865 - DNA, 379 bp, Zea mays
  Clone ID: LIB3062-029-Q1-K1-B2
cgaatgcttaaggaagtatggaaacgcaaatgtctggaaaacatttacagatctatttgattacttccccttgactgggttggtcgagtcagaaatattttgtttgcatggtggattatcgccatccattgagaccctcgacaacatccgcaacttcgaccgtgtccaagaagttcctcatgaaggtccaatgtgtgatcttctgtggtctgatccagatgatcgatgtggttggggtatttctccacgtggtgctgggtatacctttggacaggatatatcagagcagttcaaccataccaatagcctaaagcttattgctagagctcaccaattggttatggagggtttcaattgggctcatgagcaaaaagtcgtg

SEQ ID NO: 40866 - DNA, 323 bp, Zea mays
  Clone ID: LIB3062-029-Q1-K1-B3
ggaaagctgaggagggaagccgagcgcgccaagagagccctcagcaaccagcaccaggtccgtgttgagatcgagtggctctttgacgggaccgatttctcggagccgctgacccgtgccaggtttgaggagctgaacaacgacctctttcgcaagaccatgggccctgtcaagaaagccatggaggatgctggccttgagaagagccagatccacgagatcgtcctggttggtggaagcaccaggattcccaaggtccagcagcttctgcgggactacttcgacggcaaggagcccaacaagggtgtcaaccctgatgaggc

SEQ ID NO: 40867 - DNA, 355 bp, Zea mays
  Clone ID: LIB3062-029-Q1-K1-B4
accagccccacctccatcggaggcagccaccggccacgggagcagcacgcctcctgcatcagctgctggcagccaccagccacctccatcgttggctacttggctccctcctccttggtagaagatggccccatcctcgtcctccagctccgatggacatggccatgctgctccgcgccctgggactggtagagttcaagtggcgttgcctaacgcagatgctgctgctgaagctgatgcagaggttagtggtggttatgctgaatctaacgagccaaattctactggtgctccatcatgtgggtctggtgtcggtcccaatgattctgagtctatagttgccaaaacattagag

SEQ ID NO: 40868 - DNA, 430 bp, Zea mays
  unsure at all n locations
  Clone ID: LIB3062-029-Q1-K1-B5
gtagaagagctaactcctgttcactcaaagtcaaacgggaaggcttcatctgcgagcctaaggactggtggaaaggcttcagccctttctaaaggtgaggcaagcaaaggaaaagcatacagtagtgacaaaggtggaaagggttcttcatcacatgcagtgcctaccaagtctgatgcagaactaaagctagagcttgatatcccttcaaattctagaatgctaatgaattgtgaagcagctgaactattgcaagaaattcacgagcacatggccatactatcagaagaccccaagatcaaaattcctgattcatttgacaaaacttttcagtattcaaaagacggaaatcatttcaccactgcaagctctgtgaaacaagccattgaacctcttaaaaaatgtggngtcagtgatggagagatattca

SEQ ID NO: 40869 - DNA, 107 bp, Zea mays
  Clone ID: LIB3062-028-Q1-K1-H9
aacgaactggtgggtgggttactgggttggggctggaggtcgtcgccgacggccggtggaggtgctcgctcctgcctgtgtggatctgccgcccggtggtggctcgc

SEQ ID NO: 40870 - DNA, 237 bp, Zea mays
  Clone ID: LIB3062-029-Q1-K1-B7
tcgctcactcgtccggaggggagacacatctggttcggaggttccctgttgttaccatgaagcggaggctactgtacgtgaaaccgcagctcagttttgccaattttgatggggaacagtactaattgattcaagcattctggtagttggcatcgcatcatttggaacgtattatgaatatgctacagatcacatggaacatgtttgcattactttggttcatgcttcaatatgttt

SEQ ID NO: 40871 - DNA, 426 bp, Zea mays
  Clone ID: LIB3062-028-Q1-K1-G2
cccacgcgttcggcagaagaaagctcataaactagaggatgaactggttgccgcacggaaggtatcttcagaacgacagttggcggttacagacctgtacaaacattttctccaacttcaggactacaatgatagggtcaaaacagctgaacagaggctgcagtctctcgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaactgcattgtaactagaaacaggaaaaatgttgtgtaagggtcggagaatctgctgtcgtggtccctgagcccggatttctctttcgaaattggattcatt

SEQ ID NO: 40872 - DNA, 315 bp, Zea mays
  Clone ID: LIB3062-028-Q1-K1-G4
aatctcatcacagtactgttttgtttctcgtattcgcttacggtaagggggcaggtaattttaaaaagaagggggggccaagaaatggccatgactgcacattccttccagccctactaaaggcggacttcttgctactgtttctagcatactttccacgagttggcacacgcctcactgtactcaataacctggcgcatattgcaatgtctgttgacgctaatgacacaactattctgttgtgcctctttctctactgcaaatgcgatgctcaaatccttggtggatctgactctgaatatactgtacggtcaa

SEQ ID NO: 40873 - DNA, 334 bp, Zea mays
  Clone ID: LIB3062-028-Q1-K1-G5
ggcgacccatggctccacagacgaggagagagaggttggcgggggaggcgcggccgggctcgtcggggctaacagcggcgaagccgggggcggtcgaggtgcagcgccgacgggcgggcagcggttggactagccgtcggatctccatctacgcctaccgagtctacttcctcctcatcatgctccagatcccgctcttcagggtcccttgtagagctggcacatgcacaactgctattcaagtaacatcatctcagttggtctcaaatgatatattcccagcagctgttgtgaaagccatgctctaccctggagctaccgtgagcagtctaac

SEQ ID NO: 40874 - DNA, 287 bp, Zea mays
  Clone ID: LIB3062-028-Q1-K1-G7
cgcttaccataatttctcaaactcttttagatacttcgtctgatgaaattcggccagattattatgaacgtacaatgtgcaaaccaccaacggttcaagctaaaaacttctcatgcaaccatctatttcatctaccttgtttgtgcatcatacgcttgatcaatgactaatctaatgatactgctgtacaacttgttctacaccgttcttattatcatttgcacatccacaaatgtctacaaattcacatcgtgcaaatgttcatcaaattatctaacaacttacta

SEQ ID NO: 40875 - DNA, 402 bp, Zea mays
  Clone ID: LIB3062-028-Q1-K1-G8
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcg

SEQ ID NO: 40876 - DNA, 385 bp, Zea mays
  Clone ID: LIB3062-028-Q1-K1-G9
cgacagaaagagggacgaatggcgagctcgcagtgctgcgatgacccgccggccctgagccgggcctgcggggagggcaaggtcgtcgacagcttctgcgggttcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacatactccggaaaaagggtttgaagagacaaaacatgttattggggctctaaaggagaagggagtgtctgctgttg

SEQ ID NO: 40877 - DNA, 410 bp, Zea mays
  Clone ID: LIB3062-028-Q1-K1-H1
ctcacatcaagttacggaaggcacttagttcactcgatggagcacttccagatgctacgtatgatgaaatttgtgcgtatgatgatgagtgtgccatctgcaggggaccaatgggtcgagctaaaaagttgtcatgcaaccatctatttcatctagcttgtttgcggtcatggttggatcaaggactaatggaaggttactcctgtccaacttgtcggagaccgctcttattgtcatctgaagggcaaagaaggtctacaactgcggaggtagcaaatgttcagcgaattgcggaacaacttactatggggatgaatcagcagagagttcctggtaatgaacatcctgttgaacagcagaacccctcagatgctgtttggagaggtgctggtctggatgctagctggatt

SEQ ID NO: 40878 - DNA, 322 bp, Zea mays
  Clone ID: LIB3062-028-Q1-K1-H10
gggctttagcgatggtcctgttcatggctggcgccgcgctgctcgccggggctgccggcgcgggctcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccgttggatgggcgactgctccggatggaccgtttgcctggggata

SEQ ID NO: 40879 - DNA, 167 bp, Zea mays
  Clone ID: LIB3062-028-Q1-K1-H11
ataagaaaagtggtgatcaacagtattctgcatatgaatatggccctgacacaactgatggttcaccatactttggagcaggatttactgtccaaatctcacaagcacatttcgatcaccaggccgaagatgacacccatcacaagcacggaatgaggcaccacgtg

SEQ ID NO: 40880 - DNA, 334 bp, Zea mays
  Clone ID: LIB3062-028-Q1-K1-H12
cgcgttctcgcctcatctcctcccgctcaggatccggcggcgaaggtaaggcaagatgtagggcgcgaggaagaagatccagaaggataagggccttgagccctccgagttcgaggactccgtcgcccaggctttcttcgacctggagaacggttaccaggagctcaagagcgacctcaaggacctttacatcaacggtgctatccagctggatgttgccgggagcaggaaggctgttgtgatccacgtcccataccgcttgcgcaaggccttcaggaagatccatgtcaggatcgtcagggagctggagaagaaattcagcggcaaggatgtg

SEQ ID NO: 40881 - DNA, 397 bp, Zea mays
  Clone ID: LIB3062-028-Q1-K1-H2
gcggaaagcgaatcagcaggcaatggttgcctagaagaaaaggatggaaccacggggcgagggcccaggtgtttgtaagcagaagtggctggacgacaggaagaataatatcggcaagctgttggactcaaatggccttgatatgtccaaggcgtacatgctcgatacgcaggagactgcataagccaagtacaagaaatgggagaaggaacctgctccatatgggtgggatgttttcaatcaaaagaccttgtatgatgcatacaaagagacgaccaaggatatagaagttgacatggacgcgtacaatatagcctaggaagctgatcctgaattctaccgtgacgcctgcagtctccagtacgggaaggtgttcaatgtccctgaagaaaacatt

SEQ ID NO: 40882 - DNA, 383 bp, Zea mays
  Clone ID: LIB3062-028-Q1-K1-H3
ggaagaaagactgttttattgctttcgactctgcttactagtggattgggtcttctgagtgctctatctattaactacttgtgcttgctggttcttcggttttttgtcggcataggagtgggcagtgggcatgtattttcatcttggttcttggagttcgttcctgcaggaaatcgtggcacttggatggttattttttcctttttttggactattggcacagtcttggaggcttcacttgcatgggctgtactatcagcattgagttggaggtggttgctggcattgtcttcccttccatgcttcctcttgcttcttttcttcagaatcacacctgagtcaccacgctatctttgcgcacaaaatagaatgactgatgcaag

SEQ ID NO: 40883 - DNA, 434 bp, Zea mays
  Clone ID: LIB3062-028-Q1-K1-H4
gcctgataaagcaaaaccttgggaactaatggaagttctaaatccccagcaatgccgtgtagcaacaatgccagaaactccagaccaagccagaaaggttgtccgacttctgtacacaaattctggtgttgggttgctagcactagggtctaacgccattcaaaggctatggaaatggagtcgaaacgaacaaaatccgagtggaaaagccacagctagtgttgtgccacaccattggcagccaaatagtggtcttgtcatgacaaatgatacagcagataccaatccagaagaggcagttccatgcattgcactctcaaagaatgattcctatgtgatgtctgcttgtggtgggaaagtttctttgtttaacatgatgacattcaaggtgatgacaacattcatgccacctcaacagcatcaacattttagca

SEQ ID NO: 40884 - DNA, 398 bp, Zea mays
  Clone ID: LIB3062-028-Q1-K1-H5
ggagaaaaacgctcggaaatttcgtctgatcactcgatatttgttggcgattgggctgttgatgttactgatgcgatgttgctggaacttttttctaacaaataccgatcggtgaaaggagctaaagttattattgatgcaaacacaggccgttctagaggctacggctttgataggtttggagatgataatgacaaaattcatgcaatgactgaaatgaatggcgtttactgttccacaagaccaattcgtgtaagaccagcgactgctagaagatctcaaggtgattctggcacttctccaccaaagcaatctcatgttgactctactaacaagacggtatatgttggtgggcttgaccccaatgttagcgaagatgaactgaggaaagcatttgc

SEQ ID NO: 40885 - DNA, 398 bp, Zea mays
  Clone ID: LIB3062-028-Q1-K1-H7
ctgccctgcctgactgactgggatactacaggaggttacaactgggcttcagcagtggtggccttcctgtataggcaactttgtgaggcttgtcatcgttcgtcgaggaccgccagcttaggtggatgtgtctacctactacagctgtggatgtgggcacacatacccgtcgggcgacccagagagtttcctcctcgtgagtggttcgtggtagccggacatcggcttaagcccacggctgcttaccgctgggaccaggtcgaggagccattcgcacgacaccagcgtgcttacgtggagtactcaaacgagctcgacgcacttactccttcgatggtgacctggcaaccgtatcttgatccatatttcgccagcatacagttgagcagcatgtgctc

SEQ ID NO: 40886 - DNA, 302 bp, Zea mays
  Clone ID: LIB3062-028-Q1-K1-H8
gagcggtgcgggactgactgctatcctagagcacgtacctgccggccatcgtcaggggatccattcaccattggccgagtcaacgagcataagtacaagatggcccgcacgcgcaacttagataagaacatcgacgtcatagagagccagctctagaccaacatgaaggccatgagcatccagagagcacgctcgtggcaagcattccatgacagacgtgtatcagctcttgcccaatgttaataagtgataggactgaacttaggaaccattgctagttaggccagggggcgacccttggg

SEQ ID NO: 40887 - DNA, 224 bp, Zea mays
  Clone ID: LIB3062-028-Q1-K1-G12
ataactcaaggagacacttgacgtggatgcactactcatagctactgtaagggcacccgttgggcaaaagacttgggtgggaaattatcaatgtcgttacacatcaaggttttgatcctgttgatgatcggatgcaagttattgatgcaactggcaatgtcggcatactaaacctgtaatctctaatttatatacgatcggacatgccaatggtaagctcatgc

SEQ ID NO: 40888 - DNA, 347 bp, Zea mays
  unsure at all n locations
  Clone ID: LIB3062-032-Q1-K1-D8
cgtactgctgttcgtggaacaaggggtcagcattgcacctgagtacctttcaacaggagaatggtctgagaaaactggtgtatttggctatggaattacacttttagagcttattacaggacagcgggccttcgatctagcttgccttgctaatgatgatgatgtcatgcttctagattgggtcaagggattgctcaaggagaagaaactggagagtctggtcgaccaagatctagaacacaactacgtcgacgttgaagtggaatctctggtacaagtcgcactactatgcactcagagcaacctcatggaacgccctaagatgtcagaggttgngaggatgctcg

SEQ ID NO: 40889 - DNA, 438 bp, Zea mays
  Clone ID: LIB3062-032-Q1-K1-D9
acggtcgcgccccatacgccgtcaacttcaggtggtacggccacgtaacggctccacggctaccggtgatcaccgactgggtatgggcgtgtacgcgggcccgggggcagaggcccagacgcagccggagccgtacgtgtccacgtgggtcaagactgcgcgcaagtactacgacacctacaaggcgcgttacccggcgctgcgcctatgatcccacgccgtcgaccggaactgctgcctatgcaggcggctcacggagcgggacctccttaggctcaccgccaggggggcaccgagccgcgccatcaacctggtgctcacggccggcgacgtggctcgtggaccgattctgagcgtacaggtgcgggacgcacggtgcgttcacacggtcccgtgccggccggttcacgtacgtgtgggtaggcaacccggtgtaac

SEQ ID NO: 40890 - DNA, 438 bp, Zea mays
  Clone ID: LIB3062-032-Q1-K1-E1
gaattcccgattcgacggacacggacgctcaagttcaatctaatcaatatggcggatcggggcatggagctgcgtgagcactgccgcggtatgggtgacaacgatgagcgacactatagattccattctctgtgcgtacaccaaggtgctagaaccattagttgggctaatgaacacggagcagcagcaacaatatcgtaaggagaatgcatacgttggacaaatggtatgccatatcttcagttctcttatgatgcttcaacgctgcatcttcagttttctcgggtaaaaacagatcatagtcaatagtatacctatgtgtgaaatactgtaaaacttgcatggtatatggacctcaaaaagtataggaaagcgctatgctatttgcatgtttgctgggagaaagaaaagatatatgaaaggaattatacaggttct

SEQ ID NO: 40891 - DNA, 433 bp, Zea mays
  Clone ID: LIB3062-032-Q1-K1-E10
acggtgtgtactagcaaccagctagctcgggcggcagcaggcagccatcatgtcggaggagaggcaccaccacttcgggaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagagcaccaccacc

SEQ ID NO: 40892 - DNA, 431 bp, Zea mays
  Clone ID: LIB3062-032-Q1-K1-E11
acggccctctcctgcttccacaggccctgcttctcgagcatcgcccaagtcatcgggcgcaagggcccgttctgcaaggcggacctattccacattgaatacagtctctccaaggactatcacctcccgggcttccgcgacggcatccactactgctacaactacgacatggtggcctgccctgcgcaagaagtccatcttccgactcgtctcgtcctacacgcagcacttactggcaaggatgctcatctaccctgaaatcatggtaccgttcctcgactagagcgcacagcggctgactgagcgccacgaccgcttcatcgctgacctacgcaaggtcggcatatcctgccatggcttcaacgcgtgcctcttaacctggatggacttgcctatcatgctactctagaagactcacgacacgacactcg

SEQ ID NO: 40893 - DNA, 239 bp, Zea mays
  Clone ID: LIB3062-032-Q1-K1-E2
gacgagcaagggcaatgcatatgctgtattgtgtgagtccataggtgtacgtcagctccagagcgagagtgcttgcctgatcagcgtagcccaacatggcaatgctatacttgtgatcatgtacaaatatagagtcacagaatacagcaagggcaatgcatatgctcatgttgccattgtcaccaatgatgtgtacaagatcgccgagacgaatcatctgaccaccaaagaactaggtg

SEQ ID NO: 40894 - DNA, 268 bp, Zea mays
  Clone ID: LIB3062-032-Q1-K1-E3
ggacacggacgaaaaccatcagatctagcagaactctcgcgaccgcatcggcgttggcggagcgcatgttggccggggatggcgcggagcgggtggaggaggagcgcggcggcgcgggtcgcctggcgcccggtcacggtttgcctgtggctcgcgctcgccgccggcgtactgacgctcgcccaggctaagaaggacctgacagaggttacccacaaggtctacttcgacatcgagatcgacggccagtccgcatgcctgattgtca

SEQ ID NO: 40895 - DNA, 248 bp, Zea mays
  Clone ID: LIB3062-032-Q1-K1-E4
cggatgagttcaaggtgcgtttggatgcagctttgactaaaatccctgaacgctcagatgcagacagtgcagaggccaaggaaggtgtaaaggcaacctggatggcagacggaacacagtggccaggaacatggtttgaccctgctgaaaaccataagaaagggcaacatgctggaattgtaaaggttatgttgaatcacccgggcgatgaacctaggtttggtggaccagcaagtgctgaaacccct

SEQ ID NO: 40896 - DNA, 341 bp, Zea mays
  Clone ID: LIB3062-032-Q1-K1-E5
acgggctccctccgcagctctcgctccaggggccttccgctccgccttctcgactccggtcgggtctaaccctaccggtaatagaataaacatagaaggcgctttctgtttgccgtgttccacaaggaagagagctagttatagatctttccgagtgtacagattatttggagggaagaaggataaagatgagaatggcgatgaagcgccatcgaaagcaggaatttttggaaacatacaaaatctctatgaaactgttaaaaatgcccaaatggttgtccaagtataagctgaccgggtgcagaatgagcttgcagcgactgagattgatggatattgtg

SEQ ID NO: 40897 - DNA, 415 bp, Zea mays
  Clone ID: LIB3062-032-Q1-K1-E8
gccgttcaatatcatctgcagcccaagttcgatgcatgagttcggcatggggtggggatggctgctattttgggggtgagttggtggatgaaaattcaagttattgtcgaagacaacacatttctttgcatattacatcctgctatgatgttctgaactatgatgggttcaacgggtgccatttttctcttagagctattgttgacatggaagaaatggtggcagcaccagcttagtatggacaacaactgaaatctcctacagaagttgtttctaatgtgctattgagctccattgagttaaggcctacgcaatcttgttctccagtctggctccaagaaaagctctatagtcccatagtttctgctaaggttcaacaacttcaggatcaattataggctgagaagcaagaaaa

SEQ ID NO: 40898 - DNA, 443 bp, Zea mays
  Clone ID: LIB3062-032-Q1-K1-E9
acgatccattcaagccgccgaccttcatgctactcacgccaagtggacgctttgagagtcataggaagatttgttcgggcatatccaattaccaccctgatcactggcagccatcatggagtgtgcgcacagcgttggtggccttcattgcattcatgccaaccaaccctgctatgcattgggctcattggattacaaaaaggaagatagacggacactcggtataaaatcacctgaagcaccgtctaaatttgtgtactcagaacgacctaaactaattgatgagatccatgagcaaatgctcagtaaggctgctactgtcccccaaacgctaccaaatgtgccacacgaggagtctaacgaattacccgcatctgacccttctggcgagcatgcagacaacgtagatgaaggcgacaacacatatgattatgtatcagact

SEQ ID NO: 40899 - DNA, 350 bp, Zea mays
  unsure at all n locations
  Clone ID: LIB3062-032-Q1-K1-F1
gacgccaagatccaggacaaggaangtatccggccggaccagcagcgactaatctttgcggngaggcaggtcgaaaacggccgcgccttggccgactacaacatccagaaggagtccacccttcaccatgttcttcgccttcgcggtggcatcattgaaccttccctacaggcgctcgccacgcagtacaaccaggacaagatgatctgccgcaagtgctatgcacggctgcaccccagggctgttaactgccgcaagaagaagtgtggccacagcaaccagctgaaggcagagaagaagatcaagaactgaagcttgccaaatcggtgccttgcatggagtgcgtcaac

SEQ ID NO: 40900 - DNA, 402 bp, Zea mays
  unsure at all n locations
  Clone ID: LIB3062-032-Q1-K1-F10
aaatcggcctacgcccacggttccacctcctcgtccacgaggtgaggaaacccgagcgacggaccatggcgttggtcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtnccgctacgacttcgaccggttcggcgtcatcttccgtccgtcgtcgcgccagtccgattgcatgatcgtcgccggcacgc

SEQ ID NO: 40901 - DNA, 464 bp, Zea mays
  Clone ID: LIB3062-032-Q1-K1-F12
agaaacggctactatggaggagattccacctcgctcaaccttaagcagctctggaagaggtttagaggggaagacaggcccccagcacatcgaggtgcaagcagagactacaatgtggacatggtgccaaagtttatgatggcaaatgggacattggttcgaaccctcatccacactgatgtgacaaagtacttgtcattcaaagctgttgatgggagctatgttttcagcaaagggaagatttacaaggtccctgccactgatatggaggctctgaagtcccctttgatgggtctattcgagaagcgcagagcaaggaacttcttcatttatgtccaagattacaatgaagctgatccaaggacacatcaaggattagaccttactagggtgacaactagagaacttatagcaaaatatggtttaagtgatgatacagtggatttcattggacatgcacttgc

SEQ ID NO: 40902 - DNA, 350 bp, Zea mays
  unsure at all n locations
  Clone ID: LIB3062-032-Q1-K1-F2
ggacacgtacggcagcgccccatgtaatcgttggtgaggagaagactgaggacagtcaggcagctgaatgggcagtgccttccctggcgtgttcagagggagagaagaaagagaacggtggtgccactgaaccagcagcacctgcttcagctgatgcagacaagggcgcggagaattcaggccaggtgaacaccgccccccaagaaccgacggcagcgaactgcgacaaggggcagatccaacctggtgcctctgctgtcaggtgcacataanggagcttggtctccgatgagagaccgatgctttgtgtgtttaaggcaatacctcgcatttgctttgagaattataat

SEQ ID NO: 40903 - DNA, 268 bp, Zea mays
  Clone ID: LIB3062-032-Q1-K1-F4
ggacacggccgctgggcaatccacaaacagcttacgcgcataagccttatcctgaccgtactcagtccttggccatgtcatacccatatgggggatccatactactgtagcgctgtggcagcagcttatggtacgtatgctatcatgcacactcagctggttggcatggtctcgtactctcgagtgccaatgtagatcgagccatacgctgaagagcccatctatgtcaactcgaagcagtaccacgctattatccggaggagacatc

SEQ ID NO: 40904 - DNA, 393 bp, Zea mays
  Clone ID: LIB3062-032-Q1-K1-F6
gactgactcaatgtaattggattgcggccctgtacatgccaagccccccctattgccacggggactgggggcgggcaggacttcttgttcttgggagtgtcagcagtcagcaccttggactgggcagacggcggctggcttaacacccatctcatctgaagcaggtacagcatgctcatcgaccaggctcaggcgatcgtctggcaatctggcatggcgaacttgaccggaccatgtccggtgagtcgctcgctgtcatgctgttgccccaccggcactgcctatcttccacctcaaccagcgttcacgagtactatgcaaaataccttttatgctgctaaaataacgaaatggacgtgcgtgcagacggccggattactggcgctgccgctt

SEQ ID NO: 40905 - DNA, 312 bp, Zea mays
  Clone ID: LIB3062-032-Q1-K1-D7
acggcatatttctgttgaattatgcgattgtagcaggtagcgggaaaactaattgggggttggggtcacccactcgagtcggaggataaggttgtcataaccatacccgttgagcttgttgatggccttctcggcgtcctctctgtgaacaaagttcacaaacccaaaccccctgctcgaatcgcatatttctgttgaattatatcagtatgtttgtttgaattactggtacctgagtcatgaatttatcttgttggtaaaacctgttatgtgtggtttggttggtcgagaataactatactcacttctttt

SEQ ID NO: 40906 - DNA, 404 bp, Zea mays
  Clone ID: LIB3062-032-Q1-K1-C10
ccttcgacgagggccgcatcaccatgcgcaagaccttggacaatcccaaattggcgctgtggggaagctcctgggacggcctcgaccgtgtcacgtacctaaacacatacttttgcagctagcgaactacatacctgcaattgtgccaacaacatcaggtaatacaccgcctgccttctcgcccatctaaatacattctgcaagaactagacgctttaccttattcaatgccgttcagccatgcttgtctcgctcttctgcttctgttccaacctgatgttatgaaacgccgttaaattctaccataccgactacttcaagtctcatctgctagactttaacttatatctgcactgtactactcattaatcgcctagcttgattatgcccagagcatatacctc

SEQ ID NO: 40907 - DNA, 438 bp, Zea mays
  Clone ID: LIB3062-032-Q1-K1-C11
acgcctacacctccagaccaaactatagatggataatgagctgaaggattttcttggggtctggaaggtcatctggagacctcgtggactttatggcgacgaggatacaaacggccacgttgacaacatgtgctgcttcatcaaacccggtgtgatcctgctgtcgtggaccgacgacgagaaggattatcagtacgaacggtcggtcgaggcgctgtctgttctctcccagtccgtcgacgcgaaagggcggcagctccaagtggtgaagatccacgtccccgggcctctgtacatgacagaggaagaggcacagggcgttgtttcatcgggacattctgtgccgaggccagcgggcacgagattggccgactcgtacgtcaacttctacatcgccaatggtgggatcatagcgccttccttcggcgacaggtggga

SEQ ID NO: 40908 - DNA, 378 bp, Zea mays
  Clone ID: LIB3062-032-Q1-K1-C12
acttatcgagttgatggtcttattaggctgatgaacggattcaagactggaccgattaacttctttaaccgaggtaagttccatctgcattgtaactcttgttgctatacaatgagctacctacccaatctgtgtcatttctgatatatacattctactggacccagctaactaagttggttctcatcttcctcacttgaatatatcattctgaaacttgctgagtatatcaatgacgttatttcaattatataatcacactccttttctcttccaaagctctgcaaaactctactgattactgacgcgactacttcaactcatcagttgattcacccatatataacactgactatgacttagtacactcctgacgat

SEQ ID NO: 40909 - DNA, 333 bp, Zea mays
  unsure at all n locations
  Clone ID: LIB3062-032-Q1-K1-C2
gacacggacgtgctcagcagaaaaagctcaaccttcctgtccgtcccacaaccacaattggttcattccctgatacggtngaactgangaggggtcgacgtgaatacaaggcaaagaagatcaccgaggacgaatacatcagtgccatcaaggaagaaatcagcaaggttgtcaagatccaagaggagcttgacattgatgtgcttgtgcatggagagccagagagaaatgacatggttgagtacttcggtgagcaattatctggttttgcgttcactgccaacggatgggtgcaatcctattgatcacgctgtggtaagccacccattatct

SEQ ID NO: 40910 - DNA, 364 bp, Zea mays
  Clone ID: LIB3062-032-Q1-K1-C4
ggacacggacgatctcaggtttggggggaaaaggcctggctggtcgcaaaccgctctctgttgatttgggagtttggaggcgctcgagtggtcaggtaaaccatagtttactgaccaatggctcgtactaagcaaactgctcgcaagtccactggagggaaggctcctaggaagcaacttgccaccaaggctgctcgtaagtctgcacccacaactgggggagtaaagaagcctcatcgttaccgccctggaactgttgctcttcgtgaaatccgcaagtatcataagagcactgacctgctcataaggaagctttcgttccaaaggcttgtcaaggagattgcccaggatttcaagactgatc

SEQ ID NO: 40911 - DNA, 348 bp, Zea mays
  unsure at all n locations
  Clone ID: LIB3062-032-Q1-K1-C5
ggaacatagaacttaacttgagaaatgggtgctaccacaagggtggaatgggacggcctgggctgactaattaggaaagctagttgaggactaccttacccgaaaggggcaagggcagtaagggagttgtcggtatagggaggttctcggggtgatcatgttgcgatggcttttcagacgggggattcctatattgcgctttctagaaactgtagcgggttttctgaagctagtagaactttgtaaaggcctcgtagtggatccatatccattcaccgcggaattgtctaagggtctaactaaccttggctagacgggatacacgacttgtntgttaagggcgcaacc

SEQ ID NO: 40912 - DNA, 364 bp, Zea mays
  Clone ID: LIB3062-032-Q1-K1-C6
acggcaattggcttagacttggatcttgaggcacttgagtggtgccttgaaaacaacggaagcgagattggagctggtgggtattcaagaatgttgcttttccatggaaatgttctacaaccaatggaatcccgtcttgtcaagcaaaagtttactaatcttgtgcatggtctatatttgaacagcaacaatggcacaggaagtaacagttgcaagcagatgggtcttgctgactcgtagtgcttagccaatctgaccatgtcataagcagattttcctgcaagggatattatctgtgcattcaactacagctgctgttgccttcatagtataaaggacttggttctatatttcaagcatgtat

SEQ ID NO: 40913 - DNA, 374 bp, Zea mays
  Clone ID: LIB3062-032-Q1-K1-C7
atcaagtactcgcccgcccgcgcgtcgaggaaccgccgcacaggttcagttccatgggcaaggtgcgctccttcttgtgccgcgcgcgcagcggcaagcgcggcggctcccggccaggctcgtcgtactcgtctctctcgtcccagtgcccgtccgcgaggatggcgtcgacgacggccggtgacgagacgtagcgcgtcttccgcaagttcgacgcgaacggcgacggccagatctcgcggtccgagctggcggcgctgatcgagagcgtggaccacgcggccaccgacgacgaggtagcgcgcatgatggatgatgccgacgcggacggcgacagctacatcagcctgcccgagttcgcggcgctcatggac

SEQ ID NO: 40914 - DNA, 400 bp, Zea mays
  Clone ID: LIB3062-032-Q1-K1-C8
cccacgcgtccgcccacgcgtgcgcccacgcgtccgtgaacagcaagcgcacctagcctagctgcaagcgcaccgcccgccgtcgaaggcgaagacctagttcccggtccgtcgcgatggctgccgtggcccgccgcggccccggggcgcgcctcctcgcggcgctcctcctgctggcgctggtcgtctccgggcactgcctggacgcgcaccaccgcgggctgaagcgccggcggcggaagcacgagatccattccccggtcaagacggtggtggtggtggtgatggagaaccgcagcttctaccacatcctcggctggctccgacgcacccggcccgacatcgacgggctcacgggccgcgagtccaaccggcttaacgccttcgaccccgcaatccc

SEQ ID NO: 40915 - DNA, 394 bp, Zea mays
  Clone ID: LIB3062-032-Q1-K1-D1
cctgggcctgcaagttggtttgaaaccagcaatgaaggttttaggtgtgggctgtggaataggtggaccactgatagggattgcaagatttggctgaacttcagttaccggattgaataacaacgaataccagataaccaatggaaaggagctcaaccgtttaacaggaattagtggaacatgtgattttgtcaaggcggacttcatgaagatgccgttcgatgacaacacttttgatgctgtttacgccattgaagcaacatgtcatgcacctgatccagttggttgctacaaggagatatatcgtgtgtagaagcctgaccagtgctttgccgtgtacgagtggtgcattacggatcactatgatcctaacaatgcaacccacaaaaggatc

SEQ ID NO: 40916 - DNA, 428 bp, Zea mays
  Clone ID: LIB3062-032-Q1-K1-D10
cggacgcgtgggcgcacgcaagtgtcaagagacgaaacggtcgacatggctcgcgcgcagtgtgccgtagcgggggccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccggcgacaggcgcgccggctgcaactgcctcaagaacgccgccaggggcgtcagcggcctcaacgccggcaacgccggcagcatcccctccaagtgcggcgtcagcatcccctacaccatcagcacctgcaccgactgctccagggtgaactaaaacctagaccacgcgcg

SEQ ID NO: 40917 - DNA, 431 bp, Zea mays
  Clone ID: LIB3062-032-Q1-K1-D11
accgacgcgaaccgagaaaaatcccacgaaatctcgtggccgcggcgaccggaagaagagggcgacgacggacggggcggcgatggcgtgccgcgcacttgccctccgctccctgctcctccccgacccgctacaccgtctcccggccgcggcgccacctgtttggagagcgtcccgcggtggccgccgtccgcacctccgctgctgctccggcggcggcggcggtgagcccgggcagccgacgcaagaagctgtgctcgaggccatatccaagatagcaaggtctaaaggaagggttgcactcacaacagatatcgtcatgggtggtactgtgactgacgatgcaagtgatgaatggcttgttctggatcagaaagtaaattcctaccccacagatcgaggatttacagcaattggcactggacgcgatg

SEQ ID NO: 40918 - DNA, 445 bp, Zea mays
  Clone ID: LIB3062-032-Q1-K1-D12
acgagcagcgcctggatcgaagcctggtcggtctcgccttcttggtcctcttccacggccacggcctcctcgacctggagctcctcgatttcctctacatcctcgccgcctgccccctgcggcagcttctccatcgtagcctcgacgggggcgaggacctcggatagaccagcggccttagcggtggcagacctggtggtcggcgaggccttaaccggcgtgaaccctgccgccgatttgggctcgagcttccgcttcttgcccatagcaacggcgacacggcgtgggaagacgggaattgcgtcgtgctagggtttcgatggagaagagattgcggaacgaggggaagacttttgccgtttcatatagctgaagtaggcaagtagctaacgcggcgtcggacgggctgtctgtgcatcatgtgacctgcacctgaataatgtaa

SEQ ID NO: 40919 - DNA, 347 bp, Zea mays
  Clone ID: LIB3062-032-Q1-K1-D4
acgagaaggaggagaaggccgagaagaaagatgagaagaagctggtggcacctggatgcgtggggcatgctcttttatcagagcaaaagctccgagctgtacttgagaatgctcgccagatactaaagatcactgatgaatttggatcctttgatcggtactgctggggttatctgaaccacaagcctatagtaagcaagttccgctatccaagacaagttcctgtgaagagccccaaggcagatataatcagcaaagacatgatgagaagggggttccgaggtgtgggcccgactgtcatatattccttcatgcaagctgcggagctgacaaatgatcacctagtc

SEQ ID NO: 40920 - DNA, 405 bp, Zea mays
  Clone ID: LIB3062-032-Q1-K1-D6
ggaagcaggagcttatcacatggtctgagttcctggatagaatgtcgtcaactgggtgtcgatcaaacttgacggatctggctcagcatccattgtttgagcagataaaagagctcagtgaagacataattgttcccgaatactgttacgctggtggaggtgaactccaatcacttaatgcttggtttggtccagagggtacagtgacaccattgcaccatgatccgcatcacaacatcttagctcaagtattgggcaggaagtatattagactctatcctgctttcatagctgaggacttgtatccacacacagagactatgttaagcaataccagtcaagtagattgtgacaatattgatttgaaggaatttcccagggttgaaaacctggaattcattgact

SEQ ID NO: 40921 - DNA, 415 bp, Zea mays
  Clone ID: LIB3062-032-Q1-K1-C1
caattcccaattcgacggacgacgaacgcttctgggacatcaacctaagattggggttatagccactgcgtcttggtgactaccccttgtccgtgatatcattgactggggaacgactacccttcttcaaagacgaacacaatgagaatctatccggatcctataacactgttgccgttaaactactacacctcacgattctccaaatacatcgatatctcaccaaactactcacctgtgctcaacactgacgacccctacaccagtcaagacattaacatgcctcactggaatcccattggtccttctatcggaaatccatggatctacatgtaccctgaaggcttgaaggatctccttatgatcattaataaccaatactgaaacccacctatctacatcacggataaccgaa

SEQ ID NO: 40922 - DNA, 356 bp, Zea mays
  Clone ID: LIB3062-032-Q1-K1-A11
gctcgatcctaacttctctttcaaaaagggcatcgcccatgggcatggccacgcaagcctgcggcttcacgcacggcctgctggccgcacactgtgcgccggcggtgaaaccgcggcagctgagctcgcaactcgcgctgccgtcaacgtactaccgcgagccggcccctctccgcacgtccaccgacgacgctctggaggcgcctaaggagttcgtggccccgcagctggaccccagcacgccgtacccgatcttcggcggcagcacgggcggtctgctccgcaaggcgcacgtggaggagttctacgtcatcacgtggacgtcccccaaggagcaggtgttcgagatgcccacc

SEQ ID NO: 40923 - DNA, 448 bp, Zea mays
  Clone ID: LIB3062-032-Q1-K1-A12
acgcgcatctggaccatggtcgctggtggtggtgctagtgtcatgtatgctgatacagttggaggcttgggatatgcgtcagagcttggaaactatgcagagtatagtggtgctcctaatgaggaggaggttctgaattattctagagttgttcttgattgtgcaactgctgatcctgatggccgcaagagagcccttctcattggaggtggcatagctaacttcactgatgttgctaccacattcaatggcatcatccgagccttaagggagaaggaatccaagttgaaggcttcaagaatgcacatttatgtccgccgaggtggtccaaattaccaatctggactggctaaaatgcgtaagcttggtgcagaactcggcgttccaattgaggtgtatgggccagaagcgactatgactggaatctgcaaacaagcaattgaatgca

SEQ ID NO: 40924 - DNA, 430 bp, Zea mays
  Clone ID: LIB3062-032-Q1-K1-A2
acggggatccccgatggggatttatccccggggataacggagatggggaagaaatgtcccccggagcgttcgtggggatccgcgcggggaagttttttcatcgcggggactgggatgggtagccaaaacccgacggtgaattccccgttgccatctctacttgccagtcgagatggaataaaataaatgtcaggcgcacgtactgacgtgttattacgatatttctcccctacagataaatgctctgtttattccctgcctaacttatctaacttttctatttaaagttgaagttagttatttaattcgaacaactaatcttaaatgaaatatggtatagttagccacaaatcagacagacctaaaaactcggtcagcaaggtggccaatggtattattatttaaaaaacttgatcttgcgaatttacac

SEQ ID NO: 40925 - DNA, 413 bp, Zea mays
  Clone ID: LIB3062-032-Q1-K1-A3
tcccggtcgaggacgcggacgcgagtcaccttcaaagaatgcaatatggtgcatgtgcctcgtttcttgggttggtttgctggctcggctggaatgtcatagcaggtactacagcttggatcaagggggaaggtgttaagatctggttattggcaataatttacttcatatctggtgttcctggagcatatgttttgtggtatcgtcctctgtataatgcaatgaggactgatagtgcattgaagtttggattgttcttcttgctttacttgttccatattcttttctgcgtgtttgctgctgaggctcctcctgctgtatttgagggataatcattggcaggaattttgccagcaattgatcttatcagcgtgaatgctttgggtgggatattctactttgttggatttgga

SEQ ID NO: 40926 - DNA, 224 bp, Zea mays
  Clone ID: LIB3062-032-Q1-K1-A6
tttcacgaggtgctcccctgggtaaggatatccaagacttcatgatagtgaccagctatgcatacttaatccagggctatagtttaacaaaaacaactagacctaacactgtcttatatatctactacatgaccctagtcagaatcactggcatacctgccacctacaccataaattctctgaaaaaattacccgagatgggctatgatccactcggaatccct

SEQ ID NO: 40927 - DNA, 404 bp, Zea mays
  Clone ID: LIB3062-032-Q1-K1-A8
acgcggacgcgtgggtttggctgctgctgagccatcatactttatcgcagaagaaccggaagaggacaacattcttgataccagaacatatgatgttagcataacgtatgacaagtactaccaaactccacgtgtctggctaactggatatgacgagtcaagaatgccattaatgcctgaacttgtgtttgaagacatcagccaagaccacgcacgaaaaacggtgactattgaggaccatcctcacttattggctgggaagcatgcatcagtgcacccatgcaaacatgcagctgtgatgaaaaagatcatcgacgttccaatgtcggggggagtggaaccagaagttgacaagtaccttttcatatttttgaaaatcatagcgacagtcataccgactattg

SEQ ID NO: 40928 - DNA, 397 bp, Zea mays
  Clone ID: LIB3062-032-Q1-K1-A9
aagcttgctcaagaaattgttgacggtagtccaagtggtggcatagaagctaataatggttctaccatcagcgaagtatacaaagatacccagtctcgtgcatctggtgaagcatgcaatgatggtcagtctcatggtgatgaaaatatgaaacttggtgaagcttacactgaactgcagctggcaccttcctctggtgaggacgccatgacatgtatctgtagtgagctgcccagccatgaggtggaggctccaagcagtgaccctttggagaataatgaagaaacgaaaaatgaaactgctgctcaaggatcagtaaatgaggattctgctcctcgtgctgaacatgcacagattgatgaagctgacacagaacacgaactgcttccatctggtg

SEQ ID NO: 40929 - DNA, 342 bp, Zea mays
  unsure at all n locations
  Clone ID: LIB3062-032-Q1-K1-B1
gacgctttccggttccgccgcctgatcgaagggaacgagcaagggatagccatggcgagcgagcgcacgggggtnagcgatgctgagcatcaccagaagcagagcctgatggacaaggctaaggggttcgtcgcggagaagatcgcgcacatccccaagcccgatgccacgctggacggcgtgacattcaagggcctgagccgggagtgcatcacgctgcacagcagcgtgaacgtgtccaacccctacgaccaccggctccccatctgcgaggtgacctacacgctccggtgctccggcaaggaggtggcgtccggcaccatgccggaccccggctggatc

SEQ ID NO: 40930 - DNA, 331 bp, Zea mays
  Clone ID: LIB3062-032-Q1-K1-B10
acgctctcctcgagagatctcgcgctccggggatcgggcgcggcggacggaagatcgggaagtgccctgcccaccccggatgctcttcccgaaccgcatcaactacctggccccgatcctcgcctccgccgccatcctgctcctcctactctcgggctacttctagctccccttcatctccaccccgacaccactcctcgcggacgcaacgcgcttacccaccgcgctcgactccgtcagatcgcgcgaccgcaaccccttcacctcgctcctacaggccttcgcgtgctgggacaccgacgtaggctgcccccgcatccgcaccaagctc

SEQ ID NO: 40931 - DNA, 316 bp, Zea mays
  Clone ID: LIB3062-032-Q1-K1-B11
cggaccccatcgccttcaacttcaggttttacccttactgcaccgaaccacggccatctggtgatcacctacggggcttcttcgctttacctggccccacttccgacactgcattttcatccgcagccctccttatccacctcgctcatgactgcacgcaagtactactacacctacatgctcatttcccggccctgcgacctcgctcccacgcctttgaccggaactgctccctcttcaggcggctcacggatcgggacctcctcatgctcaccgtcagaggggcaccgagccgtgccatcaacctgttgctcac

SEQ ID NO: 40932 - DNA, 433 bp, Zea mays
  Clone ID: LIB3062-032-Q1-K1-B12
acggtggaggagcagccatggcttcatcgggggccgccgcggcgagcacattcctgggcaccgggctggcggacccggggcgacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaagtgttcggccttcagcggttccgcgagtg

SEQ ID NO: 40933 - DNA, 407 bp, Zea mays
  Clone ID: LIB3062-032-Q1-K1-B2
acgcaaaaaagtttgcttctatgctggtgagctttatgagcaagtgttaccctggtgaagatggtactgcaattgcacgtggggtcctaatgtatctatctcaagggaacctgagagatgcaaatttacttatggatgagatgaaggaacaactaaaatctgttaactcggattttccgaaaacagatttgattcagttcatcatgtatcttttaccaacgcttgagagagatgcttatcctctttttaggacacttcgacagaagtataagacaagcacagatcgtgacactgtgtttcaggagttactggacgaaatagctgcaaaattttacaatatacaacgccagaaccctttagaaggacttttcagcgaaatgttcaagatataatgcatgagaaaagaa

SEQ ID NO: 40934 - DNA, 248 bp, Zea mays
  Clone ID: LIB3062-032-Q1-K1-B3
gaacgcacacacacacacacatacaagtggttggcaaagccaaatgtatgtactaccaaccagctggctcgggcagaatcagacggccatcatgtctgaggagaagcaccaccacttattcaaccaccacaagaaggactagtagcatctctacagcaagtacggatactccgagaccgaagtcttcaccttcaccggcaaaggctattactagaggtacaagaaggacgataacgagcacaaactca

SEQ ID NO: 40935 - DNA, 371 bp, Zea mays
  Clone ID: LIB3062-032-Q1-K1-B4
ctccagaattaggtatgttctcgtagttcttgagtagcagcaatgatggcatgcaaatcagccgagaaaggaagaacagatctagtatttcgtctgaattcataatatgttcttcctttcagctgagaaatttagtatgggcaacatcgaagcatgatgtctacctgttattgcattactctgtacttcactggtcggccttaaatggtgtggatacagaaattatggatgtacatggacatgttgcaccgagtgagaagcacccaggaagcttattagaaggttttgtgcatactcaaattagtaccatggcaatgaaagataatttgttagtagctggtgggtttcaaggagagctaatatgcaaacac

SEQ ID NO: 40936 - DNA, 447 bp, Zea mays
  Clone ID: LIB3062-032-Q1-K1-B5
ggaagaagttgacaggaggttgcaagaatatgaacaaggaaggactgagttttgggcagaggaagacgctcatgtggtgggtgactgtgtaaagcatgttctccgagagctgccatcatcccccgtgcctgcttcttgctgtacagcattattggaagcgtttcgcctggagactaaggatgctaggataaatgctatgcgttcagctatatctgagacatttcctgagcccaatcggaggttgctgcagagaattctaaaaatgatgcacactgttgcatctcacacctctgaaaatcgaatgactgcatcggcagttgctgcctgtatggcgcctcttctgttgcgtccacttctggctggtgaatgtgagatggatgaagtatttgatatggatggtgatgattcttcacaggttcttgctgcagcaaacgccgcaaacagtgc

SEQ ID NO: 40937 - DNA, 296 bp, Zea mays
  unsure at all n locations
  Clone ID: LIB3062-032-Q1-K1-B7
ggactcntacngaatgaaattaaaagatttaagaaggagagactccatgatttgttggagatgctgggaggcgttgtatcagatgagcaatggatcgaatcttgcacgagctacagtcatacaaagtactaaaaagaaagagctggcttctcccgaggcttcgagcacatctgaaatgccactactataatgtggcacgaaagaagtacacaatgtggacgacacagcaataaccaatcaaatgactagacataatcattgcgcaatggcctaaatttgctgtgttcataccaaac

SEQ ID NO: 40938 - DNA, 329 bp, Zea mays
  unsure at all n locations
  Clone ID: LIB3062-032-Q1-K1-B8
gtgatgggtgaacgattggcacattaggttacttgagaaatgaacagaataccgtgtatcggaaanatctcttgggttgcacactctgttggatgattggttgctagatatgctattgtaagactttataaaccacctaaacgaacatcagaaattactccacaaactctgtattacaacaatatatgtaccatacatggacttgaggcaccgaactttataacagttgcgttaccgcatcttgcttccagaggaactaatcaggttcctttactatgtggaagtactgcatttgaaaatagtgcatgctacattattcaattgatatt

SEQ ID NO: 40939 - DNA, 377 bp, Zea mays
  Clone ID: LIB3062-032-Q1-K1-A1
gcgatcattatgtagcattcatagataaaaagtgacgtggcaaaatccaaaacttgacagtacggaacaggatccaggacaaaacagaacccaaaatttgactcccgcagttcttagctataatatagatatcgcatttagacatgcacccgacgagtagagctctccactcaaaccatcctaagcctctactgtctcagttggggcctcgagcacaagacccttggtgggctttgccagcaggtcggtgtactgctggaacggggccatggagaacttggtctggctccagaattcaggagtgaggaagccgtaagtcttcatcaggcagtcgaaggttgccttgacgaagttgccaagggtcttaatggagccac

SEQ ID NO: 40940 - DNA, 424 bp, Zea mays
  unsure at all n locations
  Clone ID: LIB3062-027-Q1-K1-G5
acaagcagagcagagcagagcagcgtcgtgcgtccgagaagaagacgactcacaagagcagaacgagcaccgatcgatggcagtgatggccggggcggcgtccatggaggtggagcagggacctcccgggcttccggttccatcccaccgaggaggagctcctcggcttctacctctcccgcgtggtccacggcaagcagctccacttcgacatcatcggcagcctcaacatctaccgctgcctcccaaggaggacatggtgatctgcaagatctacaggaaggccacgccactgaaggagctcgagcagagggcctctgccatggaggagatgcagacgcgcatcggcggggctagagcaacatccctggtccaggccgncggctccaccggcgacgactacctgtcgtccgacgacacaagc

SEQ ID NO: 40941 - DNA, 433 bp, Zea mays
  unsure at all n locations
  Clone ID: LIB3062-027-Q1-K1-G6
cgcgaacggagcagaaggccatggacacgatgcggggcgcgctggagcgggccaagatgctggtgggcatggaggtcgacgaggagtccgcgttgccaccgcccgaggagcagtccttcnttcngngacatcaatcggcactgcaccctcaacaccactcagaggctctatggtttcgcgatatgcttggctgccggactgacgtgcacattcttgtcaatgcttgtcttcttcaatccagtgaaatttggggtagcattcacccttggcaatttgatggcccttggaagtacagcatttctcataggccccaaaagacagtttgatatgatgcttgattctgtgcgaatatatgccactgctatatatattgcaagcatcataattgctctattctgtgctatctacgttcgcagcaagctgctgactctag

SEQ ID NO: 40942 - DNA, 387 bp, Zea mays
  Clone ID: LIB3062-027-Q1-K1-G7
tccacccacgcattcgcggtcacagttcactcgttgaccagcatccgatgctgaaaggagagctagaggctggcatggtgaagcgctaccgttcagctgatctgacgggctcactcttgaatgactgggatattctgaagaaaacgactcaagtgaagcattcaacggctctgatccaaggcatgcatccgccgatcaagatcaaagctcgatgctcaacgtcatttactaaccagaaggatcgtttccatgcacatctgcgctaaactgacgacgaactgacgagactactagataagcatcagatgctgactagtgaactggaaaaaactatagctgatgatgcgcaacttgttcgaaagattcaatcttatcaaaactataacc

SEQ ID NO: 40943 - DNA, 241 bp, Zea mays
  Clone ID: LIB3062-027-Q1-K1-G8
tccacccacgcgtacgcgatcgggtgacacaggcaccacactagcttattcgacggctgcagaacggtaggggggagatcacatgcaccccgctcaacccaacctcctaccctttccgacaaggctacgcaaagcgaggcttgcccgctgtaccactgcatgctgctgctgaagacaatcggcaaccagtgacgtcctatctgaactggtgactcaaatggcgcgcatcgcatgccaaccc

SEQ ID NO: 40944 - DNA, 378 bp, Zea mays
  Clone ID: LIB3062-027-Q1-K1-G9
ctcgagtcctcgcagtcgctcactgcgtgcgccaaaagcagcagcagctccagccggggccgtgtgcactctccagtctccaccactgctccgcgcgcgccggatcgagggagggcaggcggacgaggaggagggatgagtctattcgggcttggacgaaaccagaagacattccgccccaagaagagcgctccatcaggtagcaagggagcacagctccgaaagcacatagatgccactctcggcagtggaaaccttagggaagctgtgaggttgcctcctggagaggatatcaatgaatggctcgcggggaatactgtggattactttaaccaagttaatatgctgaatggaacactcacagaattttgaacacct

SEQ ID NO: 40945 - DNA, 437 bp, Zea mays
  unsure at all n locations
  Clone ID: LIB3062-027-Q1-K1-H1
cagctagctagcatacagacgaataatctcttcttcacctcactaacaccagctagcaactctttctctcctgcaataatggccgctcgctcctcctcctcccagccgcagctggtcgcggcggcggcggggagatggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccnncgcaagtgcggcgtctccgtcggcgtgcccatc

SEQ ID NO: 40946 - DNA, 393 bp, Zea mays
  unsure at all n locations
  Clone ID: LIB3062-027-Q1-K1-H11
cggaataatctctacttcacctgactaacaccagctagcaactctttctctcctgcaaggatgggcgctcgctcctcctgctcccagccgcaactgcgtcgcggccgcggcggtcctggcagcggcgctgctgctgctggcggcggaggccgggacggcgtccgcggcggtgagctgcggcgaggtgacgtcgtcggtggcgccgcgcctcgggtacgcgatgggcagcgcggcgtcgccctccgcggcgtgctgcagcggggtgcgctcgctcaacagccgcgcgtcgtcagcggccgaccggcaggccacctgcaactgcctcaagagcatgacgggccggctcggcggcggcgtcagcatggccaacgccgncaacatccccggcaagtg

SEQ ID NO: 40947 - DNA, 442 bp, Zea mays
  Clone ID: LIB3062-027-Q1-K1-H12
ttccggctcgagcacgcgtccgatggaatcgtctcgctcgtggctgccttactcgtgctgcttgccctcgccgccgtttgctccaggcgcagcgcacaaaaggagtacgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaagcatctgcaggaattcaagcctgttgaaaagggtgctatcgcctaaggatctgtcgtctccctgtgca

SEQ ID NO: 40948 - DNA, 302 bp, Zea mays
  Clone ID: LIB3062-027-Q1-K1-H2
tcgggttccaccttctcgtccactacgtgttgaaaccctatcgacccaccatggcttgggtcccagtcaccgctcggttgtccttcttttagacccagctggcgtactccgctgccgttgcttgacagtcgccttcctgatgttcccagcgccatacggggacgcctccgcaccggcgatgctgaatacagtcgacttcgtggtctctaacgtggacgacctcatgaactggccgcgtaaggtctcgatctggcccatgacctatcggctcgcctgcttcacgatgcagatgatgcacgccg

SEQ ID NO: 40949 - DNA, 418 bp, Zea mays
  Clone ID: LIB3062-027-Q1-K1-H3
gggagacagacgcgtatacccaggcgttggttgaggaggaggagaagaaggggaaggtgatggcttcctccgggtacgccttatggtccaagcggtggatccgttccgaggtgtgcatacggtgttcgtgccgatggccgtggccctgggtatctgctcgtaccagcttgtgcgcaacatcacgggcaaccacgaggtgcgggtgaccaaggagaagatggcggacggcgtcctggacaaccacgactagggcgagaggtacgccatgcactgcctcaggaagttcgtccgcgggaagaagccctagatcatggctttcatcaacttcttcttcgtcgacccttccaaggacgattaagctagattccgtcatggatggatgagtatgttttaccaatcattagctgccggtggcgcg

SEQ ID NO: 40950 - DNA, 348 bp, Zea mays
  Clone ID: LIB3062-027-Q1-K1-H4
gtctcaactgaccgcctgttattcataattcctgctacatggcaaggcatagaggcctcaaggttgcttgaatctgaaggaattcaaacgcatctaacatttgtttacagtttcgcactaaagcggcagcggcagcacaagctggtgcatctgtagtacaaatgtttgtgggccgattgcgggactgggcaaggcatcactctggtgacccagagatagatgaagctttgaagaatggagaagatgctgggctttctttggcgaagaaagtatatgcctatattcacaggaatgggtacaaaacaaagctgatggccgctgccataccgaacaagcaggacgtattta

SEQ ID NO: 40951 - DNA, 369 bp, Zea mays
  Clone ID: LIB3062-027-Q1-K1-H6
gcacacgatcttccacgagcgggtgcctccagaagctatatatctcgattcacgtctgctccactattcaggaagtctaagatgcactgctcttgaagcgtgtgcacatccattctttgatgagttgcgagagccacaattggccgtggccaactggaccgccatttcctacactgttcaactttaaacaggaactatcaaatgcctccacggagctcatcaacaggctgaccccagaccatgctaggcggcatcttgggctcactttattgcccaccactggaccatatgcgaaggctctatggtgtttaaaccttgctcgttctgattcttcgttgtgccataggcattgcaaggtgtagaatctga

SEQ ID NO: 40952 - DNA, 429 bp, Zea mays
  Clone ID: LIB3062-027-Q1-K1-H7
acggtgccggacgatgtgatcggcagcgccgggagccccgacaagtactggagcccgcgagccgagaccggcgtgttcggcccggcggcagtggaccccaagctggcagctggtggcgcgtcccttacgccggcgcggatgctgcaggaggcacggtgctggaccagaaggtgtggttccgcccgctcgaggacgtcgagaagccgccccccgccgcgtgagccgcgcggcgctgctagcccagcccacactgctgctcgctcataaaaagggcggcgggagagcctggcaggcactctgctcgtgctcggctgggctggactccctgcttatatcactacaatattatactactagtagtggtgcttgatagcagtgtgtggctgtgctaataccagtataatactggttctactataatcagtcgta

SEQ ID NO: 40953 - DNA, 294 bp, Zea mays
  Clone ID: LIB3062-027-Q1-K1-H9
ggaagccgtacctcataagattgctcttactgctgcctacaccgatgggctatctcagcccatgaaactggtcatataggcctgaccatacatggttcgacaacgtgccggacctggagctaaacatagataatgccgaacactactgcatacgcgtagacggactcagatcactctacgcttggtgcggtacaaagtttactgtcacagcattcgatcacgatgacgacatcatcatgctatctcacgtctacgacagatccatctatacgactctatgacagcttctatagc

SEQ ID NO: 40954 - DNA, 179 bp, Zea mays
  Clone ID: LIB3062-028-Q1-K1-A1
gtcactataatattcctataatacctgcatccccataatgaactattcatgtagtataacatctcaaacggttctccaaacaagacgcacttaaatttactgaatcacaacttaatctacctccactttttatatactgatattatacattacacactataccacataattaacatact

SEQ ID NO: 40955 - DNA, 277 bp, Zea mays
  Clone ID: LIB3062-028-Q1-K1-A10
attgggtccttgacctgcacacctcgctgggattgaccttgttgagtcgaccaactggtctggccctttcttccgagaggctcgtagttatcgttgccgacatgtactatttgctggcatcgttggccggaagccatggatggagactgatttgctgttaattgcttctacatgtccaccatcttcttggttcgctagagatctcttcttgacgtggtaccacgactcgagccctggctggtgacttggccttctgtcagttgaggcctatgctgct

SEQ ID NO: 40956 - DNA, 444 bp, Zea mays
  Clone ID: LIB3062-027-Q1-K1-G3
ggaattccgggaaaggattgtcgaactaacttcaaaggttgaagagcagcaaaagctgattttgaaacttgaggatgacataggaaagggctacagttcaactgataggaggggctcactcttgaatgactgggatattgcagagaaatcggctcaagtgaagcatccgagggctctgatccaaggcatgcatcggcagatcaagatcaaagttcgatgctcaaggtcatttgcaaccagagggatcgtttccgtgcacgtctgcgtgaaactgaggaggaactgaagagactaaaagagaagcatgagatgctgactgatgaactggaaaaaactaaatctgataatgtgcaactgtatagaaagattcgatatgttcaagactataaccacgacaagattgcttccacgggaccagacaagtacgcataagatattgaaagt

SEQ ID NO: 40957 - DNA, 404 bp, Zea mays
  Clone ID: LIB3062-027-Q1-K1-E9
agttgattgagaatggagaagactgccagctggatagatataagtcatctgagaaatgaggacggagtcgatggctatggtcccgcctcattactcagccttctagctttgctccagttaagggcctttacctctatggtggtgttggtacagggaagacgatgcttatggacttgttctatgaacagctgccatctaattggagaaaaaaacgtattcactttcatgatttcatgttgaacgtacatagtcgtcttcagatgcataaaggtgtttcagatccccttgatgttgtagcagctgagatttcagatgaggccatcatattatgtcttgatgagtttatggtaactgatgttgctgatgctatgattctgaaccggctgttcagacaattgttcagc

SEQ ID NO: 40958 - DNA, 68 bp, Zea mays
  Clone ID: LIB3062-027-Q1-K1-F1
cgctacgtggatagcgtcttcatatagtatcacgccaaacttcaattcagctggcacgctcgttttac

SEQ ID NO: 40959 - DNA, 365 bp, Zea mays
  Clone ID: LIB3062-027-Q1-K1-F11
cgcctctctttcggttctcacggcgactactggtcgagcgccgcctgccctccctcggtgcgtgaggtcctcgccggcgactagtgccttcgtccgtttccatgtattttccgccgattagtgtccaccagatctagtgaacgctggttacttgactcaaggtgttcaagaaatttaagccacacactcttcatcatatgcccaggcaatatttgtgttaatctcagggacctccagtagattgctgagagttatccttgatacaggggaatatagacacagaattttttgaacattgatctgtagccagtgctgcaatggctacaaagcttgtggttctcggtatcccctgggatgttgacact

SEQ ID NO: 40960 - DNA, 433 bp, Zea mays
  Clone ID: LIB3062-027-Q1-K1-F12
tcgattcccggtcgactacgcgtccggtgcagggaacttttagtggctgttgccagtggatgggataagcatgtggttatcagggacaagataattccccaggcttggaaggatgaacctgtggcaaggattcttgagctctgcattctacatattgctatggctgagatggcatcaaaaggaacaccccacaaagttgtcattaatgaggcagtagatctggcaaagcgattttgtgatggtggtgcccctcgggtaatcaacggatgccttcgaacatttgtgaaggatcatgttgatgttgcaggcacgagccaagaagctaaatcaaaatcatgattttttgcaaatactcatacaacaaaatggtggctgaagtaaagaagtacggagagaaccttgctgtcttgagttcaagcgaataccttctgtc

SEQ ID NO: 40961 - DNA, 369 bp, Zea mays
  Clone ID: LIB3062-027-Q1-K1-F2
gtacgaacttggagatcagagagaccgaggcgcccgtggatgtgcttgccttccttgacccgttggggagggaattttctggagtctgcgactcgagcagggctgcgctggcgctgacatggatgatcctggttcgtgcgtggaggcagcggaagctgaagtggctgcgatgagaacactctcggtagcactgatctgtgcggggccagatcgtggcgctcacgtacttgatactgcatgccatgtccagaatgataccatgacacggcttgcagatcctggatcattaccggaagaacgatcacagcccgacatgcaacctaggcacttgaaaagacgcaaagcgcatacggttagagaaatctatgt

SEQ ID NO: 40962 - DNA, 415 bp, Zea mays
  Clone ID: LIB3062-027-Q1-K1-F3
agaagagacagaaacagtaagggtttgactgtttggctaacgtcatggcgtgaacgtctccgcgccgctcctctggcggggactcagcttccccgtccgcacccctcatcccacttcgccgccgacctccccggcatccggcccctccggtggcccgctagggcggctcacgagcctccgcggcgcggcgcggttcatccgccgcacggggagccggcgcctgatgagggagccctccgtggcggtgcgggagacggccgccgagcacctcgaggagcgccagaccgactgggcctactcgaagcccgtcgtcgtgctcgacatgctctggaacctcgccttcgtcgccgtcgccgcggccgtactcgccgcatcggtgggcgagcggcccaccgtgccgctccgtgtctggatc

SEQ ID NO: 40963 - DNA, 407 bp, Zea mays
  Clone ID: LIB3062-027-Q1-K1-F4
gaatcctaagaatcttgattctcttgcaagaaagctagttggacaagaggctaaggtctaacctgcactgaatgccatcttatctataatcttacggacatctatagcgcaggatatctgttgctgctgattatgtattcaagtgtttctgcgagagaaatcctaatggccaggcattattagcatcaactattgctccacatccaaaccaaggagatattgatgaacctgctagtgacatgccttttggaagtgtacttctgcaagctctggattctagatactggtgcgtttgcaccgaggtcacactctgatgcttgtctaatccattgactaggcgatttaccaccttttgccggcttcatgatcgaaaaatatttgccatcaagcttatgaaaatacatctt

SEQ ID NO: 40964 - DNA, 428 bp, Zea mays
  Clone ID: LIB3062-027-Q1-K1-F6
cgggatccttagaatcttgattttcttgttagaaagctagttggacaagagggtcaagttcaacctgcactgggtgccgtcttatctataatcttacggacatctatagcgcacgaattccgttgctgctgattatgtattcacgtgtttctgcgagagaaatcctaatggccaggcattattagcatcaactattgctccacatccaaaccaaggagatattcatgaacctgctagtgacatgccttttggaagtgtacttctgcaagctctggattctagatactggtgcgtttagcaccgaggtcacactcttatgcttgtctaatcaattgactatgtgatataccaccttttgccggtttcatgattaaaaaacattttttttaattatttacctttttattatcgtttaaatcaactttaaa

SEQ ID NO: 40965 - DNA, 427 bp, Zea mays
  Clone ID: LIB3062-027-Q1-K1-F7
ggttgtccttaaccaaatgtcaaccattgcaggtccatgcaccgtgtcactgtctgttttagaaaaaggtagggatgtgcatctccaataatgcaatatgtcacataacgaaggaaacaatgattatacaactacttgtatgctagtttcagacactcatgtatttagacatctgcaataatgcaatatgtcacataacttgattttatattttggtcatgaggtaggttgcacttgttcaaatgggtttttgtattaacaaatgatatggtttcagatgattactcttggaggttcttctgaactggacttgttgattacatggcccattttcagaaggtgttgttttcagtgtgaggcctacaaagaaaagttggaaaaacatttccaatatatcttgtggtgagaaagtatgttccatccatgt

SEQ ID NO: 40966 - DNA, 375 bp, Zea mays
  Clone ID: LIB3062-027-Q1-K1-F8
ctttcaatccttcatgaaagaaactaccttggtgttgtagatactggtgcactttgttaaagccttgggtcaaagagtgcgatcttatctataatcttacggacatctatagcgcatgaatatctgttgctgctgattatgtattcaagtgtttctgcgagagaaatcctaatggccaggcattattagcatcaactattgcttcacatccaaaccaaggagatattcatgaacctgctagtgacatgccttttggaagtgtacttttgcaagctctggattctagatactggtgcgtttgcaccgatgtcacactctgatgcttgtctaatcaaaagactaagtgatttaccaccttttgccggtttcatgatt

SEQ ID NO: 40967 - DNA, 299 bp, Zea mays
  Clone ID: LIB3062-027-Q1-K1-F9
tttactagaacgagattaattgccaaactgagctttacatcgatatctacgaatactagatcacgaacatgatcttcatcatcgacaggcacatcagcatgaagaacttagtccttatcaacttcattcagactatagctatgtacgatactaactagttcatgttagaattacatgcaatctctaatttctctattatcaaacacttgccagagctgttgaactaaggatacctcgatgatgctagaatggtcgataccacgatccacatcgatgataaccagtacacctgtgaactc

SEQ ID NO: 40968 - DNA, 420 bp, Zea mays
  Clone ID: LIB3062-027-Q1-K1-G1
ggtgggttggcttctcctccccctccggttcgggttcgggttcgtgaggttctccggggttcggtttcgtgggtgagcggatcgagatggcggcgtcggatgttgagtaccagcatgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcagcggcaggtacggtggtggccgtggaggcggcggctacggcagtggcgg

SEQ ID NO: 40969 - DNA, 427 bp, Zea mays
  Clone ID: LIB3062-027-Q1-K1-G10
accattcccgaatggacgccacgcgtccggcgtactacgcacagtacctcaacgcttgcgcctaaagcaacatcagatccacccgggtccatgtacactctccagtctccaccaatgctaacctctcaccagatcgatgcagggctatcagacgactaatattatcgaaagtcatcatcctatgagccaaagactaaaccttggcggctcaatggtcagacagacaacatcaagtgcttccgcagctgccccacagacaaggatcgacatgtttatctccggagactctccgaatagcgcgtctgatttgagcttacctaatgtccacagcgagcttagctctagcaactgcaactttgacagcctcctcaactccataatcaaagtgtaaaagagacgatgcttacttcagcgatgacctgggatg

SEQ ID NO: 40970 - DNA, 415 bp, Zea mays
  Clone ID: LIB3062-027-Q1-K1-G11
ctggttttttcagtgaggatagcgttaaattaggtgatctggatgtgaatgatcagggatttagtgaagctacaaaggagccaggccttaccttcatggttgcaaaatttgatggcattcttgggctaggctttcaggaaatatctgttgggaatgcaacacctgtgtggtataacatggtaaaacaaggtctcatcagtgaccctgttttctctttctggtttaaccgacatgctggtgaaggagaaggtggtgaaattgtgtttggtggaatggattctagtcactacaagggtgatcacacctatgtcccagtcactcagaagggatactggcagtttaacatgggtgatgtcctggttgatggaaagtccactgggttttgtgctggtggttgtgcagcaatagcagattc

SEQ ID NO: 40971 - DNA, 430 bp, Zea mays
  Clone ID: LIB3062-027-Q1-K1-G12
catctacattaacagctctccttcaacgatcattctaaactacttggacggcaatctcaactacaccgagcataggattagggtacgcaagcatcttgcatggtcatcagcctccaaatgctgggctggcttacctcaatggtccttcacttattggatctgctggactgccccaagttgaagcaaaatatcctgcttcgctattcaaacagcagctcgtggatctaattgaaaaggcttatggcatgataagtgacagcgtgaagaacgagctaaaccctctgctcgaatcgcgtatacaggatccacgaacttctgactcgagtatcgcagaacgcaatcttaatgccatgggtcatcagaaccaactgacatattgtctgggcatagtgaaaattctgactagctacttgcatgtactgagggcaaa

SEQ ID NO: 40972 - DNA, 377 bp, Zea mays
  Clone ID: LIB3062-027-Q1-K1-G2
gcgagaagcccagaaggtgagaagatagatagagagagagagagtgatcggtacagggatcaccgctgtgcctgcgcgtgctgcttcaccgaatcgagtcagaccctgtccgaatctctgagccaagggatggcaaccggtagtgaggcctccaatgcagctgaagctgtggttgactggcataaacaggacagcaagaggatgctccatgcggtttaccgtgttggggatctggaccgtacaatcaagtactacacggaatgctttgggatgaaactgctgaggaaaagggatgttcctgatgagaagtacaccaacgcctttcttggctttgggccagagaacaccaactttgcagttgaatcgacatacaacta

SEQ ID NO: 40973 - DNA, 431 bp, Zea mays
  Clone ID: LIB3062-027-Q1-K1-E8
ggattgttggcaataattccccagattctgagcatagattgtcaaagtccttgaggcctgctaactatgaagaaaggaattccacacgtgacagttcttacaagaactcaggcaaacctatgacctagtcagggcagcacagatacaagtggagatgaggaacacagtcgtgctagagaaaatgcccggaaagcaaattcatgtcgtaggaaaacaaaggatctctcggcaggtctgcaacctaagaaaatcagtgctggtgactcaagccccagagacaaatctccattcattttacaacagagtggcaaggtcgtccaaaagaaacaccccgatcaattgtcagaatcatcagaagatgagcttgctggtagaagaacaaagcatcaaactgattcacctgatgattctcgtcgaaaacagcattcccc

SEQ ID NO: 40974 - DNA, 294 bp, Zea mays
  Clone ID: LIB3062-027-Q1-K1-D4
ggcttctcctacctctcttaccaagttctcttcgggttagggttacttagggtttggtggaggtgcaatggcagctgctgatgtggagtaccagctgcttcgctcgacgggcttgcacttcagacaccagcaacgaagtcctcgagaatgcctacgtctgctactgctagatcctcgactccaatgtaataaaccgaccgcgagacggtgaggtcttacggcttcggcttcgttaccttctactacgagaactacatgctagacgctatcgagaacatgaacggcaacgatctc

SEQ ID NO: 40975 - DNA, 417 bp, Zea mays
  Clone ID: LIB3062-027-Q1-K1-D5
tcggcgcgtgcgctgctgggagtacaggcagcagccgtacatcgtccgcctgaccaggggcacccgacccgacaaggcccgtcgtctcggctacaaggccaagcagggatatgttgtcataccgtgtccgtgtgaagcgtggtggcaggaagaggcctgtgcccaagggtattgtctatggcaagcccaagcaccagggtatcacccagctcaagttccagaggaacaagatgtctgtcgctgaggagagagctggacgtaagctcggtggactgagggttcttaactcctactgggcgaatgaggatagtacctacaagtactttgagatcatccttgtggacgttgcccacaaagccatcaaaaccgacccgaggatcaactggctatgcaaccctgtgcacaagcaccgtgagc

SEQ ID NO: 40976 - DNA, 216 bp, Zea mays
  Clone ID: LIB3062-027-Q1-K1-D6
gccaccagcaacgattcactaagaactgccttcggctcatacggctagaccctagactccaaagtcatcacctaccgaggaaccaaaagctattgcggattatgctgctttgcctgatccgactgaaactacatgctcgacgctatagagaacatgaacagcaaggacctagactgccgtagcattactcttaactatgacccaaccattggctgt

SEQ ID NO: 40977 - DNA, 412 bp, Zea mays
  Clone ID: LIB3062-027-Q1-K1-D7
cggacgcgtgggcggacgcgtgggcgcgccggcacccgcacgcatggtgctgtgcgacgaagtggaccccacgcacgccggcgctaccggcgccattaccgtcttgccggcacggcgccacggaccgcgcggtggccgccgccgccgccgcgccggcgtccgcgagcggcggcgacgacgacgacgtctgggacgagctgcgcgcggaggcgcaggccgacgcggacgccgagcctctgctccgcaagttctacgccgacctcgtcctgtcgcgcccgtcgctggagggccgcctcgccgcgcacctgtcggccaagctctgcgtccccggcgcgctgccgcaggacgcgctccgggacctactggccggcgcgctggccgcgcgcccggagtccggccgcgccgcgcgcgc

SEQ ID NO: 40978 - DNA, 414 bp, Zea mays
  Clone ID: LIB3062-027-Q1-K1-D8
cgagatcctgaagctcatgtcctcgacgtttctgatcgccctgtgccaggccgtggacctgcgccacatcgaggagaacgtcaagagcgccgtcaagagctgcgtgctgacggtggcgaaaagaagactctgagcaccgactccaccggtggcctccacgtcgcccgcttctgcgagaaggacctgctccaggagatcgagcgcgaggcggtgttcgcgtatgccgacgacccctgcagcgctaactacccgctgatgaagaagcttcgcaacgtgctcgtggagcgcgccctcgacaacggcgctgctgagttcaacgcggagacattcgggttcgccaaggtcgtccagttcgaggaggacctgcgcgcggtgctgcccaaggcggttgaagatgcacgggcggctgtcgag

SEQ ID NO: 40979 - DNA, 404 bp, Zea mays
  Clone ID: LIB3062-027-Q1-K1-D9
gtgaaattaacaggggacaatctcatgccagctggtcaagttgtcttccgtgcaaaaggtggagatcgctatcagcttcctcataacggaattatccctagagaacttggagtgattgctaggtacaaggggcaaaggaaaattgcacatcctggtttccaaaaccctcgatgggttgatggagagcttttgataatagatggaaagttcatcagagatggtcctgtgatagctttcttttactggacatctaattttcatcgtttagaattctttagactgttgatgcttcctgaatagtccacatctaaaaatagttaaaggccattctgattattgcataactgcattcggagtcaacaggagttgcctggcatcacattttccgatgacagattcttatg

SEQ ID NO: 40980 - DNA, 425 bp, Zea mays
  Clone ID: LIB3062-027-Q1-K1-E1
ggaacccacaaaaggatcaaggatgaaattgagcttggcaatggcctgccagatagcagaagcactcggcaatgtctccaggcagtaaaagacgccgggtttgaggttgtttgcgagataaggatcttgctgaagattctcccttgccttggtacttgcccttggatccaagccgattctccctgagtagcttccgtttgacctctgtgggacgcatgattacccgcacaatggtcaaggccctggagtacgttggtattgctccgcagggcagtgagagggtctctaatttcctggagaaggctgcagaagggctggtagagggcggaaagaaggagatcttcacgccaatgtacttctttcttgttcggaagcctcttatggaatgagctcttggatcaccttttcagagagagaacgcaagt

SEQ ID NO: 40981 - DNA, 408 bp, Zea mays
  Clone ID: LIB3062-027-Q1-K1-E10
gtgatgaaactgtgtcaatgattgaagcatacctgcgagccaataaaatgtttgtggactacagtgagcctccaacagagagaatatactcatcttatcttgagctgaaccttgatgaggtggagcctagcatgtctggcccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcatgggcagccagcagaaatcaagcatggtagtgttgttatagcagcaataactagctgcacaaacacctcaaatcctagtgttatgcttggtgctggtcttgtagctaagaaagcttgcgagttgggtcttg

SEQ ID NO: 40982 - DNA, 387 bp, Zea mays
  Clone ID: LIB3062-027-Q1-K1-E11
cggacgcgtgggcggctccagcatttccaccctcgcgcggcggtcgccggagcgagcagagctgccggaaggcccgtcggatccgccgccgccaagatgaatgacgccgatgtagccaagcagatccagcagatggtgcggttcatccgccaggaggccgacgagaaggccaacgagatctccgtctccgccgaggaggaattcaacattgagaagctgcagcttgttgaagctgagaaaaagaagattagacaagagtatgaacgcaaagagaagcaggttgaagtacggaagaaaattgagtactctatgcagttgaatgcttctcgcatcaaagttcttcaagctcaggatgatctagtaaacaaaatgaaagacgatgcgatg

SEQ ID NO: 40983 - DNA, 384 bp, Zea mays
  Clone ID: LIB3062-027-Q1-K1-E12
ctgcactcatctcttctcgtttagaacctctataatgtcccccactcgccagtctcaggatcggctgtagccatggacgccagcggagccggtagcatggggaagaagggtgcggccgggcgcatggcaggcattcccaggaagatgtcggtgacgctgtccgtcaaggccgagctgatgttccacgtcggccggatcgagcgctacctgaagaaggtccggttcgctcaacgcgtgatcactgtcacccgcgtttaccttgaccgcgtcctggagtacctagccgtcgaggttatagagttggcctgtatcgcggcgaatgacttcaagatgacgcgcatcatactgagcgacgtgctactggcgatccgcaacgacgaggag

SEQ ID NO: 40984 - DNA, 239 bp, Zea mays
  Clone ID: LIB3062-027-Q1-K1-E2
gttctagatcgtgagctcgcgcactttcattagcttgttaatgtcctgacagatagggcaactactacataacgtctacatgctcttgcccaagccaagtacaaagatgattcataatgagacactttgcttaatatcctcccttgacattcacgtcgccctcagatcctagcattatctcctttatgacatggcatgtgagatgaacgacgaatatgattacgaactgctaaaattgt

SEQ ID NO: 40985 - DNA, 420 bp, Zea mays
  Clone ID: LIB3062-027-Q1-K1-E3
ggtgaagccgccgccgctgcagtgtccatagccaccgcaggagactgagatggggggttttgtcaagacccacaagagcaatgcgtacttcaagcgtttccaggtgaagttccttgagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatg

SEQ ID NO: 40986 - DNA, 456 bp, Zea mays
  Clone ID: LIB3062-027-Q1-K1-E4
aatttccaccgagacctacgcgatcgggggcaataattacccatattctgttcatagattgtcaaagtccttgagggctgcgaactatgaagaaaggaattccacacgtgacagttcttacaagaactcaggcaaacctataatacgagtcagggcagcacagatacaagtggagatgaggaacacagtcgtgctagagaaaatgcccggaaagcaaattcatgtcgtaggaaaacaaaggatctctcggcaggtctgcaacctaagaaaatcagtgctggtgactcaagccccagagacaaatctccattcattttacaacagagtggcaaggtcgtccaaaagaaacaccccgatcaattgtcagaatcatcagaagatgagcttgctggtagaagaacaaagcatcaaactgattcacctgatgattctcgtcgaaaacagcattccccgact

SEQ ID NO: 40987 - DNA, 339 bp, Zea mays
  Clone ID: LIB3062-027-Q1-K1-E5
tatagccacctcatgagactcacaggcgggttttcttaataccgaccagagcaatgcctactttaagccttttcacgttaatttcatatgacaacgctctcttccaagacttactacacggccacgataatgcttattaaccaagacaaaaactagtacaatacacccaaatacaaatttcttgtgccatttaccaacaacgacatcacaactcaaatcatctctactaatataacaagtcatattcttcttgcttctgcttactcgcattaatttccacgatattatctttaaacttgtcttaccaactatgcaacttactactacactggccttctc

SEQ ID NO: 40988 - DNA, 436 bp, Zea mays
  unsure at all n locations
  Clone ID: LIB3062-027-Q1-K1-E6
caaaagcaacaaggcaggagcacaagcaagaaccacacctcctcccttcgactgtgatcatgtcgtcttgctgcggcggcaagtgcgggtgcggctccagctgctcctgcggcagcggatgcaacggctgcggtatggtgaacctgacgtggagaccgccgccaccagcagcgtcaagaccacggtcctcgacgcgccgaccaccaaggccagcgccggcggcttcgaggcggccaccgagggcggcggctgcgactgcaacacctgcaagtgcggcaccagctgcagctgctcctgctgcagctgcaactgagccggcccggctcggcgatggcgcacgagagtcgagaggacgacgacgaggaggcgtataataaatataatagcggcgttcagtanataagatcctgtcaactgcacccgtcattatccatgg

SEQ ID NO: 40989 - DNA, 425 bp, Zea mays
  unsure at all n locations
  Clone ID: LIB3062-027-Q1-K1-E7
tcgggtgaagccgccgccgctgtattgtttatagccaccgcaggagactgagagggngggttttgtcaagacccacaagagcaatgcgtacttcaagcctttccaagtgaagttcacttgagaaagcgcgcttgcaagacatactacagggccaggataaagcttattaaccaagacaaatacaagtacaatacacccaaattcagatttgttgtgcgattaaccaccaatgccttcacaacacatatcatctctgctagtttagcaggtgatatggttcttgcttctgcttactcgcatgatttgccacgatatggtctttgaagttggtctgaccaactatgcaactgcctactgcactggccttctgttggctcgccgtgtgctcaagacccctggtttagataaagaatattaaggcaatg

SEQ ID NO: 40990 - DNA, 374 bp, Zea mays
  Clone ID: LIB3062-027-Q1-K1-D3
acggcaccgcagaaaaagaaaaagataaggcataggcaaaggaatcccaatcaggcaagcgaaaggatgaaccagttgctgtggaatgcggagatatcgatgcatctgatcaaggagccattccatcgaacgcgtaggtgctcgtcgggctcaagctgtgcgagcgcaagtcgcgcgagttcatggtggagcttgtcctgctcgacctactccttccgctgcccagactggaccaggtgggctacaaccggtcgacggctttcgtgtcactgcgagcaggccgtcgcctgacccacaccttcggatacatcggcaagcaagtgtggtacgacagggaggttacggactttgatgaacctgagctgatgcacagc

SEQ ID NO: 40991 - DNA, 265 bp, Zea mays
  Clone ID: LIB3062-033-Q1-K1-H10
gagaaagtacaaggaggtggagcttgttcgaagttcaaaccttaagaaagggtcttgcagagtaggttaccttgtcttgatgttcagttgctatcgtttgacatgtcagttattattatcattgctgttgctgtatgttcctgttctgtttgtgtcacgtgtaggtatggtgttggcaattggagggatattctagataacaatgctgaggctttggccggcaggacaccggtggacttgaacgacaagtgtaggaacatgcttt

SEQ ID NO: 40992 - DNA, 362 bp, Zea mays
  Clone ID: LIB3062-033-Q1-K1-H11
aggagtcgtggctgatgttggtccaggaatcaatgggttccaagccggagatcaagttgttgcgtatgctcaactcatttaacggaggtgggcttgcggagtatgctgtggcatcagaaaatctgaccgtcaagaggcctcctgaggtatctgctgccgaaggcgcagggctgcccatcgccgccggcactgccctccaggcgctcaggaccatcggcgccaagttcgacggtactggcaaggccatgaacgttctggtcaccgcggcatcaggtggcgtcggcctctacgccgtgcagctcgcgaaacgggctggtctccacgtcactgccacctgcggcgcgcgtaacgtagagctggtg

SEQ ID NO: 40993 - DNA, 287 bp, Zea mays
  Clone ID: LIB3062-033-Q1-K1-H12
gagaaagacaaggaggtggagcttgttcgaagaagaaaccttaagaaagggtgttgaagagtatgttaccttgtcttgatgttcagttgttatcgtttgacatgtcagttattattattattgctgttgctgtatgttcctgttctgtttgtttcacgtgtaggtatggtgttggcaattggagggatattctagataacaatgctgaggctttggccggatgacaccggtggacttgaaggacaagttgaggaacatgcttttcctttgaggtaacctgtgaaaca

SEQ ID NO: 40994 - DNA, 369 bp, Zea mays
  unsure at all n locations
  Clone ID: LIB3062-033-Q1-K1-H2
agaccaattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcatggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctncaagtccacctncaagtgcgccaccgtcggcattccaggcatcgcctggtccttcggcggcatgatct

SEQ ID NO: 40995 - DNA, 451 bp, Zea mays
  Clone ID: LIB3062-033-Q1-K1-H3
cctgagtgctctcgttctctctactccgctctctctcacgcgaggcagtgcatccttaatgcagtgcatctttgagccgccgccgccgtgaggagctccgcccatccgtcgtcatccgtcaaatcagttgatacgaagacattagaggatataatcggcccttcaacttcaatgaagtctcatacacatccagtgaagcctcgctttcaagtcagcaatcggcctaaatgcaatttgctaaataaaagttctattgattctgagcaaactatccaatcttctatagcctccaagataacaactttggtatgtgtacttctgaacagagaaaaaaactttactactgaattgcagtagaaaaattctcttgtgtcatgtcttgttaatttatgtcctagtgtactgttttcttgatttttagaataacgccacaggctaccaaagttacaaa

SEQ ID NO: 40996 - DNA, 462 bp, Zea mays
  Clone ID: LIB3062-033-Q1-K1-H4
aaccaagcagaccccagcagaagaagcgaagtcgttttcggagcaggaggaagagcgagcagcaaggtgtcgtggcaggcgtacgtcgatgaccacctgctgtgcgacatcgaaggccagcacctcagcgccgccgccatcgtcggccacgactgcagcgtctggtcacagtccgagaacttgatcgagttaaagcctgaggaggttgctgacatgattaaggactttgacgaacctgttaactacaggccaacatggtccaaggggaagaggtatccagtacacagggatccttgtctggaccacaacaaccatgcgaaaggtgagagtttcgatctgggcaagtacatttgacagcactttgaaggcccatcgttggtcccataggatcctttaataaagcagttcgctgaagagctgcttgcatatactgatgcctttaacaaagtcttatactttttg

SEQ ID NO: 40997 - DNA, 452 bp, Zea mays
  Clone ID: LIB3062-033-Q1-K1-H5
cacacacacagacaagtggtttccaaagccaagtgtgtgtactagcaaccagctagctcgggcggcagcaggcagccatcatgtcagaggagaagcaccaccacttcttcaaccaccacaagaaggacgaggagcagcccgccggcgagtacgggtactccgagaccgaggtggtcaccgacaccggcgagggcgagtacgagaggtacaagaaggaggagaaggagcacaagcacaagcagcacctcagcgaggccggcgccatcgccgacggcgccttcgcactctacgagaagcacgaggcgaagaaggaccccgagcacgcgcacaggcacaagatcacggaggaggtcgctgccgcggcggccgtctgcgccggcggctacgtattccacgagcaccacgagaagaagaaggaccacaaggacgccgatgaggccagcggcgagaag

SEQ ID NO: 40998 - DNA, 421 bp, Zea mays
  Clone ID: LIB3062-033-Q1-K1-H7
cgtgcttggagcaccatatagcctggctacaaggatcatctgataaattgcaggatacatggcaagagcaacatccaactgaactaggactagaaaatgagaacaatcacatgtctattttaagcattggtgttatcagcatgaaaagctgtgagcgagcattgttgcatgttgtatgcgagctatgctatcgcaaaaactgaagaatgtcattcgaaaatgtccatacaatggcagaccttgtttatgaagttgaactcattggatttgatgatggaaactacgttaaatacctaactgacattacacttgactagagtatcgcaactacagacaacaaaaatattgaggccaatgcatatctgaaagacaagaagcttgatgaggccatgcagcaatatgatatggctatcgcatacat

SEQ ID NO: 40999 - DNA, 164 bp, Zea mays
  unsure at all n locations
  Clone ID: LIB3062-033-Q1-K1-H8
ccgcgatcgaagctcctcacaaaccgttatcgtcgccatggcagccgccgngcctgaaagcgtcctaaaggaagtgctgccatctcccctgacctccgcctccgagccccttccctttttcgatggcaccaccaggctgtacgttgcctatcattgcccgtacg

SEQ ID NO: 41000 - DNA, 211 bp, Zea mays
  Clone ID: LIB3062-033-Q1-K1-H9
gccgatcctaaggacggaggaacccctcgatagcgcgatcacgcgcgtcatccgaaaggaatcggttaagatggccgagcctgacgtggcagcagacggcgacgttaggaagtcctgtggtggacgtggggctacttcatgagaggcgtgttcctgtaattctgtactcacttagttctctctgcatgcgtctataattgagttcaataga

SEQ ID NO: 41001 - DNA, 298 bp, Zea mays
  Clone ID: LIB3062-034-Q1-K1-A1
aaattatacgagccatccaaaggggatgactcactcatcagtgaagagagctcagggggtgagaataagatggggataggctcttgaaccgaaagggttcagtttcctgagttggtttttttttccccgcgtcttctcgagcatcagtgcttgggtggagactcagtcgtctttgcagggagttggttaatcagtagactgatgggtgcgaataaagtcaagtcaaacagcttaaccatatgattaacacctttgcttttctatttctaaatctgagatgattgcaaacagttttggt

SEQ ID NO: 41002 - DNA, 209 bp, Zea mays
  Clone ID: LIB3062-034-Q1-K1-A12
acccactcgtcctaacaaaacctgtctttaacgtaacggttcttactttcatacacgtgctgcattgctggcgttgtctcgtttagagggatgatcgctcaagtcctataactagcgaaaccctctttttgagtttctgacacatgctcctaatgctaaatatccaattaaccgagttacataccaaatctactacttaattgagttcc

SEQ ID NO: 41003 - DNA, 252 bp, Zea mays
  Clone ID: LIB3062-034-Q1-K1-A2
aactcaagagaacagtgtacagaattggatttaagacttgatatggaatcatctggatctgagttatccaaacatgccatattcaaaggtgcacagtggatttttctcctcgtataacaatacaattttgcatctatctatcacaagtgctgtgcacatagcaagaaagtcatatggagatatcaatgacatagtgacaggccactctatggtaggagctatggcttcttttttcacactcgatctttctat

SEQ ID NO: 41004 - DNA, 427 bp, Zea mays
  Clone ID: LIB3062-034-Q1-K1-A3
ataaagtttctgaattccttgagaagcatgattaggacctcatctgccgagcccatcaaggggtcgaagatggatatgagtttttcgctagccgccaactcgtaacaatgttttcagcccctaactactgtggagaatttgataacgctggtgccatgatgagtgtagatgagacattgatgtgctccttccaaatactgaatcctgcgaggaaggtgttgggtggttcaactaataacaaatctggcttcaagtcatcgagaggatggtgacaattgcaagcctgatatcaggttggttggtgagcagcatgccgtggtcgacggggggttgttccatcataatcatattacatcggctgcaactgacaggccccatgcaatttctcttcatgttggatcaacattcttggaatgtattaattact

SEQ ID NO: 41005 - DNA, 274 bp, Zea mays
  Clone ID: LIB3062-034-Q1-K1-A6
attcccggagttctagatcagctatgtcccgccctttttcttttcattcatttatatttatctttttaataattcacttacttttctgatttttgtttttactctaatttttttattttattacttttttcctacaccttatatatcatttcataacatcttttttacatcaactaacaatagatattcttttacactctcaccatatacatattatcccccacacttatgagtatatcaaaaagaacgctgcataaacatttatccaaaattt

SEQ ID NO: 41006 - DNA, 401 bp, Zea mays
  Clone ID: LIB3062-034-Q1-K1-B1
agcatagataccgcaaggatagcttttgctccgatgttgaacagctttggctcgggctagagtaccaagaagagtgccgcggcgatgatggattacacatctttggaggcagcgacagaaaacttcagtgagagcaatgtccttggattaggtgggtttgggtctgtgtacaaagccaattttgatgggaggtttgctgctgcggtgaatagactggatggtggggcacatgattgcaagaaggaattcgagaatgagctagacttgcttgggaagattcgacatgcgaacatcgtgtaccttgtaggcttctgcattcatgaggagaaccgtttcgatggttatgaactgatggagagtgagtcgttggattcgcaacttcatgggccattacatgggtc

SEQ ID NO: 41007 - DNA, 281 bp, Zea mays
  unsure at all n locations
  Clone ID: LIB3062-034-Q1-K1-B10
atcgccgggtcgacgtcacgcgttcgcggacgctttaatgttaacccatttgttgtcaggagtggtcatgatgagcgggggcgggtancagatacgcggatgttcgactatcacaggcagcatggcatcgaaatccgaattgccaggattctcaacacctatgggccaaggatgaacattgacgatggccgtcgcgttagcaacttcattgctcatgctgtgcgtgacgaaccccttactgtccagaagccagtaacacagactaggagcattctgctatg

SEQ ID NO: 41008 - DNA, 347 bp, Zea mays
  unsure at all n locations
  Clone ID: LIB3062-034-Q1-K1-B11
gcgtccagaacgctgcccaccaccaccaccaccaacagcttggtctagcgcccgacggggacggggacggcgactgttggatcgacgacaaccaagagaactacgacaatatgcacgcgcaccagggctgcgaggactgccgcggcctcctcgacggcatactgtccgacttcgacgactacgacgggagcccagcacggccgaggtccccgccggcgccgtaccgcgtcgtcttcggccacgacgacgacactctgctggagctggagtgggcggaagaggccgccatggacccgttcgccaccagcgagtccgcggngggctggtacatggacggcctggtcatg

SEQ ID NO: 41009 - DNA, 116 bp, Zea mays
  Clone ID: LIB3062-034-Q1-K1-B12
cacgctgatattcgactatcacacgcagcatggcattgaaatccgaattgccacgattttcaacacctatgggccaacgatgaacattgacaattgccgcgttgctagcaacttca

SEQ ID NO: 41010 - DNA, 358 bp, Zea mays
  Clone ID: LIB3062-033-Q1-K1-G8
ccgacgccgacgacgcgattcgtctccccagcagctttggcgctggtggtcgaccgtggagttgctgcgactccgctatcaaggacgcctccctgccggcgtggcgctgcaacgacgtggtggacaagtgctccgccgactgccaggactgcgaggcgtcgccggccggcgacggcttcgtctgcggtgactttatcttaagcctgaccgagcccccggtctgcacaccgaggccgtgggactgctgcgacagcgtggcctgcacaagggactacatccccaactgcatgtgcctggacaaggtggagtcgtgctcgagcaactgcgaacggtgcgagtttctgtatcattcggaccc

SEQ ID NO: 41011 - DNA, 232 bp, Zea mays
  Clone ID: LIB3062-033-Q1-K1-F10
gctttatgctgatgcacattgaaggactccgattggtggtatacgtatgggagcttgttgactgcgaacggaaagtggacacgatcaacttaagaaagcagccacgatgcaagcctatcactactatccttccacggcctgattgacgtcaagacacgtctatgatctcataatatctctcactgattcacaactccctcaacactctaactaccactcgagctaaaccttt

SEQ ID NO: 41012 - DNA, 386 bp, Zea mays
  unsure at all n locations
  Clone ID: LIB3062-033-Q1-K1-F11
gaggagcacaggaagttcctggacgggctaaggcagctgggcaagggcgacgggaggggcatctccaagggcttcgtcaccaccaggacggcgacgcatgtggccagccacgcccagaagtacttcctccggcagaccaaccccgggatgaagaagcgccgggcgagcctcttcgacgtcggtatcgcggactacaaggacaaccaggtgccaggccctcagagcatcgtcactgccaaaccggcgcctacgcangagataatccacaccgaccgcggcgacgtccccataccaagacgatatagaggccctcgagagattttagggcagtaacatgcaggttaatcaactgactgactactactatttcaacaaggactcccatg

SEQ ID NO: 41013 - DNA, 229 bp, Zea mays
  Clone ID: LIB3062-033-Q1-K1-F12
actcacacggtctacacatcaaccagcacacatttccctttggcggatcttaggagggaaggaggacatagacggcggggtggacgtgcacataaaccggcgtatcgaagtgtggaacgcctgccgagagaacctcgagttcaacttgcgctggacccgccgcacaatcgccctcgtaattctcttcagcctaggattgaggacaccattatacacatcaatggggagc

SEQ ID NO: 41014 - DNA, 366 bp, Zea mays
  Clone ID: LIB3062-033-Q1-K1-F4
gcgtacgcgcctgtctgtctttccccgggctctcgaaaccctaggtgcgtgccgaccggcggcagcggcaaggtgatgtccatggacccggacgcggtggccaaagcctgcgtggagcactactaccggacgttcgacaccaaccgcgcggctctggtagagctgtatcacgagacctacatgctcaccttcgagggccagaagttccagggcccattcgacattgccggcaagctcggatctgttcccttgcaggcctgctagcaccagatcgtcaccgtctactgacatccgacgtagcccgatggaggcatgctcgtattcttctgcggatgcatacgtaccggccacgaagtgcacgctatc

SEQ ID NO: 41015 - DNA, 427 bp, Zea mays
  Clone ID: LIB3062-033-Q1-K1-F5
cacaacacaataatacagcaaaggaggctagcagaagtgcaggattaataagctaagctaggagaaattaagcaaagcataggcacagccatggctacctcctctggttcttgccttattattagcctgttggtggtggtggtggcggcggcgctgtcggcctcaacggcgtcggcacagctgtcgtcgacgttctacgacacgtcgtgccccagcgcgatgtccaccatcagcagcggcgtgaactccgccgtggcgcagcaggctcgtgtgggggcgtcgctgctccggctccacttccacgactgcttcgtccaaggctgcgacgcgtccattctgctgaacgacacgtccggggagcagacccagccgccgaacctaactctgaacccgagggccttcgacgtcgtcaacagcatcaaggcgc

SEQ ID NO: 41016 - DNA, 446 bp, Zea mays
  Clone ID: LIB3062-033-Q1-K1-F6
ctcatctcggtttactataagagtataagttcgtctccgcaacaagctaatcttggttttgcccctccttccacgtggccaccctgccgtcgtcgctactcgcatagagattcgcgcggccgtgtcttgctcgcgcctgcccccttccttccttgtcgtgccagcgcccagatctctcgctcgccggcgctcgggccagatctgggtggaggctcggaggcggagcctggcgcaggtttggtttgacccaaggggcgaggaggagagggaagaagaccccggacgccatggagctggcggttggcggctggatgcggcggtcggcgtcgcacacctcgctgtcggagtcggatgactttgagctcacgcggctgctcaataagccgcggatcaacgtctagcgccagcgctccttcgacgaccactcgctcagcgacgtctcgcac

SEQ ID NO: 41017 - DNA, 429 bp, Zea mays
  unsure at all n locations
  Clone ID: LIB3062-033-Q1-K1-F7
cactcccatccagccgccaccaggtgcagagtctttcgtcatctcttctccggcgaagaacgcccagtcgcccaccagatcacttgttaaactttgttgaggggtgatggcggtttctttcgcaaacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacatgccccagcttctgangaagaggacgatgatgatgt

SEQ ID NO: 41018 - DNA, 287 bp, Zea mays
  Clone ID: LIB3062-033-Q1-K1-F9
cagagagaagcatgctggctgcctcaacagtatgtgggattgaccaatcagcggattgggcatctctcatggattgaagtgcttattaactaaagattttgaagaagaagctgctgtctgctggatgtaggcttccttgaaatctaacgtcttaatgaaccttcaagatcatcacaacgtgcacgagtggcacatgctaacacgtcgaaacccttgtcacgaaagaatcatgtctctttcttccttccatttcctggcatctgatgctctgatgtgttccctctgcc

SEQ ID NO: 41019 - DNA, 450 bp, Zea mays
  Clone ID: LIB3062-033-Q1-K1-G1
ccgttcgcctcttctcctccctcctgccgggtccttaataaagagcagcagcgcaagaggtgggtagagcgagcgagaagaaggcaatggcggcggagagcttcctgttcacctcggagtccgtgaacgaggggcacccagacaagctgtgcgaccaggtgtcggacgcggtgctggacgcctgcctggcgcatgaccccgacagcaaggtggcctgcgagacctgcaccaagacgaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagtcccccgacatcgcgcatggcgtgcacgggcacttcacgaagcggcccgaggagatcggcg

SEQ ID NO: 41020 - DNA, 269 bp, Zea mays
  Clone ID: LIB3062-033-Q1-K1-G10
gcgggtgatggcatgtcagagctccaagactcgcggacaccgccgagcctccggcggagggggcagccaccggagaggcatgctacagacgcggcttcttcaacaccggcacaaaaccctaacgctgctgcaaccgcagtggccgttgccaccgatctagagaagaagatgcgccgcgcggaacggtttgcgatgccagaactgatgtcagacgatgaacagcgcagcagtctgcgccaaagatttgggactggctcttcaagtgtaaa

SEQ ID NO: 41021 - DNA, 258 bp, Zea mays
  Clone ID: LIB3062-033-Q1-K1-G11
cggaattcccattgcaccatgcggtccaacggccaatgcctgaccagcaaccgcgactcgacttaagctaatgtggtggtagacaagtgccggttcttagctacggtccgagtgaacaggcacgtgcccatggaccgtaccaacacgctcaaatggtcaatcggcctggtgatggccgctacctcgtcgactctcttcgcggggctcacggtgcggcacgacgaccgccgcaccagccagtcgtggactacgaccaac

SEQ ID NO: 41022 - DNA, 145 bp, Zea mays
  Clone ID: LIB3062-033-Q1-K1-G12
ttcgagctcgcgtcacgcactagcagagagagacagagcccatatctccatacctagacagacggatagagattccgtgccgggtacagtgcagatactgaagacgcctaggttgaactatagacagtcacttgagacagccttc

SEQ ID NO: 41023 - DNA, 376 bp, Zea mays
  Clone ID: LIB3062-033-Q1-K1-G3
cgacccaggcgtcctaacaaagcaacatcagagctattgcttggttctgattaccctgttattaatcaaggactgtgtgctgcactacagtctctctggggcactggatcactgcgtctcgctgcagcattcatacaaagatactttcctgaagctaaagtgctgatatcgtctcctacctggggtaaccacaagaatatcttcaatgatgctagggtaccttggtcagagtaccggtattatgaccccaagactgttgggttggattttgagggaatgatagctgacattgaggctgctcctgaacgttcttttgttcttctacatggtttgttctcacaacccaactggaatagacccaactccttaacatttt

SEQ ID NO: 41024 - DNA, 376 bp, Zea mays
  Clone ID: LIB3062-033-Q1-K1-G4
acggagaaaggaattaatggaacgtgaagaggagctgccttcatcttcttcttccttgggttacgtgatgcagtgcagggtctgccatgaggaagaggatcaagggcgtgcgaccatggagtctccttgtggatgctccggctctctcaagtacgctcacaggggatgtgtgcagagatggtgtgacgagaaggggagcaccctctgtgagatctgccttcagaatttcaagccaggctacacaatgcctgccaagaaaaccccggtggttgaaacggctgtcactatcagtgatcgtgcagtgaacacgaggacatgcaacatttggaaccttcggagggctaggttgacggtgcatattacaccaggtgcttct

SEQ ID NO: 41025 - DNA, 253 bp, Zea mays
  Clone ID: LIB3062-033-Q1-K1-G5
catatacactaactcccattacgttttaaataacacatctgcccacaacggaagtgtccaatctaaaagattggactgcctacaaacagctttctcttcaactcatactccatgaaccaagtgtacccatacaatctattccaacaaatttcagactcttcactttactcctctctttcacaagaacccgacagcaaaattacctgtcaaaccttatacaaaacgaactacattattctttttcactaaatca

SEQ ID NO: 41026 - DNA, 363 bp, Zea mays
  Clone ID: LIB3062-033-Q1-K1-G6
gaaacagaacagagagcatatctctcgaagcaaagctctcacttcaccgtcgtcttccttccactacagactgacttacgacgctcaggcatcagggacatatatcaagctcctgcaacaattgaatcaccacacggatgcttcgcctctctcaaactcgctcacaggcgatctgtgcaaatacgccttcaccagaaggtgatcaccctcttgaacaactgtcttcacaatttcaagcccagctacacaatgccttccaagaaaacccacgtggttcaaaccgatgttactatcaaagatcgtgcatttaacactaagacatgcaacatttagaaccttcctaaggctttattgaccgttcaa

SEQ ID NO: 41027 - DNA, 448 bp, Zea mays
  Clone ID: LIB3062-033-Q1-K1-F1
cttaatgaactcggctggctctttcagagggcttctgcctgtacattgtccaccagacctgatgtgtctgatttggatttgactcagttttcaatcacacggttcaaatatcttttactgttctctagcgagcgtgactggtgctctcttactaaaacacttctggatattcttgccaagagaagcttggtcagcgaggaattatcaaaggaaactatggagatgctggctgagattcaccttctgaacagagcagtaaaaagaaagagtaggagaatggtgcatttgcttgtacagtttgttgtactatgccttgataattccaaggtttaccccttcctcccaaactttcctggccctggtggtttaactccgttgcatcttgctgcatccattgagaatgcagaggatatagttgacgccttgacagatgatcctcaacaggttg

SEQ ID NO: 41028 - DNA, 455 bp, Zea mays
  Clone ID: LIB3062-033-Q1-K1-D4
cgcagatcagagagaccgaggcgcccgcggttctgctttccttccttgccccgttcacgagagaattttctggagtgttcgagtcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccggcttccagatcctcgatctctactggaagaaggagcacagactgatgtgcacctgggagatttgcaccgacgaagagcgcattcgcttcgagaaatctatgtttaaagctcagagaaatgtcattctttgtgtttcagcatgtctcctttattggtgcatttatcgtattgtaaaattgaacaaggatattaaggctttg

SEQ ID NO: 41029 - DNA, 436 bp, Zea mays
  Clone ID: LIB3062-033-Q1-K1-D5
cgaaaaacatctccgttccccaccaccaccttcgctccttctgcttcgcccgtcccgctccgtcgcgtcgactcccaagatggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagctt

SEQ ID NO: 41030 - DNA, 446 bp, Zea mays
  Clone ID: LIB3062-033-Q1-K1-D6
atcgaagcctggacgacgcgaccgcgcggcggcggctcgacgcaaccagcacggcggcggggcacagccccgacgacgactctccctgctgccttctctcctgtgaggatctgctctcttccttccctctcctatcctctgctctcgctgcccccaaactctcgccctcgatctcgctcctctacgctctcgcacagtgacgctttgttcaaggtgtggccgccgccagtcgcctgcgtcgttgaagcagttgctgtcgaggttgaggtcctcctgggggagacgcgcggcgcggccgaggcgcagcgcggtcaggttcgggtatgacctgcatagctactcccagaacttcgacgatggcgttgcctagtcagcccggcggccacggctagcttcttcagtacgtgtagctagttaggagtctaggatattcgtgtaactagcta

SEQ ID NO: 41031 - DNA, 437 bp, Zea mays
  Clone ID: LIB3062-033-Q1-K1-D7
gtggtttccaaagccaagtgtgtgtactagcaaccagctagctcgggcggcagcaggcagggatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcagccgtcggcgccggcggctacgtattccacgagcaccacgagaagaagaaggaccacaaggacgccgaggaggccagcggcgagaag

SEQ ID NO: 41032 - DNA, 360 bp, Zea mays
  Clone ID: LIB3062-033-Q1-K1-E1
gaacttcaattccggcctcgacctacgcgtacggtagttaccaaagcactactgtacattctaataaccagctagcactatcagcaacaggctgtcatcatatcctaggacgtgcacctccacttatacaaccaccacaagaatgactaggaaccacatgcactccaatactcttactacgatacctaattatctacctccacagaccaatcctagtcctactgttacaaacacgaatacatggagcactatcacaagcaacacactcggctatgccgactccatctgcaaccgcacctttcaactctactagaaacacaatgcgacatataactccaaacacactcacactcacaagat

SEQ ID NO: 41033 - DNA, 344 bp, Zea mays
  unsure at all n locations
  Clone ID: LIB3062-033-Q1-K1-E10
aatcgaaatcgatccgatctccgcttgcgctgaagcctgatctccaccgggttcgcagcangggcgcaggacctcgatcacgaggaggcaggggagcagcatccacaaccacaagccatggcggcgagggccaacatccccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacaaatcgaggatgcgttcaaagaatttactacgagggaggatattgctattgtgctcatcaatcagta

SEQ ID NO: 41034 - DNA, 263 bp, Zea mays
  unsure at all n locations
  Clone ID: LIB3062-033-Q1-K1-E11
cgcaaacacttgtcgccgccactgtcctcacatggtaagggccgtccattgtgtctccgggttcggtgcgtnngtgctgcgaagcgcattcgtggtgtgactgcgctgccatccatcatgccctgggctcgtctctttcctcgatcattanngccaaggagctnnngctcaatgggcatgaagggtgagtcgtcgtcccgcttgcgaaggagaatctgcanntgtcgggccggccctcgtcccgtcagaaaggattgaagtac

SEQ ID NO: 41035 - DNA, 253 bp, Zea mays
  Clone ID: LIB3062-033-Q1-K1-E12
cagccacacacctgtttaattctgtactgcatgcgtgtgtaatttgatggttcacaggaatgagtccctctccggaccttggtagctgcttgcttgtggtgagtgagagtgtgagactgagggagaagaggtggtgggcgtggtgctacgtcgagagaggcgtgttcctgtaatactgtactcgcttcgttttctctgcatgcgtctataattgtgttcaataataagtgagagcggcgtgatatgtggctca

SEQ ID NO: 41036 - DNA, 458 bp, Zea mays
  Clone ID: LIB3062-033-Q1-K1-E2
acgcccgcgtctccgcctcatggcggcatcagcgtctcggcccctcgcgctcctcgcgtgcacgggggcatctcacggcgctgggcggcgggcgtgggctcgcttggctgtctcttcctattcggcgaggtcggcgctccccaggctccgcgggcgtcggtcgttcgccgcctccgcagggggcgccgtgatggggaacccaggccccggcgccgttgacgccgacgtcgggatggacgccgtccagcggcggctcatgtttgaggacgagtgcattttagtggatgaacaagacaatgtcatcggccacgagtccaagtataactgccatctcatggagaagatagaagctggaaatgtcctgcacagagctttcagtgttttccttttcaactccaaatatgaattgctactacagcaaaggtctgcaacaaaagtgacatttccacttgtctgga

SEQ ID NO: 41037 - DNA, 326 bp, Zea mays
  Clone ID: LIB3062-033-Q1-K1-E3
aattccaattccgcgcctggcctactcactctcctggtactcatgacgcctgcatttccacttctgagctcacattattagtcagaggcttgggatccgtactcgggcaacacaatctcgaaaaactattcgatgcacataattcaggaccacattgacttcgctacccttcttaaatacatcaactagctcaatcatcacatcaatcttgaccgtgctatgcacgatgcccagaccattcgcactattgctcatgaaaacaacactttcttcattccaactggcaccctaactttaatgcccctcactaccgatggttacattta

SEQ ID NO: 41038 - DNA, 451 bp, Zea mays
  Clone ID: LIB3062-033-Q1-K1-E4
acgcaggtgttagcagtcgaccggttcctcggagcacgatgaagtttgttgctgcctacctgcttgctggcctcgctgggaacgccagcccctgcgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagttgaaccagaggaaaaccagagtcatgtttagattttaagc

SEQ ID NO: 41039 - DNA, 425 bp, Zea mays
  Clone ID: LIB3062-033-Q1-K1-E5
gtttcgaccagatcatgcttttatgggaagttctgtggtcccattatttgtcagaagattgccacttgtacttgtgcgtagcaatcttgaaaaagtatcgtcagcggataattggggagcagatggacttcgataccctccttaagttcatcaatgagctcagtggtcagatcaatcttgaccgggctatccaggacgcggaggcattgtgtactattgcaggagaaaatggggcttcctgcattccacctggaaccccaccttcaatgcccgtcgagaccgatggtggcatgtacgtgcaagaagacgaggtcttgtgagatatcggtcaccctagaaaataattgcatagaagcatcgcaagtttttatccagtagtgctttcgtcgacgtcataaatgtgatccgttgtaagtttggaagaa

SEQ ID NO: 41040 - DNA, 419 bp, Zea mays
  Clone ID: LIB3062-033-Q1-K1-E6
aatattataaaagtaaatatttagaactccagctccaaactaacagagacaggtttgttcgcatcgacgaacttaaacaaaaatgcatgttgcacgactacaggtagcgataaatgccatagcacaaatactgatcgccgcataagacagactacagggccaggataaggctgattaaccaagacaaaaacaagtacaatacacccaaatacagatttgatgtgcgatttaccaacatggacatcacagcacaaatcatctctgctagtatagcaggtgatatggttcttgcttctgcttactcgcatgagttgccacgatatggtcttgaagttggtctgaccaactatgcagctgactactgcactggccttctagtggctcgccgtgtgctcaagacccgtggtttaaataaggaa

SEQ ID NO: 41041 - DNA, 452 bp, Zea mays
  Clone ID: LIB3062-033-Q1-K1-E7
cttcgtactcgcctatctccgcgacccaaagcgttcccccttctcccattcttctctcatttctcaccaccggcgcggctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgattttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtg

SEQ ID NO: 41042 - DNA, 450 bp, Zea mays
  Clone ID: LIB3062-033-Q1-K1-E8
ccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttggttttgcca

SEQ ID NO: 41043 - DNA, 222 bp, Zea mays
  unsure at all n locations
  Clone ID: LIB3062-033-Q1-K1-E9
atttctctaaggaaggcgttccacgaaatagatcagagcctgaaagacaaggactacggagttgatatgttgtcaaagaaagtagatactttgacaaaagctattgagtcagatgccaaaaaatcgaggcgcgagctagctgctatggagaaagagctggcaactgttcgcttggagaaagagcangataacagggcaagactttttggtagttcaagcggt

SEQ ID NO: 41044 - DNA, 413 bp, Zea mays
  unsure at all n locations
  Clone ID: LIB3062-033-Q1-K1-D3
acgcccttagaagcgaccttggcccgtgaggaagccaatcagccagagacagaacaatccatcggccatgaacagcctgttctcgagctcatggaagcgcgacggcggggacatcgagtccggcggcgtggagatgtctgcgccggcgggcgccgcggcgggcgcgagcctggacaggttcttcgaggacgtggagtccatcaaggacgagctccgcgacctggagcgcatccagcggtcgctccacgacgccaacgaggggggaaagtcgatgcacgacgcggcggccgtgcgcggcctacgcgcgcggatggacgcggacgtggccgcggcgatcaagaaggccaaggtggtgaagcttcgcctcgagtcgctggaccgcgccaacgccgncaaccggtccgtgcccgggt

SEQ ID NO: 41045 - DNA, 434 bp, Zea mays
  Clone ID: LIB3062-035-Q1-K1-C6
cgggagacggggaggtctcgcggcttcggcttcgttaccttctcctccgagaactccatgcgcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgt

SEQ ID NO: 41046 - DNA, 454 bp, Zea mays
  Clone ID: LIB3062-035-Q1-K1-C8
agcgatacagatactagtgatgattctggttcggaagaacagacacctaccccaaagaagagggaggtagtagttggcaagaagagggcaattgaagctgagacaccttctggtaagaaggctaagtctgaacaatctgctcagaaaacaggcgacaaggtctcaacttctcatcctgcaaagcagtccagcaagactcctgcagacaaatctacaaagacccccacagctgacaagaagtcccccaaatctgggagccatgcctgcaagtcatgcagcaaatctttcggcagtgcgtcagcacttgagtctcatcagaaggcaaagaagcatgaagcctagagcacgtgctataccatctactcgttatcaaaatcagtggtcttatttttgaacttgaaaatgtccaagtttggaacttgcccagtagtcatctgattagtggtgttatttt

SEQ ID NO: 41047 - DNA, 451 bp, Zea mays
  Clone ID: LIB3062-035-Q1-K1-C9
cggacgcgtgggccaagctattgaattatctgctgagattctagcaaatgtgaaattcattcgagaggggaagttaattggcaagtattttgaagagatcagtcaggatactgggaaatatgtctttggtgttgatgacactctgaaggctcttgaaatgggtgctgtcgagaccctgattgtgtgggaaaatctggatatcaacagatatgtgatcaagaacagtactactggggaaattattataaaacatctgaacaaagagcaggaagctgaccagagcaatttccgtgacccatctaccaatactgatctcgaagttcaggaaaaaatgtctctcctggaatggtttgccaatgaatacaagaagtttggttgctcgttggagtttgtgaccaacaagtctcaggagggatcccagttctgtagaggatttggtggcattggtggc

SEQ ID NO: 41048 - DNA, 402 bp, Zea mays
  Clone ID: LIB3062-035-Q1-K1-D1
agtaaatccattcacaccaagttcaacgctattgttgactctggcacctctttcacagctcggtcggatccgatgtacagtgcagatcactagcagcttcaactcacaagtccaggataagccaagccagcttgactcttctctgccctttgaattttgctactctataagtccaaaggcttctaccaatcctccgaacataagcttcacggcggaaggtggaagcgtgtttcctgtcaatgatccaataattaccattacggactctgtatctaatccgatggcatattgcttggctgttatgaagagcgaaggtgttaacttaataggggagaattttatgtctgggctgaaggtcctgtttgatccaaagaagaaggtcttgggctggaaaaactttga

SEQ ID NO: 41049 - DNA, 164 bp, Zea mays
  Clone ID: LIB3062-035-Q1-K1-D10
cacgtcttacctgtcctatagtgccacctaaattaacttcactagccgatgattcacaacttcatgactttcaaaaccttatccctacccaaattaatcatattgcatatacataccactttagccagctcttgtcataacctataagcctaaacagatctccc

SEQ ID NO: 41050 - DNA, 448 bp, Zea mays
  Clone ID: LIB3062-035-Q1-K1-D11
gcgaccacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatgcggctgcttcgttcgtgttgccccgtctgattatgtactgtaacccttg

SEQ ID NO: 41051 - DNA, 446 bp, Zea mays
  Clone ID: LIB3062-035-Q1-K1-D12
gcgaacaaaaagaaaccaaactcggctcaagagagatcgcatcttgcctgcccacccagcttccctggcgtgcctcctcgcccgagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccgcaaggccaaaccctactacctttttgatggctacgct

SEQ ID NO: 41052 - DNA, 445 bp, Zea mays
  Clone ID: LIB3062-035-Q1-K1-D2
gtcccacccggtgaagctggtgccgttcaacccggagtaccaggacgagtcggtgctgtgggcggagagcggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctgccctggggcgacgaggcctacgccgcgggaggcagcagcgccgtcaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtc

SEQ ID NO: 41053 - DNA, 468 bp, Zea mays
  Clone ID: LIB3062-035-Q1-K1-D4
ctaggtctagatcgcgagcgccgcccttttttttttttttttatcagcaattcagcatcttgttactcatacggaaggaggagtagacgctacaagctagaacttgtgaacacacgctattgacctctaaaccaccttaacaaaatctcaaaattcacgcctgggctttgattctgcaaccgtgactcggatctgtctaccatccaagtcgatgccatcaaggtttgatatggcattgttgacctcctcggcagagccataagtgacgaaaccaaacccccttgacctgccgctatccctgtcgtagatgaccttagcatccagcacctgtccttgctcactgaataggttctccagagtcgagttgtcaacgccccatgcaaggttccccacgtataccttgttccctgaatcgacaaagctgctgctgccgacaccaccaccaccaccccttggtgctcttggtgc

SEQ ID NO: 41054 - DNA, 388 bp, Zea mays
  Clone ID: LIB3062-035-Q1-K1-D5
ggaggacatgttataatgcttggcgcaaatccttcaagccaggctgctgcactggaggcactacgtgcaggtcgtggtggtttgcaagttggaggtgggataaatttggagaatgcaatgtcttaccttaatgaaggggccagtcatgtgatagtgacctcttatgtgtttagtgatggcaagatgaacactgaaaggttaagaaaacttgtcgagctggttgggaaacagaggctcgtgctggacctcagttgtcgaaaaaaggatggccgatataccattgtaactgacaggtggcaaaagttcagtgatgtgtctgtggatgaaccaacattagaatatctcgctgcctttgcatatgagtttttggttcatggtgttgatgttg

SEQ ID NO: 41055 - DNA, 445 bp, Zea mays
  Clone ID: LIB3062-035-Q1-K1-D6
cgtgtgtcatcaaaggccataaggaggcagttagggcataaccttctttctgcattgaggtagacatacaagattgatgagagggattcacatcttaggccaacgaaaggatatgcgtttcagtcaacttctcaagttggtggtctatggaatagcaaaggattgagatatttccggcaggagttcgatgtacgtggtgctgtgcctttgggattttatagtgctgctctcaacgttggtgtaggagcgggtgtcattttaccgcttgcagggggattcatgaattcgacttcatcagtgccagagaggttttatcttggaggtaattcttctccagtgtgcagcttgggcggaccgtcatctctgctgggtttcagattaaggggagttggcccaacagaggcgcggaagcatgtccttaataactcggagagtggttcggctg

SEQ ID NO: 41056 - DNA, 447 bp, Zea mays
  Clone ID: LIB3062-035-Q1-K1-D7
agctacgcaagcacagaagctaggcgtttatctgaagcagcatttggtgaggctatgcgtcgcactattgggtatagttgggtgcggcaagcagcaagagaacttgggaaaagtagaatttatatgggtgtaccgtttatagctgagtgggttagagacaaaggacaccacattaaatcgcaggttaatgctgcttcaggtgctatttctctaatacaacttcaagaagggatgaaaaagatggaaggaagcgagaacagtgaagagcaacttatgaagagttttgaggagaaaaaagatgccatgcttagctcgctatggaaaattaatgtggtcgatattgagtcaacactttcacgtgtctgccaagcagttctgagagataacacggtctccaaagatgtcctgaagctgcgagcgaaagcgttgaaaaagctcggaacgata

SEQ ID NO: 41057 - DNA, 389 bp, Zea mays
  Clone ID: LIB3062-035-Q1-K1-D8
agcgaaccaggctctggtcaccatggcaggtcaattgctcagtccgctgcagcctggaacgggggattaccgcctgctagctcgcggtcactagtactttacagattctcctgcacgaacgatacccgtgcacagccatctcacaaacacgtgctacttaatcttgcgaggatcatatagcaccgacattgacgatacatcatgcaacgattctacagagacaggaagcgttgacaagaattcagccaaagatgtcaggcacatcttgaatacatgcgacaggtctttccaacgaacataatgacttgacactcatgatattgactacactcttgagaaatagggtatgctctctctcaaatagttggcatgaacctcagcggtatcat

SEQ ID NO: 41058 - DNA, 378 bp, Zea mays
  Clone ID: LIB3062-035-Q1-K1-D9
gtgttgaccgtgggggcggcggctaccgaggtggccggcgccgtgatggcggcggcggctacagcggtggcggcagctactgtggtggcagcggcagctacagtggtggtggcatcggctacggcggtggcaaccgtggcggccgctactgcaactccgacgggaactggaggaactgaccggtggggcccgcgcggccaagttatcctgatcgctaccgagttgtttaccctagtccagagtgtttatcttcgttcgtctcgtgttcgttgttgcccatctgtgtttttgattgaaggtcgctctgtgtcagatgctagtgctgtgttcatactcagctccagcagacccatgcatcaaccagcatggactgcggat

SEQ ID NO: 41059 - DNA, 468 bp, Zea mays
  unsure at all n locations
  Clone ID: LIB3062-035-Q1-K1-C5
gttgtgttacattctccttgactatgggccctgagtatcacatctctcagatcacagatgctgtggttattgcgggggatctaggtgcaacacttgtactcccagacatcagaggaaatgaattaggaaataagcgaaaattccaagacatttacaatgtggataagttcgtgaggagcctggatggtgttgtcgaagtaatagaggatatacctgatgaagtgagtgctaagaagccagcagtcatcagagtaccgaaccgtgtgactgaaagcttcatcacaggcaccatccagcccatcttccaaaaaaacaagtacttaagactagcggtcattttctcttccgtaagtttaaggccaaaggagacgaacaacatggacatggacgcaactgcttgccttgcgatgttcggtggcctcgagctgaagcacgaatattctgaggtggccagaanaatgctggata

SEQ ID NO: 41060 - DNA, 467 bp, Zea mays
  Clone ID: LIB3062-035-Q1-K1-B10
cctgaattcccggggtccggttgcctcgcctcgcgttagtagcctgcttccgacccgcacatctccctccggttctcgccatgggcgccgggggcaacggccacgaggaggggagccccctcatcccagctgcggtcgccgcccccgcgtacgagaagcccccgcaggctccggcgccggaggccgccaattactatgccgacggggtcccggtcgtgatgggcgagcccgtgtcggcccacgccttctgcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctcttt

SEQ ID NO: 41061 - DNA, 262 bp, Zea mays
  Clone ID: LIB3062-035-Q1-K1-B11
gcaccttcgcctggcacatcctcggcggcgcggtttcctgcttcttcaccggcgtggctgcttgggcacggggtgcatgaccggcttgttcaccgacgtgaccgcctacttcttcgacaacgcggatgcctgcggcggacaaaacgtggcggactaccgggcggtcggatccgcgaacgaacaaatctacggcgccctgtaaatcttcggacgccgcacggcagactaccgggcggacggatccacggacgaacggatctcc

SEQ ID NO: 41062 - DNA, 394 bp, Zea mays
  Clone ID: LIB3062-035-Q1-K1-B12
attcccgggctctggctgtgcctctggtctctggacaaccaagccagagaggagcagttagcgacaacctcctctcctctcctcccctgttatgccgcgcccagcagcgaggcatggtggagaaggcgaggaccatggcgcgcaggctggagatcccccagtggaaggccgactgcctgccgtcgccgacgagcccgctggaccgcgcgtcggcgtcaccccatgggtggcgccacctcgacgccgtatgacgaggcctggggctcgggatcctggcagcgctcgaggccgagggcccgccgcagcccgcgcccagggtgtccatcccgcggcgcgcagcgcggctggaggtgtcagagctcgagtgcatcgggcgctgcgccaccagcctgtg

SEQ ID NO: 41063 - DNA, 483 bp, Zea mays
  Clone ID: LIB3062-035-Q1-K1-B2
cctgaattcccggggctctagatcgcgaccggccggccttttttttttttttttttttgtttttttttttttttaaactcggtgaacagtaggatggtcgtaattgagttcatgtacagtatcatcgtcaataattacccaagttaataggaaacatacattttggaacactgaactctgttgtgtgtggagaaaatggcacgattatggttatctttagtatggctctacatgtaatccaacacatgctctgcaagaaagcttagctcagattgcctcatttgagactctacagttgagctgaataggttcattgaggagataaaagatgcacatttttatccgaaaaccttttgcaaatcttctcgcatattagactctgaatatgcgccacatttttcttttgcgtttccagagtaaagaagcagaaactcggaacattttaaccttacatggtcatccctatttgcatcttttacaatg

SEQ ID NO: 41064 - DNA, 462 bp, Zea mays
  Clone ID: LIB3062-035-Q1-K1-B3
ggagtccgcacggggggcagcattcaggggccagaagcgctggcgttctaggtacctagccggcagtctatcgaggcagcgagaacgaacaactgggacggcgtctggggaaactgagatcatgcctatgggtgcaacgagttgaatcatatagaacaagtgcaagggctatgacctatgggagtttgcttgccttttgattcatcaaaaagaagattgcggccagataccgcctttggtggcaacttatgggaagctgtgaagaagaaactgctgggcctatcttgcttttcgcagctttgctttgatgtacctgctagggccatggcccatgacagtggtaggtgtttctttaatcgcaactgtaaggatttggtgaaaaaacggttcacagtgcactgatatatatgtagctgcttgctgctgctgtgatatcaatgggggtatcgaatgtttgtatat

SEQ ID NO: 41065 - DNA, 326 bp, Zea mays
  Clone ID: LIB3062-035-Q1-K1-B4
cacatgcatgaggcagttcacatgaacgtatgtctgtctgcgctagatcgaaaaaaaagtggtgaggttttgtcatgagagtatgattctactagctagcatccttagcacacttgagatgttgttgactcgtgtcctagtgtagtgtactctgtgtatatccatgtatgcacagtgatatatgtcggcactggaacatgttaacaccaaatgtttcaagcttcgtacttttgcctgatgtggacatgcatgcagcaggcatcccagtactacacctgctgttgaacttgaacactactgtattcagcctatgaatgattcatgct

SEQ ID NO: 41066 - DNA, 401 bp, Zea mays
  Clone ID: LIB3062-035-Q1-K1-B5
gcgcttccggccttcacgaacaggttcgtctcctcggctcctccttggcttcgcaagagtggggccgagtagctcctccgcgctccgccgggaccgacttgccgctggccgccaggggctccctcgcccaggaccggctccgccgtccaaccgtcctatcccctccggcctccgcccagatatgggttcttgggagggccaagctaggcagcttttgttggatgaggaagaagatgatgaagagtttttctttcttcttctccctgctatactttcattcctctctgaagagcaaagcgaaactggagcagctattgaaagtttcgtggaattcaagaggagcactgcagccaaaacgctggaagctcttgaagaaaagaagaagcatgatgaagaattct

SEQ ID NO: 41067 - DNA, 444 bp, Zea mays
  Clone ID: LIB3062-035-Q1-K1-B6
gaagccctctagtggtactgagtctgaagctgctccctcaaccaatgatgaaactcctgcagcggtagaagacaagaatggaacttctgaagtacaagatgctgctgaaaatccagaggcagaagaaactaacactgctgcagaggaaacacctgctgtagaggaagcaagtgagactaccgaggaggaagaggctgagaaacctgagatcaagatcgaaacagctccagcagattttcgtttcccaacaacaaaccaaacaaggcattgtttcacacgctatgttgaatatcacaggtgtgtggctgcaaaaggtgaggatgcacctgagtgtgataagttcgccaagtactatcgatccctgtgcccaggtgaatgggttgatcgctggaacgagcaacgcgaaaacggcaccttccctggacctctgtaatcctacaatgc

SEQ ID NO: 41068 - DNA, 409 bp, Zea mays
  Clone ID: LIB3062-035-Q1-K1-B7
cctcctcaccactggtgccagggagagcgctttcaggaacatcaaaaccattgctgagtgcgttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgagatattctgcttgtgaatttgtgagtgctgttggcgtcgccgctggcttgccgatgtagtatttcttgtcactc

SEQ ID NO: 41069 - DNA, 450 bp, Zea mays
  Clone ID: LIB3062-035-Q1-K1-B8
gagcaagaagctcacgtggaacacccgcgtaaggatagcgctaggcactgctcgcgccttagagtacctgcatgaggtgtgcctacccccagtggtgcatagtaggaccttcaaggcatctaacatcctgcttgatgaagagtacagcccgcatctatctgactgtgggcttgctgctgctctcactactgctgtggtctccgctgaagcggttggctcctttggatatagtgctcctgaggtcgccatgtcaggaacatacactgcaaagagcgacgtgtacagcttcggagtagtgatgctggagctgctgacaggccgcaagccactagacagtgtgtgtgtgtgtgtgtgttttataccagctccagagagaggtcagaacagtctctcgtcagatgggcagccccgcagctccacgacatcgatctcctcgccaggatggtcgat

SEQ ID NO: 41070 - DNA, 441 bp, Zea mays
  Clone ID: LIB3062-035-Q1-K1-C1
ctacaaaggcctccacattgaccttgtattgcctggaaaggatgctgttttaggagtcgacagtgttggtacggtatgaggggctcttttgactagttggtccattcaaacactgaagccagaccttatcattaatgctggcactgctggtggcttcaaggccaaaggggcaagcattggagatgtattcctggcatcagatgtttcattccatgacaggaggataccaatacctgtttttgacatgtatggaattggagcacggaaaacttctgcagttcctaatatcttgaaggaactcaatttgaagattggcaaattgtcgactggggattctctggatatgtctccccaggatgagaaggtgatactgagcaatgatgctacagtaaaagataatggaggagctgctgtggcatatgtcgccgacatgttttcaac

SEQ ID NO: 41071 - DNA, 402 bp, Zea mays
  Clone ID: LIB3062-035-Q1-K1-C10
cctaatttccggtcgagccacgcgtgcgtgcaagtgacggccccgacccatcatgcgccattcgaatcaaaccactacctgatttgtttaggccccggaaatttgccgggtcgctcgtgtcgctcctctccctgcgcagcccccagatccggcaccgaccgctcctcgatccccgcaccccacgcccacacgcctggaccagcagtgtcgcgcgcctggtatgaggaagagaacacgaacggcggcatggcggctccgcccgcgaaggcccgggccgactaccactaccttatcaagctgctcctcattggagacactcctgttggcaagagttgcctcctgttgcggttctctgatggctccttcactacaagctttattaccacaatatggattgacttt

SEQ ID NO: 41072 - DNA, 468 bp, Zea mays
  Clone ID: LIB3062-035-Q1-K1-C11
ctaatttcgggtcgggccacgcgtgcgggagagcagcccggaggagggggagcaagcagtagccgtcggtggaagatgtcgtacctgctggcgcgtctgcactcggggtgggcggtggaccaggccatcctcgccgaggaggagcgcctcgtcatcatccgcttcggccatgactgggacgagacctgcatgcagatggatgaagtgctagcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtgatt

SEQ ID NO: 41073 - DNA, 323 bp, Zea mays
  Clone ID: LIB3062-035-Q1-K1-C12
gcggcagcagcagcagaggggcctgcacgcggcgttcctgggcccgcgggcgcagccgatgaaggagtccgggtcgccgccggcgctggcgccggcgccggcgcagtcgaagctgtaccgcggcgtgcggcagcgccactggggcaagtgggtggcggagatccgtctcccgaagaaccgcacgcggctgtggctcggcaccttcgacaccgccgaggacgcggcgctcgcctacgacaaggcggccttccgcctccgcggcgacacggcgcgcctcaacttcccggccctccggcgcggcggcgcgcacctcgccggtccgc

SEQ ID NO: 41074 - DNA, 272 bp, Zea mays
  Clone ID: LIB3062-035-Q1-K1-C4
gcatggcatacttccagaccagccacggctaatatttgcagggaaaacatttgaggacgggggcagggtctacaactacgacgggcagaaggataacacgatcgacttacagcttggaactaggggcagcatgcagctatactttaaaacagctaccggaacacctatcaccgatgaagatgagcatatagaccacatctaccacacctatggcactattcatgacaaggagggcattcgcacaaaccagaaccatgtcatatatgctggaa

SEQ ID NO: 41075 - DNA, 410 bp, Zea mays
  unsure at all n locations
  Clone ID: LIB3062-035-Q1-K1-B1
caccatttcccaaaccctacccatacccccgccgccgccgccgccatgccgcccaagctcgagccgtcgcaggtggtggaggtcttcgtccgggtgacgggcggcgaggtcggcgcggcgtcgtccctggcgcccaagatcggcccgctcgggctctccccgaagaagatcggcgaggacatcgccaaggagacggccaaggactggaagggcctgcgcgtcaccgtcaagctcaccgtccagaaccgncaggccaaggtctccgtcgtcccctccgncgncgcgctcgtcatcaaggcgctcaaggagcccgagagggaccggaaagaaggtcaagaacatcaagcacagcggcaacatcggcctcgacgacgtcgtcgagatcgccaggaccatgaggaacaggtcca

SEQ ID NO: 41076 - DNA, 378 bp, Zea mays
  Clone ID: LIB3062-034-Q1-K1-H2
cggagctgttccccaagatcttccccgagcagtacaagagcatcgagaccgtcgggggcagcggcaagtctgccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggaaggcgagggcggcgccgtcgtcagctgggccatggagttcgacaaggccaacgaccaggtgcctgacccggacgtcatcaaggagaccgtcaccaagacgttccacgacctcgacgactacctcc

SEQ ID NO: 41077 - DNA, 450 bp, Zea mays
  Clone ID: LIB3062-034-Q1-K1-H5
agaacattgacagttttgtcagtgagtggggaattgacaatttggagaagagggagctataccttgctatcaccacgatcctgaaagaccacaagggcatggctaaagagtactttaactttctcaataagtaccttgccacattcaaagggtcagatgatgaatcagctacaattggtgatgcgaaggaagaggctgttgcggcaatcatcgagtttgttaaatcgcctaatctctttcagtgtgatttgctcaacatgccagctgtttcacagcttgagaaggacgaaaagtatcagttggtgtatgaactactaaagatattccttactaagaagcttgattcctacttggagtttcaaagtgcaaactctgacttgctgaaagattattgtctcgtccatgacaaatgtgtaaccaaaatgcgcctcatgtctttgcttgatctga

SEQ ID NO: 41078 - DNA, 422 bp, Zea mays
  Clone ID: LIB3062-034-Q1-K1-H6
cgcttctcttcggttcagctctcgagtttccaggatgaaagtaatagctgcctacctgctggctgtgcttagtggaaacactatgccgactgctgatgatgttaagagcattctggaatcagatgatgctgaagctgatgaacaaaaactagagttcctgctcacagaactcaaagacaaggacataacagaagtgattgcagctggaagggaaaggttatactctgtgccttcagatggtggtgcaattgacatgggagctccagcagctgtagctggcggtggcgcagcacctgctgaagaggcaaagaaggaagaaaaggttgaagagaacgaagagtctgatgaagatatgggtttcagcttgttcgattaaaacaccactggcaatttacagattctctcgcgaatggtctcacaat

SEQ ID NO: 41079 - DNA, 430 bp, Zea mays
  Clone ID: LIB3062-034-Q1-K1-H7
caggggaactcaagagaacagtgtacagaattggataaaagacttgatatggaagcagctggatctgggttatccaaacatgccaaatgcaaaggtgcacagtggatttttctcctcgtataacaatacaattttgcgtctagctatcacaagtgctgtgcacaaggcaagaaagtcatatggagatatcaatgtcatagtgacaggccactcgatgggaggagctatggcttctttttgcgcgctcgatcttgctatgaagcttggaggtggcagtgtgcaactcatgacttttgggcagcctcgtgttggcaatgctgcattcgcctcatacttcgccaaatatgtacccaacacaattcgagtgacacacggtcatgatattgtgccacatttgccaccttatttcttctttctttcccagctgaca

SEQ ID NO: 41080 - DNA, 288 bp, Zea mays
  Clone ID: LIB3062-034-Q1-K1-H9
actattctcgtcaagctgggccacttaacgaagcattatagacagtacatccctttgctggtgctctaacataagttatattcattgatcccctcgactcatgctaagaaatgaaagcatcttaccctatcgagccctgatttccaaaaatctgcaacatgttcaaaggtggccatcaaactcctatactgagtcctggcgcactggaccatatacgccataaaataatatcctatccatgatatgtaattggtgtatacatgcgtgcaatgtaggatgctcttatag

SEQ ID NO: 41081 - DNA, 306 bp, Zea mays
  Clone ID: LIB3062-035-Q1-K1-A1
ctagttctagatcgcgagcggcagccactcatggccctttttggcacatgaaaaatgctgcgaagtggccgccttgctggtgttgttctgagtaagcggaattgcagacctgatcttgacaaaaaaaacctagcttggagattcaggtaagtaactgttggaactgtagggcacaactcattctggaaatagttagcaagtttggatggcattgtaattgttgtaatatatgagttgaaacattctttcaaaggctcgtgcttgtgatctctctcgcatctgtaatgttagtgctttgatcattta

SEQ ID NO: 41082 - DNA, 462 bp, Zea mays
  Clone ID: LIB3062-035-Q1-K1-A10
cttgaaagtctacctcaagacgctgctgacgaggaagaaccacttgacaggggtggagtacagggacgaccccaccatggtcgggtgggagctgatgaacgagccccgctgcaccacggacccctccggcgacacgctgcagcgctggatggaggagatgtcggcgtacgtcaagtccatcgacaagaagcatctgctcaccgtcggcaccgaggggttctacgggccgacgagcccccaggagaagctggacgtcaatccgggcacgtggaaggacaacaactacggttcggacttcatccgcaacgccaagatcccagacatcgacttcgcttccatccacctctaccctgacacctggctgctgcagcagcacgccacggtggacgagaagctcaagttcgtgaagcggtgggtggcgtcccacatcgaggacggtgacaaggagctgggcaagccggt

SEQ ID NO: 41083 - DNA, 449 bp, Zea mays
  Clone ID: LIB3062-035-Q1-K1-A11
gtgaagggcgacgtccagagagtaagaacgaggcgacacagtatggacttgatatgagtgagcaacaatatcttgagcattcgattccatggatagctgccaatgatgctgcttggcgtgcgttatgtcgttactgggcttcgactgaatttaaggcaaagtctgtgcgacacagttccaatcgtggaaccgagtcgtatcacaggtatggaggtgatgatcactttcgtttggcaaaacgaatggaagctagcactggtgcagtgcctagtgatgttcaaatataccttaaggggcacagaggatcagatcctgcaaatccagatgtgttgtgcagccaaaaggcaacagatcgtgtgctgggtgtttggaaatgtttggtaggttctgtttatatggatttttgtatgtaagattacattgttcttttgtatgaagctgcatatggc

SEQ ID NO: 41084 - DNA, 269 bp, Zea mays
  Clone ID: LIB3062-035-Q1-K1-A12
catcacattatacaaccttcctaacaacatccttaacaacttaccacttctcactctatctcttaaccacacatccgtctcctagttccaatccctacaccattacctattcttcaacatctacattcaacttctcctatttcctttcaactcctccctcaccatcaccctctactacctttcatttcaattccacactcactactaaatctacttccaattccttatcaacatatccctctatccctacactcttcacaccaacattt

SEQ ID NO: 41085 - DNA, 423 bp, Zea mays
  Clone ID: LIB3062-035-Q1-K1-A2
gatccatatgaagcctgagtgatcaggatcttgttatttcatttgtgttcgggagaggggttggtcgacagccatacggaaacgaaaggttgatgtacagggagcagagaggactaaagtcggtagaagtgagcttgatctaggacagtgctctccaattcgttccattgaacacaagtagcagtacaaatagaactcatcctaagatccttggaggcttcacttgtatatactcagctgggtggataggtggtgggtgtatggtgtgattttggcatccaattggaatggcaaaggtaatagtgttattgtactaggaattctttcccttttttttctttctcggggcctaaaattctcatgttgcaaattatttttgagttgccacagagatttgccaggagggctcgaagtcatgttggt

SEQ ID NO: 41086 - DNA, 247 bp, Zea mays
  unsure at all n locations
  Clone ID: LIB3062-035-Q1-K1-A3
ttcatttgtgttctctagagaaacganagctttataacatacgcggacgcacagattaatatacacagagcagacaggactaaagtcggtacaagtgaccttgatctaagacaatgctctccaattccttccatttaacacaagtatcaatacaaatagaactcatcctaagatccttgcatacttcactcgtatatactcatctgcatgcatacacaatagatatatcctaccattttatcatcca

SEQ ID NO: 41087 - DNA, 399 bp, Zea mays
  Clone ID: LIB3062-035-Q1-K1-A4
gtaggcatttcctgaggcgttgtttcatcaacttcttttagcaatgctctatccagattgtgggacgcatttaggagcacatcggattttctctgttgttcttgttccctcttccgttgctccgttttcatttgcagacacttcacagacaaggaagattgatctccgaaggacattatctagaacaacatcagtgttttcatcttctgctgctttgtttgggaaacttaaaagagatatgctttcatttcgtgaaagtgcactccaggataacacaaagctactgcccatcagtgagaatgcaaatgagatcagtgcaaatgatgcaaaattattcaagtcacagactattcaaaggatggttagtacaagagatatttctcttccctcttccacaga

SEQ ID NO: 41088 - DNA, 446 bp, Zea mays
  unsure at all n locations
  Clone ID: LIB3062-035-Q1-K1-A5
caaacgtgttcccaacagcgcattatggcttttaagattcccggcagctggtgaaacgggagtgagagcatatgctgctgccagaggagtaagatcagatcaaattgtattcacagacgttgccatgaaaaatgagcatatacgacgcagtgccctggcagaccttttcctggacactcccctctgcaatgcacacacaacaggcactgacatactgtgggctggtctgccaatgatcacccttccactagagaaaatggcaaccagagtagctggttccctctgcgtagctactgngcttggggaggagatgattgttagcagcatgaagaagtatgaagatagagcagtagaactagcgctgaantccgtgaagcttcaagcgctgactaacaagctcaaggaagttcgtatgacctgcccngtgtttgatacagctcgatggg

SEQ ID NO: 41089 - DNA, 459 bp, Zea mays
  Clone ID: LIB3062-035-Q1-K1-A6
cgaaatggatgataaggtggatagagccaatgcagatttgaagaataccaacgtgagactgaaggagactgttcttcagcttagatcaagtcgcagcttttgcatcgacatcatccttctgtgtgtcattcttggtattgcggcctacctttacaatgttctaaaaaagtgaggtggagtcttcttgccttggaaccgctcatgtcgtggtccctttgtcaccatggttctacccagttctttgagcgatttgtgtgcaccaagccatttgttttgtcttatatctgtattattatggtgtccaagttgaaccttgactaggcttgttgaagagaacgctggtaacatgtttgctatatatctggggagtcgatttcgtagcgaggaatgattacacggcaccattcttatcgtcttatcgaaccacgggctcatgtatattcattccgtcagggcttt

SEQ ID NO: 41090 - DNA, 453 bp, Zea mays
  Clone ID: LIB3062-035-Q1-K1-A7
gtgggttggcttctcctcccccaccggttcgtgttcaggttctggttcgtgggcgagggggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggt

SEQ ID NO: 41091 - DNA, 445 bp, Zea mays
  Clone ID: LIB3062-035-Q1-K1-A8
agcacgatggctcgtcgaatagacctggatccttcaatggacgccaactaggtagcagagcgggtgacaatactacaaggcggaattatcttggccacatattcgggactatctacttgactggcattcaacaaaagtgcagcatgccattcgaatgtcacaatggctctatggagtatatgaattagcacaaccataggccacgctctacataatcgaacatacaaggcacagataacacctcaggatatgagacaagcgacaaaattgactatctgaatgatagctaactgtacaatcactgtgattttataaccgaatgcaaagataccaaattcttagtaataaagtcctacactgaggaccatgtacatagggtcatcaactataaagtttgcgccagcacactcatgtcgaacatgaatctggattctgcttaccatgc

SEQ ID NO: 41092 - DNA, 211 bp, Zea mays
  Clone ID: LIB3062-034-Q1-K1-H12
gagaaagacaaggaggtggagcttgttcgaagaagaaaccttaagaaagggtgttgaagagtatgttaccttgtcttgatgttcagttgttatcgtttgacatgtcagttattattattattgctgttgctgtatgttcctgttctgtttgtttcacgtgtaggtatggtgttggcaattgtagggatattctagattacaatgctgatgc

SEQ ID NO: 41093 - DNA, 290 bp, Zea mays
  Clone ID: LIB3062-025-Q1-K1-G9
gcgctgatgctgtcactgctgcagccgctcggaacggtagcaccagcagcagcagccctcgccatgtggccgttttcgcacccgcgtcttccaccaccctcgagctgcccccctacagctcctcctgcttctttcaggtgcccaggttttctcctgggcatgaagccattgggctgtgatgtgaggtgcacagaacaaaaaatggggagggggccccctccattcctctaatctgggaggactaatggctatgattggccccatcaaccaggcgtagagaagctttgaca

SEQ ID NO: 41094 - DNA, 428 bp, Zea mays
  Clone ID: LIB3062-025-Q1-K1-H1
tcggtcggtggcacgagacaggagacgccaaggccatagctagagcctagagcagcagcagaggcgtgacgtgaagctcgaccggccatggcattcacgcccgctacggcctgctgcaaggcttccctggcgctggcaccgcgggcgtcgccccgcggcccggcggcctgcgcgcaggcggcgctcctctgcacgccctacacctccgtgttccgcggcctccgggcgcccgcatccgccgcgccggccccgcgccggcgccgctcggcggcgtccacgggcatagtctgcggcaaggtcgccaagggcagcgtgccgtcgaacttcaccctcaaggaccagaatggcaagcccgtgtcgctgaacaagttcaagggcaagcccgtcgtggtttacttctaccccgccgacgagacgcccggatgcac

SEQ ID NO: 41095 - DNA, 282 bp, Zea mays
  Clone ID: LIB3062-025-Q1-K1-H11
aaagcacacatttttaagattatacatcaaacatgctcatcaaatgccaaatttcccattcacaggggtgacaaccttacattcccaaaaccttaaaaatcaatagatgaatcaatcaatgttcatgttaaagtacaccatagttctaataccactcaattatgatcaactaatctcttatataatactaaattactttaccaacaccataaccataaatatcgatccaattaatatattatagatcaaattgcttattaaccctccacaaatatcaatgat

SEQ ID NO: 41096 - DNA, 152 bp, Zea mays
  Clone ID: LIB3062-025-Q1-K1-H12
acgctaaagtctaccaccacccgccttctctggagttcgatctgggtgctcccccagacatgtcgggccgcggcaagggaggcaagggcctgcgtaagggcggcgcgaaacgccaccgcaaggtgctccgcgacaacatccagggcatcacg

SEQ ID NO: 41097 - DNA, 394 bp, Zea mays
  unsure at all n locations
  Clone ID: LIB3062-025-Q1-K1-H2
caagaaaattaacaatgccagagatcttatcactatcctggaggatgctgttanagttngatggccaagggtaataggattttaccaaatgtacaaatggtgcacagttacaggcagaatctgacacctttagtgaaaatggacacaggagctttcttgcaatggctgattatcttgtcactgacaaaatcactgcattcctagcgcaaatgcaacgtgcagcaactgaagtccttaaagagaaacaactgaaagaccgtatgaacatggaccaagtattgcagacagtattacaaatattggacatgttcatggccctttctgaagataactcatggataaattatcttgtacctgagaatccccctgtttatgcacagttgatggctgtgtc

SEQ ID NO: 41098 - DNA, 436 bp, Zea mays
  Clone ID: LIB3062-025-Q1-K1-H3
gaagagtaattttggcaaaagaagagctgggatcggatgttgatctcgactcacttgccaatatgactgatggttattcaggaagcgacctgaagaatctgtgtgtgaccgcagcgcattaccccattcgagaaatcctagagaaggaaaagaaggagaagagtttggctaaaacagaaggtaggccagagcccgcgttgtatggaagcgagcacatccgtcctcttagcatagacgacttcaaatccgcccatgagcaggtttgcgcgagcgtttcatccgactcggcaaacatgaacgagcttctccaatggaacgacctgtacggcgaaggcgggtcgaggaagaggaaagcgctgagctacttcatgtgacggcgagagacataaaaccagaaggatcacaaccgcgccataaagccagaaagtatcgcagt

SEQ ID NO: 41099 - DNA, 412 bp, Zea mays
  unsure at all n locations
  Clone ID: LIB3062-025-Q1-K1-H5
tgttaacatcattttttgtgcctgtcttaagctggatattatgctgtgtggtgggtatggtcccatatttctgacacattttcattctgattagtctttttgtagcacatttgtgaagctgttaatttaacaacaatgtatatctagagttattagattgcagtctcttcgagtcccttttgtttgatgcttacagaagccccccctcccttgacatagcctcaaaattttcaacaacatgncttgtgatgcaacagaaggcctaatttcattttttttatcttttctccaatagaatccaccctctgttccaacactggctgctgtaaaactggcaagttggctgagaggtgctaaatttattgttgattggcataagtttggatatacattgtcggngttgtcgcatggc

SEQ ID NO: 41100 - DNA, 434 bp, Zea mays
  unsure at all n locations
  Clone ID: LIB3062-025-Q1-K1-H6
ggcntcggccncnaagnncccganaaaaataacaatggcttaggtcttatgactatcctggaggatgctgttagaggtggatgtccaaggctaatagtggcagaggacattgagcaggaagctcttgcaacccttgtggttaataggcttagaggtgcattgaagattgctgctattaaggcccctggttttggagagcgcaaaagtcaatatcttgatgacattgctactctcactggaagcactgtcatcagagaagaagttggattatccttagacaaggcagacaatgcggtcctaggaactgctgctaaggttgtagttaccaaggattcaacaacaatagtgggagatggcactacacaggaggaagtgaacaaaaaggtgacacanatcaagaaccagattgaggctactgaacaagaatatgagag

SEQ ID NO: 41101 - DNA, 318 bp, Zea mays
  unsure at all n locations
  Clone ID: LIB3062-025-Q1-K1-H7
ccggcaaaatctgcacgagagacagaggacgagattgccgatgcggaggacgccgccgggtcggtccgacgggccggcataaccgactaccgcaagaagctgctcaactgcanggagctcgagtcgcgcgtcggcaccgtgagagaaagccttaaaaatgcaaagagggattttaccaagactgaagacgacttgaaatctctgcaaagcgtggggcaaataattggaaaggttctccgacctcttgataatgaacgctttattgtgaaagccaacagtggtccccgatatgtggccggttgccaaagtaaagtacac

SEQ ID NO: 41102 - DNA, 412 bp, Zea mays
  unsure at all n locations
  Clone ID: LIB3062-025-Q1-K1-H8
gaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcattccgcgcagcagcgtggacgtggagcggctgggcccggagctgcaggagatgcgcggcgggctgatccgnctctgcgccgacgcggaggcgctgctggaggcgcactactccgacctgctggccttcttcgacaacccgctggagcacctgtcgctcttnccctacatcaacaactacattctgctgagccagctggagcacg

SEQ ID NO: 41103 - DNA, 334 bp, Zea mays
  Clone ID: LIB3062-025-Q1-K1-H9
tgcattcaggcgccacgcacattcgtcgtcagtcccagaggatcttgtgctcagggaacagatctggcgcaacaagcctccgtggcgcattggcagagcatcatcaagatcttgacaaattctctcgatgttctgaaatcaaattacgtgcctccgttcctgatctgcaagatgttcacgcaagtcttctcgtttatcaatgtgcagcttttcaacagccttctgctgcggcgtgagtgctgctcgttcagtaacggagagtacgtgaaggctgggctggatgagctagagcattggtgcttttggctgactgaagagtacgcatgatctgcat

SEQ ID NO: 41104 - DNA, 277 bp, Zea mays
  Clone ID: LIB3062-026-Q1-K1-A1
tcgaccgcgcggcgccggtccctgtcccggtcccggtcctggcgcccgccgtgtccgtgcagaggtgggccgagcgcgggtactccgttgtcaccgtgcagtgcggcgaccggaccaagctgctgttcgacgtggcgtgcacgctccacgacatggactacgtcgtgttccacggcaccgtggacaccgcggccggtcgcgcgcgccatgagttctacatacggggcgccgacagcagccccatccggtccgaggccgagcgcgagggtcttaccca

SEQ ID NO: 41105 - DNA, 400 bp, Zea mays
  Clone ID: LIB3062-026-Q1-K1-A10
gtctgaggaagcagtgcacacaatgaaagattatgctggaacatgctcatcaaatcccagggtacccatgcagttgcgatgacgaccttgcattcccaggtcctgaaaaatcaggagatgaatcagtcaatgttgaggttaaagtacaccatggttctaatctgtctcagttaggatcaactgatctcttggatgatactgaattgcttcaccagggccataaccataaagatcgatccaatgaggatatgatagagcaggttgcttctgaaccctgcacaaatggggatgatatcgtggaggctgcggctgctaccaaatactttcgacaatggatctgttgtggctgttgctggtaagagaactccatctggttctggtcactatgaacacaatgtct

SEQ ID NO: 41106 - DNA, 344 bp, Zea mays
  Clone ID: LIB3062-026-Q1-K1-A11
ctgccacatacgagccaaaaaggaacagtgaaataagggtttttgagagttcagatgagattgcaacggatcttggtgagtatatctcacaagtttcagaaatttctgtcaaagaaaggggatactttgccatcgccttatctggaagtcccctagtcagttttttggggaaactttgtgaagctccatacaacaagacactggattggtccaaatggtacatcttctggtctgatgaacgtgctgtggcaaaaaaaccatgcagagagtaactataggttaacaaaagaaggattcctcgccaaagtaccgattctgaatggccatgtctactccataaatga

SEQ ID NO: 41107 - DNA, 378 bp, Zea mays
  Clone ID: LIB3062-026-Q1-K1-A12
atcgggtcccacagactcatacgcatatatttttacagacacccatcagaagacacatgcacgtacaagttctaaccaccttggggaacctcaagtaaaacaacctatctatcctctaattacaacacattaactactatcattcttttataaccttcacattttatgattctgaaaacctgacaaatgcgaaaaccatcaaactgtaaatctactaatcccactccatgtataataatgccattattttgtatcaacctaaattatgactactgcgaacagataaatttatttacctgccgtatctctacaacttgcatctgcttcgcttctagttgctagatcaaaaccctcttttctacactaacggctcctaca

SEQ ID NO: 41108 - DNA, 389 bp, Zea mays
  Clone ID: LIB3062-026-Q1-K1-A2
agctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatcctgcagcgcctggccgtggcgcgcggcgcctactacgccatcacg

SEQ ID NO: 41109 - DNA, 293 bp, Zea mays
  Clone ID: LIB3062-026-Q1-K1-A4
gccggcgccgctgcagtgtccatagccacctcaggagactgagatggggggttttgtcaaggcccacgagagcaatgcgtacttcaagcgtttccaggtgaagttcaagagaaggcgcgctggcaagacagactacagggccaggataaggctgattaaccaagacagaaacaagtacaatacacccaaatacagatttgttgtgcgatttaccaacaaggacatcacagcacaaatcatctctgctagtatagcaggtgatatggttcttgctatgtgcttactacgatgag

SEQ ID NO: 41110 - DNA, 429 bp, Zea mays
  Clone ID: LIB3062-025-Q1-K1-G8
ggcctcgggccacaggttctgacagttgtcaatgacattgcttagcttgtatgttagagttcaggtcaccatagtaggcaggcatggctacttagattttgcccagggtacaaatggtgcacagttacaggcagaatctgacacctttagtgaaaatggacacaggagctttcttgcaatggctgattatcttgtcactgacaaaatcactgcattcctagcgcaaatgcaacgtgcagcaactgaagtccttagagagaagcaactgacagaccgtatgaacatggaccaagtattgcaaacagtattacaaatattggacatgttcatggccctttctgaagataactcatggataaattatcttgtacctgagaatccccctgtttatgcacagttgatggctgtgtccagtagtggctttgatga

SEQ ID NO: 41111 - DNA, 403 bp, Zea mays
  Clone ID: LIB3062-025-Q1-K1-F2
gtgaaatatcacagggatgagcaaagggatgtttccaggattgtggcctgggaagggaaaccatacagggttaagcatgaatatgaagggcaatggaatgataagaagacccgcctgacaacgtgtgaccctcatgctcaacgtatcattacttcgtccgagtctcctcaggaggtcgaagttggcaaggatatcatatttacttacgatgtggatttcaaggagagcgacatcaagtgggcatctcggtgggacagctatctattgatgacagatgatcagatccactggttctctattgtgaattctctcatgattgttctcttcctttctggaatggttgcaatgatcatgcttcgtaccctttaccgggatatctctaagtataaccaacttgagactc

SEQ ID NO: 41112 - DNA, 329 bp, Zea mays
  unsure at all n locations
  Clone ID: LIB3062-025-Q1-K1-F3
acactggggaggcaagtggaacgtcttatgaagtggtgcaaggtgaacaatgtacgtttncaagtggaggcgggagcggatcagatggagatggtgagaaaaatgaggcagttgatattcaaagtggttctgaatcccttcctgataatgccaatgcttaagcaactgatgaccgtgctactgtcagtctttctgatgaaaccgggaatataccatcagttcatactgataattcgcaaaatgatgccagtgaaaaccaaggtgatgcaacttacactacctctgattcgtctgagcattgcattgttgatgctgtccatattgaaact

SEQ ID NO: 41113 - DNA, 440 bp, Zea mays
  Clone ID: LIB3062-025-Q1-K1-F4
ctcgagttgggccacctgttcgcgcaccgcaagcaaggcgcacaagataaaagcagagggggccagatgaggagggagctcgcatgctcctgtcgctaccgccgcatcctcttcctcggcagccgacgcgctccggggctggtgggatgacgtcaacgagtcgccccagtggcaggacgcggccttcttctccctcgccgccgcctacgccctcgtctccgccgtcgcactgattcagctcgtcaggatccagcgccgggtgcccgagttcggatggaccacgcagaaggtcttccacctcatgaacttccttgtcaacggggtccgtgctctggtattcggcttccatgtccacgtcttcctcctccgcgcaaaagtatacaagttggtgttgctagatctccctggtctgttgtttttctccacctacaccttgctcg

SEQ ID NO: 41114 - DNA, 417 bp, Zea mays
  unsure at all n locations
  Clone ID: LIB3062-025-Q1-K1-F5
gttcgaggtgctgcaggaggtgaggtccgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgacggcgccggcagcgacgaggggtgcagctactacgccgacgaagccgncgncgncgncgncgcgttcttcgccggacacgccacccaccaccacgcggacgaggacgaggacgccggccagatcagctggtggatgtggaactagacgttcgatcttcccacgccgatcgatcgaccgtcttcgaatcctgtgtc

SEQ ID NO: 41115 - DNA, 371 bp, Zea mays
  unsure at all n locations
  Clone ID: LIB3062-025-Q1-K1-F7
tacaaaatccttgctttagtttcatggnanagangaagcacaactgcacctgttcaaatgtaagggatccttgcacacctannaaatcttaatattccaataacatttccatatacaactatnttattgtcttcacattgttttacctatatacaatcacaaatagcttccttgccgattatgttctcngcgaaggaggatttgggaccgtttacaagggctacatagatgaaaatgtcagggtggggctgaagtcactgcctgttgcagtcaaggtgctcaacaaagatggacaccaagggcacagagaatggcttaccgaaattaactgcctggggcagttaaggcatccaaacttggtgaagttgatc

SEQ ID NO: 41116 - DNA, 412 bp, Zea mays
  Clone ID: LIB3062-025-Q1-K1-F8
atcgattccggatgaggacctcttctacggcgagcaggcccccgccggcgccggcgcccttgagacggattcggtgctcaaggcgctgaacttgggctccccgaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctgcctctctagcagcatctgctactggctgcagctgccgtcggcgtcgtggtctgtctgtcaaagtcgaagtaaaaaaacgtgagtagttgtactactgtagaagtttcttttgtatagcatgcacgtaagaaatgaccaa

SEQ ID NO: 41117 - DNA, 242 bp, Zea mays
  Clone ID: LIB3062-025-Q1-K1-F9
ctcccgctccggcttccgcttccgttcctgttgctctcctgtgttcgggttcccgggtaagcggatcgtgatcgccgcataggagtgtgaggtaccgtgcttcctcgccgcctcaactgagccacggacgaccacttcctccacaacgccttcagcacctacggcgaggtcctcgagtccaacatcattctcgatcggtagacgcacaggttccgcaacttcagcttcctcaccttctccac

SEQ ID NO: 41118 - DNA, 414 bp, Zea mays
  Clone ID: LIB3062-025-Q1-K1-G1
cttgttacaaaatcctgccaagaatgccattggagataggaagcacaaccgcaccggatcagatataagggatccttccacacctaggaaagctgaagatgccaagaacatttccatatacaacgatgtgattgtcttcacattgtttgagctagagacaatcacaaagagcttccgtgccgattatgttctcggcgaaggaggatttgggaccgtttacaagggctacatagatgaaaatgtcagggtggggctgaagtcactgcctgttgcagtcaaggtgctcaacaaagatggacaccaaaggcacagagaatggcttaccgaagttaactgcctggggcagttaaggcatccaaacttggtgaagttgatcggatattgctgcgaagatgaccatcggctgcttgtcta

SEQ ID NO: 41119 - DNA, 381 bp, Zea mays
  Clone ID: LIB3062-025-Q1-K1-G10
cggacgcgtgggttggatctagatagcacacgatccaagtatatattcgtaaataatgagacggctgtgccactgcggtgcaagccctggtgcgtctcagagcttgcttatggtgaactcttcgtgttaggtttcttccttatatctgtcgtgtctgtggtgtcgatgaactatctagtatgtggagcgtgtgcgtctcagcagttaccctgccatgccacgtggactggctgtcctgcctactggctggtaaccatgtatattaatataaaaaatgaatccgtgacccaaaaaaaaaaccaagaaattcaaaaaaaaaagaggcccaaaaaaaaaaaagggccggcccttttaaagaacccaacttaacttccccttcct

SEQ ID NO: 41120 - DNA, 410 bp, Zea mays
  unsure at all n locations
  Clone ID: LIB3062-025-Q1-K1-G12
ggctgagctcgaccttgttgtctgcattacggaaggaattccccagcatgacatggtgaaagtgaaggctgcactaaatagacaatctaaaactcgattgattgggccaaattgccctggtatcattaagcctggtgagtgtaaaattggaatcatgccaggttacatccacaagcctgggcgtattgggattgtatctcgttctggtaccttgacatatgaagcggtgtttcaaacaacagctgtaggcttggggcagtcaacttgtgtaggcattggtggtgacccattcaatggcacaaattttgttgattgccttgaaaaatttgtcgatgaccctcagacagaaggcattgttctcatcggtgaaattggaggtacggctgangaggatgctgcaacgttcatcc

SEQ ID NO: 41121 - DNA, 398 bp, Zea mays
  unsure at all n locations
  Clone ID: LIB3062-025-Q1-K1-G2
acgcgtccgatcgattccgtgttatggtggaggagagtcattcttttggggtgcttggcgagtgtgggcgtggccttgcgtgaacattatggagttcctattgaaaaaattgatatcatcactgctggaatgggaaatgcattagctactgatggtggctcttgtacaggaagtgtcagagttgctgatcatcagcgtctaagcagctctgggtatgttttctctgcatctctgccaccttatcttgccagtgctgctgtttctgctgttaactatctcgaggaaaatccctcagttcttgcaaacctaaggagcaatattgctcttttgcataaagaactatcagatacttcagggcttgaanattccagccatgttctgtcacctatcggcttcct

SEQ ID NO: 41122 - DNA, 412 bp, Zea mays
  unsure at all n locations
  Clone ID: LIB3062-025-Q1-K1-G3
attgaattttggaataatgtatatggatttgatatgagctgcataaagaagcaggcgatgatggagccgctggtagatacagtggatgcaaatcagattgtcactaactgccagttactgaagacaatggatatctccaaaatgaccccaggtgacgcgtcctttactgtaccattcaagctggtagcagagcggaatgattacattcatgctcttgtcgcatacttcgacgtgtcgttcaccaaatgccataagctgatgggcttctcaacagggccgagatcgaaagccactcactggaagcanactgttctctacctggaggatgttataactatctgtcanggggaaagcctgagtggttccatgacagtcacacccaataagagtaaccctcgagatatcgacatta

SEQ ID NO: 41123 - DNA, 426 bp, Zea mays
  Clone ID: LIB3062-025-Q1-K1-G4
agtttcttgacagttgtgattgctgttatgggagtgatgaatatgacagcaatgtcggctgtgggaacacttgctgggaggctggacaggtggcacgggagaaattgaagaagaaaattgctacatacaaaaatggtgttgttattcggaaacaggaagttgaaagggcaaaagaggcttttgctaaagatgaagcagatttagcaaaatcgaagggcgaagagaaaatgctccaaggacttgttgataaactcagagagcaaaagatattaatagagaatgcacaggaagaagagcgtttaagataagagaaggatgataagagaacataagatgaagctgaaaagcaagctgctgttgaaaagggagcgcttgatgcctctcgggatgtagattctaaggaaattcatgatcatctgcaagaag

SEQ ID NO: 41124 - DNA, 419 bp, Zea mays
  Clone ID: LIB3062-025-Q1-K1-G5
ctccgacttctaatgggccacaggcctcaggattgggaacccggattcggaaaacgttggggagtccagggaggggccatggattctccggaccaaggccccaaggtggcacaagcagctgcagtgctggtgcctcaatttcaggggcagggtgacagtcgcatctgtgaagaacttccagctcgttgctgccacgcagcccgctgctggagcaccaaccccatcacaggctaccccagtgccgcccgagcacgagaaggtgatcctgcaatttgggaaggtggctaaggacatgttcaccatggactaccgttacccactgtcagccttccaggccttcgcgatctgcctgagcagcttcgacaccaagctggcctgcgaatgaagccaccagtcatggctcaaagtcaaggacgatc

SEQ ID NO: 41125 - DNA, 413 bp, Zea mays
  unsure at all n locations
  Clone ID: LIB3062-025-Q1-K1-G6
nggtgacaaactggctggggttccgcttccgcaacccgctcgcgcgcctcgacatggacgccgggtcctggcgcctgaggaaatacgggctgaggtacgatgacctgtacgacccctatttcgacctggacatcaaggaggcgctcgggaggctgcctagggaggtggtcgacgcccgcatccagcgcctcaagcgcgccatggacctctccatgaagcatcagtacctccccgaggacctgcaggcacagcaggtcccattcagaggatatttgagtgacatgttggctctggtgaaaaaggaaagcgctgagcgtgaagcactgggagcccttccactttaccagagaacgcttncctaaattgctggctaaacatggctgcaagtcttctctttacgccaaatcagaatg

SEQ ID NO: 41126 - DNA, 417 bp, Zea mays
  Clone ID: LIB3062-025-Q1-K1-G7
tgtagaatctcaggccttcgattgtcgattgcagcagcagcaatgaccatggagagaatcgtatgagctgcttggcccccctcctgagtcactctgttacagatgcaagagtggggactgctgccaagttgttcatctttcttgtgagctgtggcatgtatgtataattgaaagatggtgcaggaaggaaggaaaatgcagcgtccgacagcgaccggtgagctttgccggtgagcctgaagggttgaaagcaaagactgacaagaggaagtgaacaaccgcgcattgttgtgagggtggattaggatgggaaagatttggcttttagcgtgcacaagttcacttgccatggactagcctctgtatgttgcttttgctttttctgaaatatcgcatcacctcttttgttgacaaaat

SEQ ID NO: 41127 - DNA, 403 bp, Zea mays
  Clone ID: LIB3062-025-Q1-K1-F12
gaaggatccattagctctagagttcaaaggttggccaagtacaggtttctaaagaaacaatgggagcttctgctgagtgctgatgatcttgatgccatgtgggtttgtctcagagaaaattgtgttattgatgatgctactggtgctgaaaagatgaattatgaagatttctgccatatcgccacagtctgcacggagcagattggtcagaaatgcaaacgatttttcagcccttcaaacttcatgaagtttgagaaggatgattctgggaagattgctatcctaccattttatctttatgtcatgcgaacagtttctcttactcaagcaagaattgatatgagtgagcttgatgaggattctgatggtttccttcagcctcatgaaatggaagcatatatta

SEQ ID NO: 41128 - DNA, 420 bp, Zea mays
  Clone ID: LIB3062-025-Q1-K1-D3
cgaccagaaagttgtggatgagaaccttgagaagctgaagaaggtgctagaggtgtgcgaggcacgccggaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagtgatgtgtcttctatgacgaaagttgagtgcctatgtgtgagcatgcttgcttgtaacgagacattgaattgttcggaaatgagcattc

SEQ ID NO: 41129 - DNA, 417 bp, Zea mays
  Clone ID: LIB3062-025-Q1-K1-D4
atggattggtccacccggttccggacccgaaacccgtcgccggccgtgtgccactgtgccggccacagggggagtcaagcggatagggtatttctccggaccatggcgtcggcggccccggtggaggagccgacggcggcggccgaggcgaaggggcggctgaccggtgactccttcatccggcgccacctcaggaccctcgccccgtatcagcccatcctgcccttcgaggtgttatctgctcgccttgggcgtagaccagaggacataatcaagttggatgcaaatgagaatccatatggtccacccccggaggtcgctgcagcactaggtagtctcaagttcccctatgtgtaccctgatcctgaaagccgccaattgcgtgctgcccttgctgaagattctagacttgaatct

SEQ ID NO: 41130 - DNA, 422 bp, Zea mays
  Clone ID: LIB3062-025-Q1-K1-D6
gcttctcaaccggataggtagcagcggagcaggtagaacgctgcacaatccccttggccgcggccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagc

SEQ ID NO: 41131 - DNA, 406 bp, Zea mays
  Clone ID: LIB3062-025-Q1-K1-D9
ttgcctacagccttccatttcagggtctgaaagctgggaacaagaaacagggatatgttaagatcatcgagaggaaaggtgctacttcaattgaagctctcttccccggatattctacccaaattagttgctaatttcaatactttccgttaattacccttgaaaaatcccccaacttttaattccttaaaaaaatggtcaaaaacccttttatttcggaaaggtttcaatttgaatattgtttttaattgaccaattctaaattcccacattccccaattaaccacggttcggcaccttccattggctccaccagttgaccaaacttttggaatggttccttttggaaccaccatttgcatttaaggcccttataaggaaagaaaaacccccttgtcaaagtttt

SEQ ID NO: 41132 - DNA, 322 bp, Zea mays
  Clone ID: LIB3062-025-Q1-K1-E1
actcactctgactatttctcaaagcctggttcttctgattggatggagaagtatgatactgtttcaatgacactgtctccaattttaacctaatctcatttcattaaatctaatctgaatcttactctcatcccatatcctaatcatatcaattcttaatctcacattaaatttatgatacgagcaaagccaggcatgaaataatatcaattataaagtatcttccttcaccatatttatatgtattgaatttacctacattactcttatacatgtatatgttctactctacataatagtactgttctacattatagacatt

SEQ ID NO: 41133 - DNA, 425 bp, Zea mays
  Clone ID: LIB3062-025-Q1-K1-E3
cacgcactcgggtaaagctatctcgagctagctagctgctgtaagccgttgccatggccaaaatggtgttggtctgcgtgctcggctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccaaggcaccgtcgccgtcggcttcatc

SEQ ID NO: 41134 - DNA, 412 bp, Zea mays
  Clone ID: LIB3062-025-Q1-K1-E4
gattccccaatcccgtcaccatggccgcgccgccttctccttcgtcccgctcccggtcgagcgaggttgccgtccacagattcagcggcaccttggatgtatcatcatcgccctcaaggaccgagttgttgagcatggtgaagaagcactcacatttgattgggtggacgattattggtgccgaggatgatgcatcagatgtgggaatggatgataaattctggcatgaaatgcttgacctattctttgtgcgtggcaggcaatcaaaaagaagtgaagaggatgaccttgtcttctttgttaataacatgaaattgcatggttatggtttcaatgataacatggaagatccacctcccttttttgtacggagatgggctcccacgcttgaaaagatcagtattaatacagt

SEQ ID NO: 41135 - DNA, 434 bp, Zea mays
  unsure at all n locations
  Clone ID: LIB3062-025-Q1-K1-E5
gcacggctntcctcctgcctttggaaattcttaaaggccggttagtttgaaggggatggaaaatttggttcgggattaagggcccgtggttccaattttaaccgattgtcgggggattaaatctgacctggaccttgctctaatccggtttgctaatgatgtcagttctgaaagctcacattgaggttatgagacgagcaaagccaggcatgaaggaatatcaattagaaagtatcttccttcaccatgtttatatgtatggaggttgccgacattgctcttatacatgtatatgtgctactggagataatagtgctgntctacattatggacatgcngcagctccaaatgaccggactttgaatgatggagacatggcactaatggatatgggagctgaataccatttctatggatctgatttcacatgctca

SEQ ID NO: 41136 - DNA, 322 bp, Zea mays
  unsure at all n locations
  Clone ID: LIB3062-025-Q1-K1-E6
ctcactcttcaaatttctcaaggtctgctttttcggactggatttacaacttttttactgataaaattacaggtgatccaattttaaccnaatcccttcatcattaaatatcatctttaactacctctcatcctatcttctaataatatcactcatataatctcacattgacgatatatataatatcaacaccatgcatcaaataatatcaactataatgtatactactttaccatgtttatatatatataggttccctacatttcttttatacatatatataaactactccatataatatttctttacaacattatataca

SEQ ID NO: 41137 - DNA, 402 bp, Zea mays
  Clone ID: LIB3062-025-Q1-K1-E7
cgcgcctcgatcctcctcgccccgcctgcctctcctgccctcccccgcacctgcagctgcggagagcggggcaagctagctgcagaggagcgagacagcaggaggaggatgaggacgagaggaagaagagatggcgggctgtgatggagccaagtcgtcggcgtccatggaggaagaggcatgcgcggagaagaagtacggagggatggcacccaagaagcccttgatatccaaggaccacgagcgcgcctacttcgattctgcggactgggtgctgggcaagcaagccgcgaacagcagcagcaacagcacgaggaccgcatccgccgttgagtctctgaaacccaagctgaagcactgatgagactgaactcgctaaccgggctggtcctttctccctgt

SEQ ID NO: 41138 - DNA, 411 bp, Zea mays
  Clone ID: LIB3062-025-Q1-K1-E8
aggtcattgagcattacaatttcgcaccgttgactgccgttttgtctgtgaactacgctcgatagattcctgctgacgtatgagttccctgaaggcagagcttggatgactcagctcttggcagtggcttgcttgtctttggcttcgaaaatcgaagagacttttgtgccactccccttggatttgcaggtagccgaggcaaagtttgtttttgagggaaggaccataaaaaggatggagcttctggtgctaagcaccttaaagtggaggatgcatgctgttactgcttgctcatttgttgaatactttcttcataaattgagtgatcatggtgcaccctccttgcttgcacgctctcgctcttcggaccttgtcttgagcaccgctaaaggtgctgaattcgtggtattc

SEQ ID NO: 41139 - DNA, 329 bp, Zea mays
  Clone ID: LIB3062-025-Q1-K1-E9
gggactagttctagatcgcaacggccacatgcggctgaggtacgaacgaaaacatgaggcttgtagtgatgcgggtcctgtgtatcgggaagatgggaccgcctgtttatctctgcttctatatatcaactgcgtatcatgatcagctgtctgcttaccgttgagtttcatatcagagtcctagatcatctgagtatttagttgctttgcttgcgagatttacagcactattcccgtgggtcgaacgtttcttgcagatgcttgaactttatgttgtcgaacggtccttatctacacggtcacatactcttttgtaacaaaaagcttat

SEQ ID NO: 41140 - DNA, 413 bp, Zea mays
  unsure at all n locations
  Clone ID: LIB3062-025-Q1-K1-F1
gcggcgcagaggagaagaagcccgccgccgcggtggccccgattttgccgttccggccgctgcaccaggtgccgccgcagtacatgcacatgatcagcaacgactacatgagccagtaccaccgncccccgccgccgcccgtggcgtaccacccgtacgcggcgccgcccccgccgcccccgcagtactactacgtgcgcaacatgagcatggaggagaacccaaactcgtgcgccatctgctgaagcaatcgatcccggccgctttgtctgtcgcgtcgcgcgcgcgaacgtgagtacgtacgtgtctnccggnccggcccgccccgccccgtccatgtgtacatncgtcgtcgtgttacgttattattacgatgagaagacagacgaatcatactagctactcgtagcttt

SEQ ID NO: 41141 - DNA, 188 bp, Zea mays
  Clone ID: LIB3062-025-Q1-K1-F10
ccggcgcgggcgtacggctacgcacacggacatgcgacgaactggctctgctaagttgccccatatatctggttccaggatgaaggcgtgggggcgtagtgatacacaaaacgctctggacgccaatctgacgatacttgcctacatctacgctgaggcctttaacaaaattagccagaacgacacac

SEQ ID NO: 41142 - DNA, 385 bp, Zea mays
  unsure at all n locations
  Clone ID: LIB3062-025-Q1-K1-F11
ccgacgactacgacgacggggaggtaggggacgaatcgttgcaagcaacgaggtcagaactaaggaggccgatccatcctccagcctccgatcccatccgacgacatggtctgcgtcgcgtgcctgctgccgctcttcctgatcccggtggtcaacgccctcccttacctcatcgacctcatcatcagcaaggtgtatcggctatttggatgggagtaccggagacctgaaagagtcccacctgcatgtccatacaagcctgcagctcagaagaacgatgagggtgcgagtgaatcaaaacccctggtcgaaccgcacggtgctggtgcttgtgctgcggcggcagaggataagaaagtggaatgatgcaacangcgcttaaaat

SEQ ID NO: 41143 - DNA, 391 bp, Zea mays
  Clone ID: LIB3062-025-Q1-K1-D2
acgcgatgctggaattcgagaggctggtgaaggtgaggcaccaggtcgtggccgggaccctgcaccacgtgaccgtcgaggtgaaggaggccggcggcggcgaaaagaagctgtacgaggccaaggtgtgggagaaggcgtgggagaacttcaagcagctgcagagcttcgagctcgtcggagacgccgcggtcgcctgaggcgcacaggcttttcgctggaggctggagtacaacaatgaaagaatttaactgtcatcccactggaaaagtatgatataatgaataaaccagcgtcttaccacatgtattgtaccctaatgagatatttgacccctgtaatagaatgagatgtgctaaggaatctgaaagtcttcttgctttttgttgcc

SEQ ID NO: 41144 - DNA, 378 bp, Zea mays
  Clone ID: LIB3062-009-Q1-K1-D7
cgaaagaagtgtatgacacactcactcgctattctgcatacgctgccttctacgatcggggacaccgtacaccatattgcttgctctcaaagaggaacagttgaaaaactcacacgccttttacatctcatcaccacgtcgatcgtcaaggaccttaactcggcgtcgaaacacacgaaaggcacacacgatcaactcgatgaaatgttcatggtcagctaaatttgtattgaaccagtatattgcgcctgtcatgttccttcgcacatactggatccacgagcatctctctacttttactaacgacctaaccgactacttgatcagacttcaatacgctctgatcagattgaatgtcgttttcataagtcatatgtg

SEQ ID NO: 41145 - DNA, 424 bp, Zea mays
  Clone ID: LIB3062-009-Q1-K1-D8
gcagagactggccttagcctgttgttggagatcttgaaaaaattccaggcttcaggagggcaaaaccaattctacaaaacctactttttgacaattgagcaagagatttttgcagtcctcacagacacattccacaaacctggtttcaagcttcatgtttcggtgctacaacacttgttttgtgcggttgatggtctaacggagcctctatgggacgcgtcttctgtaccttaccaatatacggataatgctatgtttgttcgagattacaccataaagctcttagggacatcatttcctaacatgacagtaaccgaggtgacaaagtttgtagatggtcttcttagttcaaaacttgatcttccaagcttcaaaaaccatattagagacttgctggtgcagtccaaggagttctcagttcaag

SEQ ID NO: 41146 - DNA, 427 bp, Zea mays
  unsure at all n locations
  Clone ID: LIB3062-009-Q1-K1-D9
aacaggctgggcaatttcaaatgccactttttgtggcacacatgatcagatcaagtaccgggttgcccaagggtgcattaaggcactctgggatctgcttggttgccccgatcccaaaatcgtaacaatttgcttggaaggtctcgagaacattcttgaagttggccaagcagagaaaaaccttggtgcaagtgatgtcaatgtctatgcacagatgattgatgatgctgagggcctggacaagattgagaacctgcagagccatgacaacaccgagatatatgagaaggctgtgaagatgctggaatcctactggctggaggaggaagatgatgccatgccctcaggcgacaatccccagaatggcttcaactttgggaaccagccctctgttccatcaggtggattcaactntggctgaagatgc

SEQ ID NO: 41147 - DNA, 432 bp, Zea mays
  Clone ID: LIB3062-009-Q1-K1-E1
cttccagacattgtccacacgagctagtgcactggtgtcgctcgcaaccaaattaaggacgtgctgagccatggcatccaagggcgtcctcttcttggctctcaacctcctgttcttcacagtggccaacgcctgcggcagctgcccgaccccaacgccgccggtcgtgccaccgccgccgcctcctgctgctaccccacccccttcatcatccagtgggaagtgcccgctgaacgcgctcaagttcggcgtgtgcgtcaatgtgctcggcctcgtcaaaggcgaggctggcaaggtaccagctgagccatgctgcaacctcatcaaaggccttgcagacttcgaggccgccgtctgcctctgcacggccatcaagggcaacgtcctcggcgtcgtcttcgatgtccctatcaagttcaatgcccctcgtca

SEQ ID NO: 41148 - DNA, 343 bp, Zea mays
  unsure at all n locations
  Clone ID: LIB3062-009-Q1-K1-E10
cacacagtcagaccgacggactcattaacacacacacggacacacaggttcttcatacacgccgtagccatggcttccgctgcgcagaagaagatggcaattgtttgcttgatgctgctggccgtcgtcggccaaatcgtcgctgatgctgatgttaccgtagaacatcccagccgcatctgcaccgaaacggtgattgatcctcgtgttcccaacaacgagtgcatatgctccaagaactgcgcctgtgcccgcaagtgcatacttgagtcgcctgatgctgtccaaacctgctttgtcgactgcgtnctcaagaacgactgcatctgcagcagcaagatca

SEQ ID NO: 41149 - DNA, 428 bp, Zea mays
  Clone ID: LIB3062-009-Q1-K1-E11
ctcctttgcaatctcatcctctctctctctctccctctctctctctctggcggtcggcgtggctccgggggcgcgaagcgcgggctcggcggggcgactcgccggcggcgacctgcaggtttgggtatgagaggggtcacccacgcggcgcccaccacaagcgccccccgcccccgcggacgcctcatggacggcctcctcatcttcgtcttctacctctcgctgcccacccgtgccggccgcgaccactcgtcaatcgccgcctctaattgttagccggcggcggcacgccattggtcggcacggcttccgagaagctcgatctggggcctaaccaggcagcctcacgcgggatcaggatcgatggaccagccaccgaatggattcgccggcggaggttttttcacgcacattgatgggcaaaaccg

SEQ ID NO: 41150 - DNA, 409 bp, Zea mays
  Clone ID: LIB3062-009-Q1-K1-E12
attgaactcccatgtactcttcacaatcttgactaccatcatagtcatgccgaccacgtggcttcatgaccttagctgcctgagctacctttcagctggaggtgtttttgcatcaatccttggagtcatctgcctattctgggtaggagttgccgataatgttggctttgacaacaaacgaactgctctgaacctccctggaatccctattgcaaccggattgtatggttattgctactcagggcatgcggtgtttccaaacatctactcttctctgaagaagcgcaatcagttcccttcaatcctttttacttgcattgggctgtctaccatttcatttgctggtgcaccggtgatgggatacaaaatgtttggtgaagccacacagtctcagtttacactgaactta

SEQ ID NO: 41151 - DNA, 431 bp, Zea mays
  Clone ID: LIB3062-009-Q1-K1-E2
accagagctcatatctggtgcaacggaatatactactgctattgatttgtggtcaacaggctgtgtcatggcagagctgcttctaggacaggctctgcttcctggagaaagtggagtcgaccaactacttgagatcatcaaggatttgggtactccaacaagggaagagatcaagtgcatgaacccaaactatacggagttcaagttcctacagattaaagctcatccgtggcacaaggtttctcaaagaatgcttccacctgaagcactggaccttgctagcaggtttctacaatactcaccaaatctaccgtgcactgctttgcatgcctgtatgcaccctttcttcgatgagctgagagacccacacactcgtctacccaatggtcaccctctgccgcctctcttcaacttcaaatctcaagagctaa

SEQ ID NO: 41152 - DNA, 437 bp, Zea mays
  Clone ID: LIB3062-009-Q1-K1-E3
ggaattcccggcgctactgatctctttaacatggtatcaatggatgggaccaccgagaaagggtcagagtcattttccaaccattgggatggcttggattgctttcaagctggacaacccggtcctaacctggaaggaaaaggatcttgccaaaccaccgaaagcttgcccaatcttccttttggaatgaaaaactaattaaaagatcgccagttgtgtcattatcctcagcttcagctgtttcccaagtaaatgcaaagaatgatatcatgagtttgtttgagaagtccaacatggcatcgccattcgctgtccaacagcagcagctggcgtttatgtctcagcagcaagctcttctaatggctgctcttaaagctggaaattcaccacaaatagttccagggaatgccaatcaactaaacactaacgtttctagt

SEQ ID NO: 41153 - DNA, 423 bp, Zea mays
  Clone ID: LIB3062-009-Q1-K1-E5
gaggatagaaaaattatgatttcgaggcataaccttgttaaattgcacaaggtgcttgaggagcatgatctttcttgtgtggagcttttggatgtgaagttggatggtattgttttaacaaaacaaaaagcggagaaggccgttggttgggctagaaaccactatctgtcatcaacaactcttccttctatcaaaggtgacaggttaatcattccccgtgagagtctggatatatcaatcgagaggctgaaggaacagggtataacagctaagaaatcctctcaaaatctgaaggttttggctaaagatgagtatgagcgcaatttcatttctgctggtgtgcctccgaatgaaattggagtgaaatttgacgacatcggtgcacttgaggacgtgaaaagaacattggatgagctttgtaca

SEQ ID NO: 41154 - DNA, 440 bp, Zea mays
  Clone ID: LIB3062-009-Q1-K1-E6
cttcctgatcccaccgcggtctccttccgcgacacgcgcacacgccacagcgcattcgcgtacgtcaacggacgtggaacccatcgcccatgggaggagggcacgaggagcaggagggtggcggcgcaaaggccgggggctactcctccggtctcccgccgtcggagccgccgcacctgcagggccagccgccgcaggagtacgggtacggcacgttccagggccctcggcatcctcccgtcgggttcccgcagcctgccccgcctcccgggttcggcggcggcggcggctaccacaaccagcaacagccgtacgcgcacgcggagacgtactacgcccaggggtaccaggccgtgccaggctatggtcctgttgctgaaggaagacctgtgagaatgaggcgtctcccatgttgtggcctcggcttaggctggtgcctg

SEQ ID NO: 41155 - DNA, 303 bp, Zea mays
  Clone ID: LIB3062-009-Q1-K1-E8
tggtgggcatgttcatattataacatgcaatgatgacttataccagatgataatagtagcatacacagatgtgaaaactattgtatctaatttcaaagcttcctgatgtgcaccatgccatgtcattgctcctgtctatgcttaaacgtcaactacttatcctaaactaatagacttgacaatacacattaatcacttgatattacttcaactcttcatatgacatccacgcaacaacgacattcttcttactcaacaacggacaactaatctacaagctagttgacgcaaacaaacctgagc

SEQ ID NO: 41156 - DNA, 427 bp, Zea mays
  unsure at all n locations
  Clone ID: LIB3062-009-Q1-K1-E9
ccttaacgggccggccgttagcgcctgcgcagctttcggattccctatccccgagggattggtgcctactgcgggggccatggcaagcctctctccatcttctatcggcccaaaattgcctgccaacacgccgacgggctcagccaagtcccccgcgggacgcgtcaccgtcgncggaggcctcgtcgccctcgccgcgctacccgtcgccgtcgcggccgggatcatgttctagagcatctaccggtcgtcttagactttgtgatttcttcgtcatcattcttcttacagcacacacatgtttgtgcattatggtactagttcgttaattcacgtacaaacagctagctgttccaggcacgagattcttccggatttgtttccttgtaataattccccttgatgagcgtgtgtttggtatgtttct

SEQ ID NO: 41157 - DNA, 417 bp, Zea mays
  Clone ID: LIB3062-009-Q1-K1-D6
ccagggtggacaaagcccatttgcattgtgaggcatgcattcggcgatcagtacggggggactgatgcagttatcaaggggccgtggaagcttaaattagtttttgagggaaaagaacagcatgttgagctggaggtgttcaacttcactggtgccggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaactcaaatttgaagctgccggcatatggtatgagcaccgccttatcgatgacatggtagcatacgcacttaagagtga

SEQ ID NO: 41158 - DNA, 446 bp, Zea mays
  Clone ID: LIB3062-009-Q1-K1-C12
ccggcccgacccacgcgttcggcctggggcttcatttggatttaaccagacccttgggataagcttgctgtatatggacaggttcttctgactagagttggtatcctttggttttttgctcttccaattctttgcagtcagttcatggatcttgtaactgaacagtgtttatttgtatagatctgccaccagataaagagcctcttgattggaacacacggatgaagatagctgcaggtgcagctaagggcttagaacaccttcacgacaaggcgagtcctcctgtgatttaccgggattttaagtcatcaaacattcttcttggagaaggatttcatccgaagctatcggactttggccttgcaaaacttggtccggttggtgacaagacccatgtttcaacacgtgtgatgggtacatatggctactgtgccccagaatatgca

SEQ ID NO: 41159 - DNA, 427 bp, Zea mays
  unsure at all n locations
  Clone ID: LIB3062-009-Q1-K1-C2
gttattagtggaaaagctggtgagaggttggagaaaggatcaataattgcttccaaaaggcaaattgatacaaaaattggagcatcatcaacaaagatgtatttccactactacgggcaattattacatcagcaaaacatgttacaagattntgttcggacaggaacatactatgctgctgtaatggaaaaccgatctgactttgagggtcgagttgtggttgatgttggggctggaagtggtattctgtcgttatttgctgcccaggctggtgccagacatgtctatgcagttgaggcatccgaaatggctgaaaatgctcaacgtctaatgtccgggaatccgtcacttggacagcggatcacggtcatcaggggcaaggtcgaggaagtagagcttccagagaaagctgacatattgatttctg

SEQ ID NO: 41160 - DNA, 432 bp, Zea mays
  Clone ID: LIB3062-009-Q1-K1-C3
ggctagcggcgcgggcagcacgggccccccgcaaccggcgctcgccccctggttcccttgcccggccttccggccggggcggttccccgtggggcagcgtcaatggccctggcctaaacggcccggccgcaagcactggtggcgcgcacagacccggcaagtgcagccacggatcaggccaggtacgtccacggcgcggggtgctttgcgcggctccgcgacggcgcacaggcggctcaggcttgcgggctcgcggccccaacccccggctggcgcggccccggccctagcctcggcgcgggcgaggccttccggcgcgcggcccctgctgcgagcgcatcccggcggcgagcgcgacccctgctgcgagcgcgtcccggcggcgagcgcgacccctgcaagtcacaggctcggggcgggcagcctattcgc

SEQ ID NO: 41161 - DNA, 428 bp, Zea mays
  Clone ID: LIB3062-009-Q1-K1-C4
ggcaaatattgatgcagcggtcagaaagttttcagacaaattcaccattatgttgttcgattatgatggtcggactacagagtgggatgaatttgagtggtctaaaagagcaatccatgtgagtgccaggaagcagacaaaatggtggtatgcaaaacgatttttgcatcccgatgttgttgccagatatgattacattttcatctgggatgaggatctaggtgtagagcatttcaacgcagagaagtacattgagcttgttagaaagcatgggttggaaatctctcagcctggtttgcaacctgatagaggactaacatggcaaatgactaaacggcgtggtgaccaggaagttcacaaagtaactgaggagagaccaggctggtgcactgatccacatctaccaccatgtgcagcatttgttgaga

SEQ ID NO: 41162 - DNA, 106 bp, Zea mays
  Clone ID: LIB3062-009-Q1-K1-C5
ccatctccctacggctcgtctaacttaaaacctcacacgcccctaacactctcctctctactcaccccctcacactctaccacacaccctcatatacacccccctc

SEQ ID NO: 41163 - DNA, 420 bp, Zea mays
  unsure at all n locations
  Clone ID: LIB3062-009-Q1-K1-C6
gctagccacctgctggaatccttcgtcgcgcatgccactgcacggtcatgtctgactcgtctcgtccgtcgtcgctaggctggctggaaaggtggcgctgatcacaggcggcgcgagcggcatcggcagggcaacggcggcggaattcgtccggcacggcgccaaggtcatcctcgcggacgtccaggatgacctgggacgccacgtcgccgcggagctgagcctgccggggggcccggcccggcggccgtccactacacccgctgcgacgtgaccgacgaggcgcaggtcgcggcggcggtggacctggccgtggagctgcacggccgcctcgacgtgatgctgagcaacgccggcatcagcggcagcctggcgccggcccncgtggcggcgctggacctggccgacttcgaccgcgtc

SEQ ID NO: 41164 - DNA, 428 bp, Zea mays
  Clone ID: LIB3062-009-Q1-K1-C7
aacaatacaaacaaagctgtaacgtactgtaaaagtaagatatggaggccgccggcgggggcggcgaggttcacaaggctagcaacgacaaggaggagcatttcgtgctcgtgcacggcgccggccacggcgcctggtgctggttcaagctggcgtgcctgctccggggctccggccgccaccgcgtctcctgcgtcgacctcgccggggccgccggcagcctcgtcgacccggacgacgtccgctcgttcgacgagtacgacgcgccgctcctcgacttgatggccgccttgccggacgacggccgcaaggtggttctggtagggcatagcgcaggaggactgagcgtcacccacgcgatgcatctgttcagagacaagatcaagcaggccatcttcgtagcagcgaccatgctcccgttcgggtac

SEQ ID NO: 41165 - DNA, 381 bp, Zea mays
  Clone ID: LIB3062-009-Q1-K1-C8
gtatcgatgcgtgcaatggaggatgctcttattgctataaggggtggtcgcatacctggtgcaagcagcttgccaacatttgaggagatcaagaatactcttggcttcaaccactattacgaagaagacaaacgatatgcggtgacaccagcccaaccattgtacgggactggctatgataattatacaagtgaaccgaacagtccgggagattccaggtccagggctaaaaaaacacaagaacctgttattgacatattgcctcagctctatgatattggttccagtgacagcagaggaccttcaactggaatgtggtctcgaactcttcgactaaagattacaggaagagatgggatccagaaaatcgatgccaggata

SEQ ID NO: 41166 - DNA, 103 bp, Zea mays
  Clone ID: LIB3062-009-Q1-K1-C9
tctgtttgtggtccgcattcgtggtatcaatgccatgcaccccaagacccgcaagatcttgcagctcctgcgtttgaggcagatcttcaatggtgtctttctc

SEQ ID NO: 41167 - DNA, 398 bp, Zea mays
  Clone ID: LIB3062-009-Q1-K1-D10
tcgtgcatagagtgggaagcccacagccggctttccaatgggcttacccttggctttcttaggggccgaaccaaagaacttgggtggccttttccgtcatgaccagggcattcctggaacctacatcggctttcaattgacggtcaatgctggcacagctgctgcagggtccgcgagtaggacggctctaatctctccatcacgtgttattatctggtgtttccataatgcgatttgatttcaatttggcgttagatgttgtacacgtgtatttaactgcttgagttgtacgtaatttgtatacttgtaactttgtttaataatatggctattactcaaaaaaaaaaaaaaaaaaaaaaaaaaaaaaaaaaaaaaatataaaaaaaaaaaaatataaa

SEQ ID NO: 41168 - DNA, 348 bp, Zea mays
  Clone ID: LIB3062-009-Q1-K1-D11
ccacgcgtccgggctctaactctgcttctagaccggtgatggttcagcttagaagcatgggatcttcatggtgagaataaaaacgtgtgttgttgtgttgctgggtctacgccactagtatttctggtgttacttatgttcctaggtaaaactgcgcagccagagcagagctgaagaatatgtactgcttgctcgctcttgtgtggttgtgtctacccctactagcatttcagctttgttgtaggtaaactgcgaacccagagttgcagaacccgtactgctcgtttaagttcatggtgaactacgagctaaaaggctgttgccagagtggatgtcacttgtcactgg

SEQ ID NO: 41169 - DNA, 427 bp, Zea mays
  unsure at all n locations
  Clone ID: LIB3062-009-Q1-K1-D2
gcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaggtgacgaggaggagctccagaaggagaacatcaagaacgccgnctcctccaccggcaacatcacgttgagcgtcaccaagagcaacccggagaccggcgaggtcatcggcgtcttcgagagcgtgcagcc

SEQ ID NO: 41170 - DNA, 391 bp, Zea mays
  Clone ID: LIB3062-009-Q1-K1-D3
acgggtggcttcttcttccccttcgggtccggttccggttcctgaaggttttccgggttcgggttgcgtggtcaaccggatcgagatggcggcgtcggatgttgaataccgctgcttcgtcggcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggagctggacggccgcaacatcaccgtcaacgaggcccagtcccgcggcggccgtggaggcggcggcggcggcgggtacggtggtggccgt

SEQ ID NO: 41171 - DNA, 416 bp, Zea mays
  Clone ID: LIB3062-009-Q1-K1-D4
gcttatattagtacgaaagcaagggggtcatctaccgcgtgtatcatcactcttaaagatcagggtatccatgctgtaaatcttggggatagtggtttcgtagtagtccgagatggccgcactgttctcaggtcaccctcacagcagcatgatttcaattttacttatcagctcgagagtggaggtggcagcgatcttcctagttccgcacaagtatctcactttccggttgccccgggtgatgttatcgttgctggcacggatggactatctgacaatttatacaacaatgagataagtggtgttattgttgaagctctccgggttggacttgagcctcagattgcagcacaaaaaattgccgccctggctcgacaaagagctacggacaaaaataggcagtcaccttttgcatc

SEQ ID NO: 41172 - DNA, 413 bp, Zea mays
  unsure at all n locations
  Clone ID: LIB3062-009-Q1-K1-D5
gaagaacgcggagacaggctgggacacgccgatccacgtggacgcggcgagcggcggggtcatcgcgccgttcctgtacccggaactggagtgggacttccgactgccgctcgtgaagagcatcaacgtcagtggacacaagtatggtctggtctacgccggcatcgggtggtgcatctggaggaccaaggcggacctgccggaggagctcatcttccacatcaactacctcggcgccgaccagcccaccttcaccctcaacttctccaaaggttccagccaggttattgcacagtactaccagctgatccgccttggctttgaaggttacaagaacatcatggagaactgccaggagaacgcgacggttctgaagcaaggtctggagaagacggngaagttcaacatcgtgt

SEQ ID NO: 41173 - DNA, 417 bp, Zea mays
  unsure at all n locations
  Clone ID: LIB3062-009-Q1-K1-C11
gtcgcacactgcgcgtctgtctctcggcgcggacagcccgaccagcgggagtcggctcaggtacccgcctacacgctggggcccaagatctccgactgggacgagcagcgcgccgtctggcaccgncgccacccggagacgccgcctttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggccggcttctgggccaaactcccgctcatgcgggcgctgctcctcgcgcacccggaggtcgagttcctctggtggatggactctgacgccatgttc

SEQ ID NO: 41174 - DNA, 303 bp, Zea mays
  Clone ID: LIB3062-009-Q1-K1-A5
ccaagagatgcatgctgatctcgacctccatgccaacgccctcatcaagatccacaacgacatcaccaaaaaccaccatttcctcacgcactacaccatctagatccgctacaacaagctcatcctcacggatctttaactgatcagcgctaactccaacgtgtacaaactcatcgtacccttgctggtgaaccatgacctctagcaagccactgccaacgtcattaaacgcatctcgtacatctgctcaaagctgaaacgaatacatcacgctctcaaatacttgcaggacaagcactacac

SEQ ID NO: 41175 - DNA, 425 bp, Zea mays
  Clone ID: LIB3062-009-Q1-K1-A6
atctgtagtccctatccacgcatcacgctctcaggccctaaggtacctgtgtatacgaggggggatagaagtgccaaatgttgcagtcctcgtgggtgaaagcggcgattcagattacgaggaactgctggggggtctccataggaccgttatcctaaagggcgagttcaacatcgccgcaaacaggatccacacggtgaggagataccccctgcaggatgtcgtcgccctcgatagctcaaacatcatcggtgtcgacggctacaccacggatgatctgaggtctgccctgcagcagatgggtatactggcacggtaacaccttccggagcttccgtttccactaccaggtcaacgaagagaaacgagaaaacagacagaatggtgacgaaacaagtgcgaccgtttccatgctcgatgggaat

SEQ ID NO: 41176 - DNA, 425 bp, Zea mays
  Clone ID: LIB3062-009-Q1-K1-A7
cagggaggcttcacaaggtggacactggtaatctcccagatctggatcacctgtcgctgcgcggtgttcagtggaactggggagcagtgagctcggtgctgcagtgcgctagcgaggtgaagcatctagtgatgaagatagagttctgtggcgacctggacgcactccagccgttcccggaagtcgatttggttgacttcttcgacaaccaccccaaactccgcaaatttgagatccatggtgccatgttcgctgccctgtgccagaaaaatagcctgaaaaatttgaattcaaggttcctcatcccttgtttggaagaggttctgatcactgtacgctccccactcaatgctgaacagaagctgaacactctcgagtcgcttctgaagtacagtgtgaagctgcggacgatgatcatcagaatc

SEQ ID NO: 41177 - DNA, 412 bp, Zea mays
  Clone ID: LIB3062-009-Q1-K1-A8
ccaaagtgcgatagccagattgacttcgtcaagagcttcaaaggagcagcacaggtacgtgagaagaagggctatacggagttcactcctcattacattacctggtactgcccagaggccttcattctgagcaagcagtgcaagtcccagtgcatcaatcatgggaggtactgtgcacctgacccagaacaggattttagcaaaggatatgacggcaaggatgtggtggtccagaacttgcgccaagtttgtgtctttaaggttgctaaggagcacaagaagccttggttatggtgggactacgttactgattttgcgattcggtgcccgatgaaggaaaagaagtacacaaaggagtgtgccgatggagttatcaggtcacttggccttgatcataaggcattagataagt

SEQ ID NO: 41178 - DNA, 175 bp, Zea mays
  Clone ID: LIB3062-009-Q1-K1-A9
ccgcggcggacatcacctgcgagtacctctcccgccttcgccgtaccgagccgaccttgcgcagcttcatccacgtcgcggacgccgccgccgaacgggaagccgaggaactcgaccggaagattgcctccggggagaaagatgcggtgggtccgctcgctggagtgcttgtggg

SEQ ID NO: 41179 - DNA, 423 bp, Zea mays
  Clone ID: LIB3062-009-Q1-K1-B1
agggattctaacaaaggttgccaaactatgaaattgcaaacctagggctctaaagtaggcaaatgatggtccaaagcatctatgagcctgtttgtttcagcttctggcagcttctggccactaaaagctgctacggactgccaaacgctcagcttttcagccagtttctataaaattcgttggggcaaaaaccatctaaaatcaacataaacacataatcggttcagtcgttgtaatagtaggaatccatcactttctagatcctgagccctatgaacaactttatcttcctccacacgtaatcgtaatgatactcagattctccccacagccagattttcaaaaaagctggttagaaaaaagctgaaccaaacaggccctcgtctgccgatgtaagggtgacactgctggaacgagctatgc

SEQ ID NO: 41180 - DNA, 257 bp, Zea mays
  Clone ID: LIB3062-009-Q1-K1-B10
cagacacacaatagcggctagggctggtggggactctcaaaaattgtaactgctgtaacaaggttgccccaagggtggcctaaatcgtcatcaacttcgtgaaggggtttgctttttgcgcacctatcaagagcaccatcacttttggaccatgaatgcttccctatagatatgaacctactgttagactatttgtggatatgtacatattgacttaacacctgcaagcacactgttgctaagtgttgatgtatgat

SEQ ID NO: 41181 - DNA, 433 bp, Zea mays
  Clone ID: LIB3062-009-Q1-K1-B11
gcacccggttccgcgtgcctttccccacctactctcgcggctctcgccagccagtctagggtttcggtcccggggtgcttatccgcccccgccggccatgtcgaagcaaggagggaaggccaagccgctgaaggcgcccaaggccgacaagaaagagtacgacgagacggatcttgcatatctgcagaagaagaaagatgaagaaaaagcactgaaagagcttaaagccaaagcacagaagggcgcgattgggggctcgggtctgaagaaaagtggaaagaaatgagactggtcacccgtcttcaatacctagaagatgataaggcagctgtctatctgtgttgcgcttcactaagtgtgattgtaacagtggtacctcttgtgttctgtgttccgcgatgttgcagttggttgcttgatcgaaagatgtttc

SEQ ID NO: 41182 - DNA, 366 bp, Zea mays
  unsure at all n locations
  Clone ID: LIB3062-009-Q1-K1-B12
cacgcgtncgcacagncagtcagccacatcactagctatctgtgcagaggcaatggcgtccaaggttgagctggtggtggaagtcaagtccccggctgacaagcttggggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaagtgac

SEQ ID NO: 41183 - DNA, 425 bp, Zea mays
  unsure at all n locations
  Clone ID: LIB3062-009-Q1-K1-B2
gctctccagttcaggcgtccagcttcgcccagagtccagacacggccaacagttaaacgcgcgagcgncaccacgctcgcacgcacgccccacaggtacagctagctcccacccctcaacagcaacagctaagcttctcctagcagacagcaacatgaccgaggaggaggccaagaaggtggaggtggaagtggaggtcaccaaggcggcgccggcgaaggagaacgccgccgaagagaaggccgtcatccccgcgaccgagccgccggccgcccaggagaagccgccagcgccggccgacgactccaaggccctggccatcgtcgagaaagttgcagataaatctgctcccgagaagcctatcgctgagaagcaagggggctccagtatcagagatctcgctcttgcaagggtggaaacggaga

SEQ ID NO: 41184 - DNA, 444 bp, Zea mays
  Clone ID: LIB3062-009-Q1-K1-B4
ctagccctcgcgccgccgcctcctccgccacccagcgctcgagctcctcgcgtcctgcgagcgcgcgccgcaacgccacgatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccataggggcactccctgcttccgtggttatggcaggcgtaatggtgagcgcaggaggaagtctgtccgtggttgcatcgtgagccaagacctatctgttatcaacttggtgattgtgaagaagggtgagaatg

SEQ ID NO: 41185 - DNA, 410 bp, Zea mays
  Clone ID: LIB3062-009-Q1-K1-B7
gttttcggacagagaagatggcgacggcggcggcagggttggctccggcaaaggaggtggtggagaagaaggtggaactcctgaaggagatacgggcgcacgaggtggcgatcgcggagctagacaacctgaatccctcccgggcggtgtaccagaaagctggcaacatcttcttctgtaagagcgtcaaatcggtgatcacaacggagcagaagcaacttgaccaagccaaggctcggctgagcaagctgaaccaagcttgatgggcagcacgctacaaatgttgaccttgaacacaatagagcatgcagatttgaatggtcttctcgttgctcattaattctgcagttgggcgttgtggacctaatccatgtgtaatgctactttctttttcttgagatgtatgggta

SEQ ID NO: 41186 - DNA, 96 bp, Zea mays
  Clone ID: LIB3062-009-Q1-K1-B8
aaaaaaaaaaaaaaaaaaaaaaaaaaaataaaaaaaaaaaaaaaaaaaaaaaaaagaaatgaaaaataaaaaaaaaaaaaaaacaaggatgcccct

SEQ ID NO: 41187 - DNA, 419 bp, Zea mays
  unsure at all n locations
  Clone ID: LIB3062-009-Q1-K1-B9
ncacctcgccgacctgctcccgcgctgcgtgccgcgcgcgatatacctcgactccgacgggctcgccgtcgacgacgtgcggcgcctctgggagacgcgcctgcccgccgccgcggtcgtcggcgcgcccgagtactgccacgccaacttctcccgctacttcaccgaagccttctgggacgaccccgtcctcggcgccagggtctttgccggccgccgncgcgcgccctgctacttcaacaccggcgtcatggtcatcgacctccggaggtggcgcgttggcaactaccgccagcgcatcgagcgctggatggagatgcagaaggagaaaagaatctacgagcttggctccttgccccccttcctgctcgtcttcgccggcgagatagaggccgtcgaccaccggtggaaccagcacg

SEQ ID NO: 41188 - DNA, 410 bp, Zea mays
  unsure at all n locations
  Clone ID: LIB3062-009-Q1-K1-C10
cttcgatgcaaactcgcttggcccttttggggaaattgggcctgcccaaaagattatgtattgagggatttgggagggattcattatgaaccttggagcttaagggcttcccggaagtcaattgccaaccgaccctacctgaccagtactaccaaaaagtaaaagggaaatgatttcaaggcattcaggtcattttatcaatcacttgttgagaagataagaccacaaggaaatgggagtcttgttttcagatagcatcattctttgattttcaatatgtcttccaccaaaagactcctcaactgtgttattcaattataggctagttgtgccatcaatgtacatagagctataatntctgagattggaagacgtattactgccgcattatctttaccaagtctggcaac

SEQ ID NO: 41189 - DNA, 224 bp, Zea mays
  Clone ID: LIB3062-009-Q1-K1-A4
acgatccaccatcaccaacggcgccgcaaccactaacgtcaatctcaccgagaaaaacgtcctcgggcagtgagagctgtagcactgtagctgcagctgaactcgtcatgtgcatcaccgacccactggagccaaaacctccatgatcacgaccccactgcaggccgatcccattacaagatccacgctctgatccgttcgccgacgaccgagaccatgccgac

SEQ ID NO: 41190 - DNA, 322 bp, Zea mays
  Clone ID: LIB3062-025-Q1-K1-B7
cacctaatgatctggtttgtacctcagatgttgggcaagatgatgattgcatacaccaccagaacaatcttgctggccacccaactatccacatctgtgacgaggaaaacatgtcttttttctgacttggaagacgatgatgtgaaatggtgtacttgcaacttgcaaaccgagatatggacttttttacaagaaaatgtacaggtctagattgctcctgaaaataacaaggacaccattaaaacatgtggctttgttttgcaatcaaatttcctgggtgatgccacttttaaatctacccccgttaaaacacttattttat

SEQ ID NO: 41191 - DNA, 345 bp, Zea mays
  Clone ID: LIB3062-025-Q1-K1-B8
tcttcaaccaacatccgctcggttagagtacgacaaactatctgtgtctgtttaaactgtacgggcgcagcccccacttatctcaacaattaacatacacattacactatcatatatttccttcattattcttactcccaatcattcttcttttaacataaatatatcaaactaatttactcttatacaactctcctttttaccaatatcactaatatcataccttaaactttcttcaaactttatttcctctacatttacacatctcttctctccaatataataatttacaacacatatatattcttccaccatcttctctatcaaatcatttccaaacttaaa

SEQ ID NO: 41192 - DNA, 424 bp, Zea mays
  Clone ID: LIB3062-025-Q1-K1-C1
gttgaagttgtggtcaaatcagtcatcaaagaggagccacctaagggtcatgttgggacctcaaatgtggtgcaagatgatgatggcatagacgaggagaacaatcttgctggccacccaactatccacatgggtgacgaggaaaacatgtcttttggcggacttggaagaggatgatgtgaaatggtgtagttgcaacttgcaaagcgagatatggacttgtgtacaagaaaatgtagaggtcgagattgctcctgaaaagaacagggacaccatgaaaacaggtggctttgttttgcagtcaagttgccggggtgatgccactgttaaagctaccggggtgaagacacagatgttatcgctcgagatatggcagagatatggcagggtgctacgtttcactagcattatcgcttgtaatttg

SEQ ID NO: 41193 - DNA, 375 bp, Zea mays
  Clone ID: LIB3062-025-Q1-K1-C10
ggactagttctagatcgcgagcggtccggttttttttttttgttgaaagctaaccgaacaagccataactcttcagatatactggcgctccacttcatggctccatcgagttagactgttagagtaattttgattggccgaagcggcggtctctgccctggaaggagcgcaacgcttccaggtactcagcctccccaaagtcaggccacatcttgccggtgaagaacaactccgagtacgccgactgccacagcaagaagttgctgagcctcatctcgccgctggttctgatgaccaggtcgggacaggagaactcgccggcggcgctcgtcgcgagcttgccggcgatgaccgactcgtccatgtcgtccggac

SEQ ID NO: 41194 - DNA, 407 bp, Zea mays
  Clone ID: LIB3062-025-Q1-K1-C12
gatagagcttagaagttggaagtaataatttcttggttgattgtatccttaaccatttcttgttttttgacacgaggaactcatcatgaatccactaattgctgctgcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttttagtacattggcatttgcttatgtaaa

SEQ ID NO: 41195 - DNA, 425 bp, Zea mays
  Clone ID: LIB3062-025-Q1-K1-C2
cttggaggaacaaatttcttcaaccaagattcctgcccgtctcaagagtggcagcggactatgctcggcctgtgaaaacttcacgagcgaagccgtcacttatctcggcaaggaacagacacaggacaggatcatggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacacagctcttctctccggtgtgggaagtgacagcacgtgtgtgttctgccaccatctgctcgatgaaatcatgtccaaactgaaagatccagatgcggagtttgagataattcagattcttgtcaaggagtgcaataagatcg

SEQ ID NO: 41196 - DNA, 411 bp, Zea mays
  Clone ID: LIB3062-025-Q1-K1-C3
gtttaagccttggtcaaatcacggattaaagatgaggcacctaaatgtcgtgttggtacctcagatatttggcaagacgatgatcacatacactaggagaacaatcttgctagccacccaactatccacatggatgacgactaaaacatgtcttttttcggacttagaagacgatcatttgaaatcacttatttgcaacttgcaaagcgagatatcgacttgtgtacaacaaaatgtatatgtcgacattgctccttaaaagaacacacacaccatcaaaacacgtggctttgttttgcattcaagtatcctgggtgatgccactgttaaagctaccggcctcaacacacagatgttatcactcgacatatggcaaacatattgcatagtgctacatttcactaacattat

SEQ ID NO: 41197 - DNA, 411 bp, Zea mays
  Clone ID: LIB3062-025-Q1-K1-C4
caagcaggctggcgagagatatggatccttcgaccgtgcaaggcaagaccggttcgtccagcgatgggtggacgcgctgacagaccctcgcgtgacccatgaacaccataccatttggatctcctactggtcccagtgtgacgccgctcttggccagaagctggcttctaggctgaacctgaagccgaacatgtaagatcgacgaggaagaaagcaggcaccggtggccaaggttgcaacgcaacatggagcgtgtgatgtttacaccaatataattgaataaacaggggatgtgcgcgtcgtcctacttatgctgatgctgatggtcggtgatcggttatatatactggaacttctggtgtatgctcttctcttctggaaagacgtaatgtaacgaagaagaatgtgtca

SEQ ID NO: 41198 - DNA, 413 bp, Zea mays
  Clone ID: LIB3062-025-Q1-K1-C5
gagatgagctgacccttgagggtgtcaagcagttctatgtgaatgtggacaaggaggactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaacttt

SEQ ID NO: 41199 - DNA, 398 bp, Zea mays
  unsure at all n locations
  Clone ID: LIB3062-025-Q1-K1-C6
ctggattgctcacagataccctgtgcattttttagtggttgaggttaatgttaaggtggagagtgcaggcacacgtaacgtgcacaataatgatttctatgctaaagagaagttgctcaaatcaatgcgtgattgtgatccttcgtctgtgcgccactggattgtaagagttgttttcttgttttaattttttttgttattcctaccattaaattgggcattcaatacctgttcattatccgaatgcttatgcaatccaataatgatggaaaataactgacttggctgctctcttgagttgtggcaacggaagttctaggccccgttgcagcactacactgcgctaatggaccttcagaaatgagaagctattntacaagctccagattgacaatgtc

SEQ ID NO: 41200 - DNA, 302 bp, Zea mays
  Clone ID: LIB3062-025-Q1-K1-C7
ggtacgcgcacaaaatgaaaaagaaaaggcgaaggcaaatgaatcccagtcaggcaagcaaagggaagaaccagctgctggggagtgcggagatatcgtcgcagctgatcgaggagcacctgtccgactcggacgtacacgtctggcacgagctgtgcgagcacacgtaacgcgacttcatggtagacctcgacctccacgacagcctactaacgatgaccagactaggacgacgtgggctacaacccgtcgaccgcgttcgagtggctgcctcataccaacatgactgacccacaccttaa

SEQ ID NO: 41201 - DNA, 381 bp, Zea mays
  unsure at all n locations
  Clone ID: LIB3062-025-Q1-K1-C9
cgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgncagcaccgncgncgacaggcgcgccgnctgcaactgcctcaagaacgccgccaggggcgtcagcggcctcaacgccggcaacgccgncagcatccccttcaagtgcggcgtcagcatcccctacacca

SEQ ID NO: 41202 - DNA, 423 bp, Zea mays
  Clone ID: LIB3062-025-Q1-K1-D1
gactaagagttttacctcagagtgccctcatgttgagaggtatttctggaccatggttaaccaaccaagcttcaaaaaggtcattggtgacgttaagcaggcagaagctgtgccacttgttccacagaaggctgctccagccaaagtgcagaagcctaaggaaaccaaaaaggaggctccgaagcccaaggtaactgagaaatcagcagaagaagaggaggcaccaaagcctaagccaaagaaccctcttgatttgcttcctcctagcaagatgattcttgatgattggaagaggctgtactctaacacgaaaaccaacttccgtgaggttgctattaaaggtttctgggatatgtacgacccagagggctactccctgtggttctgtgactacaagtacaatgatgagaacacagtgtcgtt

SEQ ID NO: 41203 - DNA, 394 bp, Zea mays
  Clone ID: LIB3062-025-Q1-K1-D10
acaacccagcgccggcagtcgccgtcatggatcgatcgccggaaaactaacccctagacgatgtctggatccgtcgggggggacaagaagcccgctgagggcggctcccacatcaaccttaaggtcaagggacaggatggcaatgaagtgttctttcgcataaagaggtccacccagctgaagaagctgatgaacgcttattgtgaccgccagtctgtggacatgaatgccattgcgttcctgtttgatggccgcaagcttcgcggcgagcagacccctgatgagctggaaatggatgactgcgaccagatcgacgccatgcttcaccagacccgaagcagcgttcctagcaccaccctaaaacctcgttttgcttctcctactgcgtggtatt

SEQ ID NO: 41204 - DNA, 407 bp, Zea mays
  Clone ID: LIB3062-025-Q1-K1-D11
gcgcccaggaggctgttcaggagccggtccaggagcaccaccatcatcggcggcggcggcgcggacatctgcgccatggtcgccgagcacgagaggatcgagtgggaggtgcggcccggcgggatgctggtgcagaagcggcgctcgacggaggacgacgcggcggcggccgtggagtacatcctggtgagagtctccaccaccgggtggcagtggcacgacgtctccatcgacgccaccgcaaccttcggcgacctgaaggtgatgctgtcgctggcgaccgggctgtggcccacggagcagaggctgctgtacaagggcaaggagagggacgactgcgagcacctgcacatggtgggggttcaggacagggacaaggtgctgctcctggaggacccggccgtaaa

SEQ ID NO: 41205 - DNA, 420 bp, Zea mays
  Clone ID: LIB3062-025-Q1-K1-B6
cgccgtcctactctcaccccaatgtgctcggactctgatcgcagcggacgcgcatgcaacgagctcggggtctgcctctctcccggggaaaggatggagttcgggaggaagcccttgagccttgtggagctctgcgtgcggaaggccatcgacaacctccgctacatgggcagcgtcgacggcgtcgagatggatctgctcaagcgcatcctgccgcactgcacgatggagcagctcacccgcgtagagaacagcaccgagatggatcttagcttggtaactgatccgctgtggaggcgattctaccagcgagaattcggtcaggagcatacgagcaaagtcatcgcaaggctgaaggagcttgggcaaaaaacgccgtacacatggagggagctcttcgcgggcgaaaaagagaaacag

SEQ ID NO: 41206 - DNA, 404 bp, Zea mays
  Clone ID: LIB3062-025-Q1-K1-A12
aggggatcgagatgcttctaaagtttctgtgaagaaagaggaagcagcaaacattaagatagttgagcttgcaatgcatagatggtctgggcagttcagccggccattcctctttggattattgaatgatgggacattgttgtgttatcacgcatattattttgaaggctcagaaagcaatgtgcaatgtgctcctttctcacctcatggtggttcaccggatattggcaatgccactgattcaagactcagaaatttgagattttgtcgagtttcaatagatatctcatcacgagatgacatatcatggcttgtacgaccaagaataacaattttcaacaatgttggaggttacgagggattatttcttggtggcccaaagccaacctgggtttttggttggg

SEQ ID NO: 41207 - DNA, 365 bp, Zea mays
  unsure at all n locations
  Clone ID: LIB3062-025-Q1-K1-A3
atctcgctttcgatcangattgggttcggttcgtggttctgcggtgcttatctggttactgtttatcggtgcggcgggttcactaccaaattctcttcttcatttacctttatacattgtagccaattttatcattgttcctgcgtggagaaaaatcatgatggtttaaaagcagatggaactggcaaaactccacagaatgaactgacatgtagtgtttgcttagaacaagtcatggtgggtgatctgttgagaagcctaccatgcttgcatcagtttcacgtaaactgcatcgacccatggctgcgccaacaaggtacatgcccaatctgcaagcaccaagtcagtgatgggtggcatgccac

SEQ ID NO: 41208 - DNA, 417 bp, Zea mays
  Clone ID: LIB3062-025-Q1-K1-A4
ctagttctagatcgcgagtaccagcctccgacacccacatatgtttctccgactcgcatctatcacccggccgctgagacagaaatgaagtatgacaagaagcacttctttgatcactttcacaaggaccatgactaccaccacttctttgaccacttccacaagaagcctgtgccacccaagccaaaaccagagccagagccaaagccaaagccacaacctaagccagagtacaagccccccatgcccacatacgggtctccaactcctatctaccatcctccagccaagaaagaagtggcatttgacaagaagcacttccttgatcacttccacaaagaccatgactaccaccacttctttgaccacttccacaagaagcctgtgccaccaaagcctaagccggagcccaagcca

SEQ ID NO: 41209 - DNA, 430 bp, Zea mays
  Clone ID: LIB3062-025-Q1-K1-A5
gctgtcacagcgtggctgaccagcagatccgtcgttggcggaacccacgctcgccggctgcgaatgcatgtgtaggctgctctgcgtcggcacggacaattggacgagctagactctgcgtcgccggcgatggggtgctccttctcagggctgaacgcactgtacgacaccgtcggcggtcggggtggtgacgtctgggttaacgactaccacttccgcgtgctccgcaggctcggcgatgccggccctgcgggctcgtcggtcttcctcgtcaaggaggtcgtcgccgccgcaaccgcctccgacggcacggctgggtcagagcccggcgcctcagggatcgccgggaagaaaggcatcgacccatcacacatctcagctgacgggacatatgctctcaagaaagttcttgttcagagtgatcagcact

SEQ ID NO: 41210 - DNA, 421 bp, Zea mays
  Clone ID: LIB3062-025-Q1-K1-A6
aaaaatgaagctaggttctgcatgttactttgtgatgtccagaagaatatgtcaagggaaccagaaaagagaaggggctatgaaatgttcttcttgagtagtctccttgtggcaccaaatagattccgcccatcaactagctctagtcttggaattatggaacatcctcaaagtgttctgctaagtaaagtgcaagaatccaatcttgcgctacaacattacaatgcatcttctaaccatatggatgttcttcaaagatggatggatctacaacggagtgtaaatgtgctatatgatagtagcaaaggccttgcaagaagcgagaagaatgctcatggtatacgccagctattggaaaagaaagaaggaattcttcgacaaaagatgatggggaagagggttaattatgcatgccgatctg

SEQ ID NO: 41211 - DNA, 371 bp, Zea mays
  Clone ID: LIB3062-025-Q1-K1-A7
cgaattcccggtcggccccgcgtccggtatctcgctttcgatcaggattgtggtcggtgcgtcgttctgcggtgcttatcgtggtttcggtttatcggtgcggggggttcacggtcaaattcgctgctgcgtggcgcttttgacattgtagccaattttatcattgctcctgcgtggagacaaagccggatggtctaaaagctgatggaactggctaaactccacagaatgtactgacatgtactgatggcttacaaccagtcatggcggctgatctgttgagaagactaccatgcttgcatcacgttcacgtgaactgcatctacaccatggctgcaccaacagggtccatgcccaatctgcacgcacca

SEQ ID NO: 41212 - DNA, 419 bp, Zea mays
  Clone ID: LIB3062-025-Q1-K1-A8
ttcttctctctctgctcctccgcgtccgcctgatccatccaagacagggatcgccgtgtcggactcggaggaggaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcggcatagacatattcaatgggaaaaaagcttgagatattgttccttcatcacacaactgtgacattccgcatgtgaaccgtactgagtatcagctgattgatatttctgaggatggatttgtgagccttcttacttcagatggcaacactaaggatgatcttagactcccaactgatg

SEQ ID NO: 41213 - DNA, 377 bp, Zea mays
  Clone ID: LIB3062-025-Q1-K1-A9
gttgcatcccacagtctcatgcgcatgtttacttacagaagttcatgaaaagacacgtgcacttgtaagttgtaaccaccttgaagaagctaaagtaaaacaacatgtgttttctctaattacaacacattatgttctatcattttattgtaaccttcacattttctgattttgaaaacctggtaaatgcgtcaaccatcaaactgtaaatttactaatcccagtccatgtatagtgatgccattatttcgtgtcaacctaagttatgagtactgtgaacagatgaattcatttgcctgatgtgtttctgcaagctgcatttggaatgctactggttgctagatgaaaacccttgtttatgcactaatggctgctgt

SEQ ID NO: 41214 - DNA, 422 bp, Zea mays
  Clone ID: LIB3062-025-Q1-K1-B1
gaagaagacgagtgtcaagtgaacctgaaacttgcggtgtcactggctggtagcgtgagtgtgagtgagtgatcgagctagctgagctccgatcctcgctagctaggataccgccataccacaagtcttcttcacaagtttaggagtgacagcaacaagagatcgatggcctctgccaccgtgctcaagtcctacttccttcccaagaagtccgaatggggcgccaccaggcaggccgccgcgcccaggccgaccaccgtctccatggtcgtccgcgcctccgactacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggca

SEQ ID NO: 41215 - DNA, 347 bp, Zea mays
  Clone ID: LIB3062-025-Q1-K1-B10
gtgaccttgggtccgctctgcatgcagtatgggaggatgaccgtgccatccaggagtttcagacagcaattgatcgtaaacctggccatgttgatgccttatataatcttggtggattgaacatggacgcaggtcgttttgtacgggctgcggagatgtatactcgtgtgctgagcatccgaccaaaccattggcgtgcacagctaaacaaggcagtggctttgcttgggcagggtgagtctgaggaggccaagaaggcactcaaggatgcgtttaagatgacacaaaaggtggaagtgtatgatgctatctcacatttgaagacattgcaaaagaagaagccaaag

SEQ ID NO: 41216 - DNA, 249 bp, Zea mays
  Clone ID: LIB3062-025-Q1-K1-B11
gcggggagacatgccgcaacattggtttcgtgtcgaacgatgtcgggcttgacgctgaccactgcaaggtgcttgtgaacattgagcagcagtcccctgatattgctcaaggtgtgcacggccacttcaccaagcgccccgaggagattggagctggtgaccaggggcacatgtttgggtatgcgactgacgagacccctgagctgatgcccctcagccatgtccttgccaccaagcttggtgctcgtc

SEQ ID NO: 41217 - DNA, 358 bp, Zea mays
  Clone ID: LIB3062-025-Q1-K1-B12
gtaaatggtcgaccaacaaagttacacatggattccacctggtggaaggcaagtccggccatgacatggaagactaccatgtggcagagtacaagtatgtgaagaatcatgagcttggtctctttgccatttttgatggccatttaggagataaggtgccaagttacttgaaagctaacctttttagcaacataatgaaagagcctctcttctggtctagccctcaagaagcaataaagaatgcatactgctctacaaacaagtatattctagaaaataccaaacaacttggaccaggtggttcgacagcagttactgctattggagttgatggtaaggacatgtggatagcaaatgt

SEQ ID NO: 41218 - DNA, 401 bp, Zea mays
  Clone ID: LIB3062-025-Q1-K1-B2
cccaacatcacaacccaatcttctagctctctcatcccaactcactctcatggaacgttctcctattctagctatctacctatcaaagcatcaattctcgcaacaaacccaccaccctaccacaactcttctttccaaacgccatagacaacctaacctacaatcccaaccctaacccaccctacaaaaatcctctttaactcatcctatcctactacactactcaacaactcaccccactagacaacagcacccaaatgtatcttatcttagtaactcatccgcttacgaagctattctaccatccacaattcaatcaatagcataccatcaaaatcatctcatggctaaactaacttagaccaaaaactccatacacatcgaatcaactcttctcctcg

SEQ ID NO: 41219 - DNA, 321 bp, Zea mays
  Clone ID: LIB3062-025-Q1-K1-B3
caacaacaccattttaaagtaaagcttaaactctcggatccactacctcgtacatgttacctgaataagtgatcaatctatctcacctaaaatcctcactacctaagatacccccataccacaattcatcttcacaaccataagaccaacaacaacatcagatccatggcctatgccaacgtcctcaagacctatttccttaccaacatcctccaatactgcaccaccaaacagctcacccgtctcaagaacaccaccgacatcaatcttatcctcgccaccgactacgtctataagctattctacaccccaaaatccatc

SEQ ID NO: 41220 - DNA, 408 bp, Zea mays
  Clone ID: LIB3062-025-Q1-K1-B4
acatcatatacataacggacaatgatatgcaccgatcatgctaaatcttaggcctggcaatgcttctaggcggatatgtgtacacaatgcccacttacaacggctctaacatcaacctcatagtcaccgaactagctgacaaatatcagttctcccacataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggaagcagcgttcctagcaccacctaaaagcctcgttttgctctccgtcctgcgtagtagtaaacaaaagggaaaa

SEQ ID NO: 41221 - DNA, 424 bp, Zea mays
  Clone ID: LIB3062-025-Q1-K1-B5
cgcccgagcatgaaagtcctgtggggttcgttcgaggcggcggcggcagcggcggtggcgtgcgaggtgaccgacagcctgcgcgcgttcgagatgtcgatgaacacgtgggcggagtggctggagcgccacgtcgaccgcgcccgcaccgggctcttcttcacgagcatttcgccgacgcacctgcactccgacgagtgggaggaggcggccgggtccgggagcggcgccggctaccaccgatgctacggcgaaatggagccgatcacggcggatgggcaccgtgggcgggacacggacccggcgttcgcgcgcgcggtggatgcgcatgtggcgcggctgggcgcgcgcggcgtcgccgtgcgggtgctcaacgtgacgcagctgtctgagcaccgcaaggacgcgcacccgtacgtgcacc

SEQ ID NO: 41222 - DNA, 156 bp, Zea mays
  Clone ID: LIB3062-024-Q1-K1-F7
cggtctcggattcccggcgcagacattcttcaatatcctgaagagtcgtggagagaagttattgcgatatcctccactagttgcagtggatctgtctcctccaccagctagaagagaaagaatttctttgctgcttgagctcatagatacctacaa

SEQ ID NO: 41223 - DNA, 448 bp, Zea mays
  unsure at all n locations
  Clone ID: LIB3062-024-Q1-K1-F9
aatgtttacatgcagttctcatctcaccaagagcttaccacagaccagagctcgcatggaaggaattctgatcaggagtctgaacccaaccgaatcctcttagttactatccaccacatgatctatcctataacggtggaggttctacatcaagtattcaaagcttatggatttgtggagaagattgtcacatttcaaaagtcagctggttttcaagctcttattcagtttcactcgcgccaagaagctgtggaagcatttggttctttgcatggaaggaacatatatgatggttgctgccagctagatattcaatattcaaatctcagtgaactgcaagtccattacaacaacgaccgatctagagatttcacanatccatcattacctacagaacaacgccctatggcctcttagcaagcttatcctgatccagctaatctctatg

SEQ ID NO: 41224 - DNA, 444 bp, Zea mays
  Clone ID: LIB3062-024-Q1-K1-G10
attcagtttgttcagccaaatttatcgctcaagggaaatggctggtagtgggaaatagtgatggatacatatatgtctacacttacactgacactaagcttaaggaggccaagaaattcagagctcatgacaactctgtcgacgtgttggctgtccacccaaccgaggcgtaccttctttcatcatctgcttatggcaaaacaataaagctttggagctggggcagtgactcgatcatgaactgggtgcaaattaaaacatttaacgtgaaacctacatatccggatggagtgcgcagtctcaggtttaacccaagggacaccaacacttttgcttgtgttacgtatgaagatagagtaaaggtcggggacataaaaaatccttctggtcttaccaccatactgaaggggccattgaaagctgattattgcttctctcatactc

SEQ ID NO: 41225 - DNA, 437 bp, Zea mays
  unsure at all n locations
  Clone ID: LIB3062-024-Q1-K1-G11
cgggggccaaggtggagaacaacaggttctgcgtctccgtccacttcagacgcgtcgacgaggaagatgtggggcgagctgtcagagtcggtgaggggcgtgctgcgggggtacccgaggctgcggctgacgcacgggcggatggtgctggaggtgcggcccaccatcaagtgggacaagggcaaggccctggagttcctgctcgagtcgctcggcttcgcggactgcagcagcgtgctgcccgtgtacatcggcgacgaccgcaccgacgaggacgccttcaaggtcctgcggcgccgcggccaggaccagggcgtcggcatcctcgtgtccaagcaccccaaggagacgagcgcctnctactcgctccaagggcccgccgaggtgatggagttcttgctgcggctcgtcgagtggaagcgcctctccagggcaag

SEQ ID NO: 41226 - DNA, 441 bp, Zea mays
  Clone ID: LIB3062-024-Q1-K1-G12
aggtacttcgcgatcctactgaagtattccccgccgccgctgccatggccaccctgaaccctgtcgaactcctcggcgccgacgacaacgacgacccgtcgctgttgattgcggcggcggcggctgctgctcagaaggccaaggcaaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggcacaaccgcggcttcagaggtgacaatggccatgagttccaaggaggttatggtggccgatgctatggggatggtgctgtaactggtggatctgaaagaaaaagggagagagacac

SEQ ID NO: 41227 - DNA, 196 bp, Zea mays
  Clone ID: LIB3062-024-Q1-K1-G2
aaaagacaggctacaaggatgatgagggaactgcaaatgagctctcttttcagatgtggacgaatcatatgcaagatacgttgaactcaaaaaagaaaggtgacaatgcttttcgacagaaggattttactgctgccattgattgctattcccagtttattgaaagtgggacaatggtttccccaaccatttatgc

SEQ ID NO: 41228 - DNA, 315 bp, Zea mays
  Clone ID: LIB3062-024-Q1-K1-G3
gttgtggttgtggtcaccccgactagatattttccttctgtggtgtatgattgctatggcgggcccgcgctcgagcggtgtgcggctcatctcagctgcgggggccctacttgggtgggtgtgccgtgtgcggtggtggtgagtggtgactttctagtccttgtgcgggccattcgcccgtgtctagtggctcctctatgagtatgccagatgtccttagattccggcgcatgtagccgagctcggcggagactccgatgccactgtcgtgaactaaattaccaagggttgttcgatcgaagaatgcaattagca

SEQ ID NO: 41229 - DNA, 245 bp, Zea mays
  Clone ID: LIB3062-024-Q1-K1-G4
gccagtaccgagtcctacgagcagtcgcacgcaagtgtcaagagacgaaacggtcgacatggctcgcacgcaaatcttgccgtagcggtcggcctgggtggccgcgtgctgcttctggcaacggccgggacgaccttcgaaggccgccataacttgcggccaggtgagctccgccatcgcgccctgcctttcctacgcccgcggcacggggtccggcccctccgcgtcctgctgtaacggcgtca

SEQ ID NO: 41230 - DNA, 188 bp, Zea mays
  Clone ID: LIB3062-024-Q1-K1-G5
acttgcagtggggctggagctggttggagcgctggatggcagcaaaaccttgggagggacgcaatgggaccgacaaggagagcaacattgatcgcggctccgtcaagaatatgagcttgaaccttggagttggaaagggtgagatcacaaaagcttataaccgccgggactcaaagccagagaagcca

SEQ ID NO: 41231 - DNA, 159 bp, Zea mays
  Clone ID: LIB3062-024-Q1-K1-G7
ggcttttgagagtgtttgcgtgaaaatgattgctgccggtgccgaacatactggtgcagtaactgaatacggtgacctctacggatggggttggggtcgatatgggaaacttaaggcttggtgaccgtaatgaccgtttgcttcctgaaaaagtatatt

SEQ ID NO: 41232 - DNA, 239 bp, Zea mays
  Clone ID: LIB3062-024-Q1-K1-G8
cccgtagcggcacggcatggcggccactgcgtactccgtggcgctcctcggcggcgcacgcctgccagccgacctcctccctcggcgcagcagcgtgtgccaccaccagcttcgcctccaagacgcaccgaggctctccctgcaccgtgccagggccgcttccgaggacacttcggcctccggcggcgacgagctcatcgaagacctcaaggcaaagtgggacgccgttgaggacaagc

SEQ ID NO: 41233 - DNA, 463 bp, Zea mays
  Clone ID: LIB3062-024-Q1-K1-G9
tctggccttccatcacatacacataggtttgaatcggagttagtcgaagtagatctggaaaaggatccccaaatccatgttggtcccctcaaatataaaactgaggagcgtcatcaaaagcaggaactgaccccagcaccagtttttccgcttattgttggagtttctgtggttgcactggtgatcagtatgccaaggttaaatgacttataccagagcgctgtagggatgacttctctgggttcagggatggcaccgaccaaaaaggagccacgcaagaatatattaagaaagagagtgtaaatggcatattagcttagccttaggggtcgagaaatgagacatgacaaattgagcaatttcaacagtggaatagcttctggtttccccctcgggtaattttgccgacgaaaaggaatgccagttttgttgtacgatagcactatgcacagtttttgaagcc

SEQ ID NO: 41234 - DNA, 421 bp, Zea mays
  unsure at all n locations
  Clone ID: LIB3062-024-Q1-K1-H12
ggtctggtgccaattgttgagcctgagatccttgttgatggccctcatgacattgatcgcgggcgcttacgtcactgagaccgtccttgctgcctgctacaaggcgctcaacgagcaccatgtcctcctggagggtaccctcctgaagcccaacatggtgactccaggctccgactccaagaaggtgactcctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgnngctgcaaggtggagaacttggag

SEQ ID NO: 41235 - DNA, 237 bp, Zea mays
  Clone ID: LIB3062-024-Q1-K1-H3
gaggtcctgcaggagcttcgcgggcctcctcgccgccgaccccaaggtcttcgacaccctcaacggcaccagggacaccgcgctcaccgtattctgccccgtcgacgcggcggtggccgccttcatgcccaagttcaagaacctcacggccaaggccaagacggccatcctgctgtaccacgccgtgccggactactactccatgcagttcctcaagtccaacaagggcaaggaaaa

SEQ ID NO: 41236 - DNA, 222 bp, Zea mays
  unsure at all n locations
  Clone ID: LIB3062-024-Q1-K1-H4
ccagcaccgncgncgacaggcgcgccgccatcacctgcgggcaggtgagctccgccatcgcgccctgcctctcctacgcccgcggcacggggtccggcccctccgcgtcctgctgtagcggcgtcaggaacctcaagagcgccgncagcaccgncgncgacaggcgcgccgnctgcaactgcctcaagaacgccgccaggggcgtcagcggccttaacgccg

SEQ ID NO: 41237 - DNA, 255 bp, Zea mays
  Clone ID: LIB3062-024-Q1-K1-F6
gctggaagctccagttgttgttgttacaggtgcatctagagggattggtaaggcaactgctctagcccttggaaaagcaggatgcaaggttctggtaaactatgcccggtcctcgaaagaggctgaagaggtctccaaagagattgaagcatctggtggtgaggctatcaccttcggaggaaatgtttcaaaagaagctgatgtagagtctatgatgaaagcagctctagataaatggggaacaatagatgtgct

SEQ ID NO: 41238 - DNA, 342 bp, Zea mays
  Clone ID: LIB3062-024-Q1-K1-H5
gattcccggtcgcccacctccgagcgatggtgcggcgcgattcacgactgattcacagggcttcttccgacgcggctggctccatcttcaccagcaagcttttctataatgcagacgagagcacttcatcctgcgattaaatcagcactagtgttgcacaatggtacctattgcgtttgtcgtagcagctttattgggcatatcaggatatgcaggacaaggaagtggtgttagtgatgctagttcaaagaaggcacaaaagctcaagctctaaatgcatgagaggaagctgctttaaactagctatttaaatcatagttgttttagcaaatctagacggtt

SEQ ID NO: 41239 - DNA, 219 bp, Zea mays
  Clone ID: LIB3062-024-Q1-K1-H7
attccgggtcgaccagcgtccgagaagttgaaagttggatttggttcatgtcccaattaaagaagctgttggggaacatggagtactcgctatttgttcagacgcttaaaaaggattaatgcatgcagtgacacattgtttcccttatgctgagaagagggagtgcttccgacatctcatgggcaactatgtcaaaagctactcaggttccgaacacat

SEQ ID NO: 41240 - DNA, 445 bp, Zea mays
  Clone ID: LIB3062-024-Q1-K1-H9
gagcaaatgcaccttgtgtctcagcatccggcaaaatcctactgccacaacctgtggacatgttttctgctggtaaaagttgttttttacaatgatcatgtattgagtcttgacagatataaattttacacttgagccatcaacagtagtgatgaacctgccatcctggcttacttctgcactagtgacagaagccttggtttcaagagtttggacaatttttccaattctcacatcccatagcctgcacagtaccgtaaaaattaattaaaaaggaacataactatagtaaatatataggccaaccagtataaatgtttatcattgattgaagcatttctaacatgcacacaccttactccacccatgtcagtgcaggaactcaatatagtttggtcactatgaagccaaggagcagttcggacaaccaggtgctttgtcaagc

SEQ ID NO: 41241 - DNA, 296 bp, Zea mays
  Clone ID: LIB3062-025-Q1-K1-A10
caacagaagagcggcggctcgtattgaggatgagcaggccgaggacgagttgtgccaaaggtcaatgggtatctcgggtgactcgatgcacaatcagccgatccaccggtggaaagcataaagcctggaggaagaaacgaaagtattagcttggtcgtcagccaaccaacaccaagttgtcaagcaataagacagttaggaaggtccgtgttcgtggaggtaatgtgaaatggatggctcttcgccttgatactggtaactactcatggagaagtgaagctgttaccctcaagacc

SEQ ID NO: 41242 - DNA, 445 bp, Zea mays
  unsure at all n locations
  Clone ID: LIB3062-008-Q1-K1-G3
ctaactacccccgcgctggctcgccaccaccgccgcagcaggcgtgggaatctgggcagcgccccgcggagaagaggangcagcgcgctctccgtccgccatggcgggctcttccgaccccgaccagctcatgagcaaagccgacaaactaacaaaattgagttttacaagatggaatgctgattggaaaagcgctacctncttgtatgagcaagctgcaattgcgtataggttcagaaaggacaatgagaaagcaaaagatgcttttgagaaagcctcaaaaggacaggaaatgatctcctcaccatgggacgctgctaagcatatggaatctgctgctgctttagcaaaagagcttgggcgctggaatgaagtatctgaattctatcacagagcttcagaattataccgtgaatgtggaaggccacaacctgcatctgatgct

SEQ ID NO: 41243 - DNA, 395 bp, Zea mays
  Clone ID: LIB3062-008-Q1-K1-G6
ctcagaaggtttgcaactgagcacaagtttatgtcagcggacgtgatccggaaagcttggcaagcgactgaggagggctttctttctctagtcagcaaggaatggtctttgaagcctcagattgcttcagtgggctcctgctgccttgttggtgtaatctgggctgggactctctatgttgcaaacctgggtgaactaagtgccgttcttggaaaggctggtaaagcaacttgaaaagtcctgggccttccaattgtaattgggcccaaatgcctcctttggggaagttagacaagaactggaatcatcaaatccggccaatcccaattttggggttctaaaacccaatgtttggcaagtgaagggcctaatccaaatcttaagatctattggaa

SEQ ID NO: 41244 - DNA, 432 bp, Zea mays
  unsure at all n locations
  Clone ID: LIB3062-008-Q1-K1-G7
cttcatccgcacaagctttgtcaaggtctcccctgatcggatcattttcacggtcactgtcatgggaggatcccccgctggaagtcatgtcgccgaattcgttgagactctcaaggcttttctcgaaggctgatgaagatctagattcactgacgtttatccagaagctggtccactctcgaggcacgggtcgagaaagttgcatattagctgaccctttggacccgagtttgctcgagaagatttcggattacgaagaagatggaattaagtttgggaaaaggcggcccaaacagaggctccttttcgacgccgtanacgaagcgctcatcgaacttgcttcgattgcgggacctgctgcgtacccctgggtagatcatgctcttcgaacacggggatgcaggaacggttcagcagtaattctgcggctga

SEQ ID NO: 41245 - DNA, 353 bp, Zea mays
  Clone ID: LIB3062-008-Q1-K1-G9
ctcgactcctctgttaaaaagggttatgctaatgacaagtcaaacataaccctttttgacagaggagtcgaggacattaatacaacacaatgcggcacaaatatatccttctatagaaaaaaacctaatctatagttttcaggcaccatgtcactcatgtctccattcccaaggatggatctaagtaaaatggatcccgcgactctgaccctccttggggcagctggttgtgtaatgctgactatgcatttcactgtgcaattggtgtcacaacatctcttctattggaaaaaccccaaggagcagaaagctagactaattattgtgctaatggcctcactatatattatctc

SEQ ID NO: 41246 - DNA, 318 bp, Zea mays
  Clone ID: LIB3062-008-Q1-K1-H1
ttcatcgccacaagctttgtcaatttctccccttatcagatcattatcacggtcactggctatgtgaatccctctctggaagtcatgtggccgaattcgttgagactctcaaggcttttctcgaacgctgattaagatctatattcactgacgtttatccacaagctgttccactctctaggcacggctctagaaagttgcatattacctgaccctttggacccgagtttgctcgagaagatttctgattacaaacaatatgtaattaagtttgtgaaaaggcgctccaaacagatgctccttttcgaccccttaaac

SEQ ID NO: 41247 - DNA, 394 bp, Zea mays
  unsure at all n locations
  Clone ID: LIB3062-008-Q1-K1-H11
cggacgcgtgggcggacgcgtgggcggacgcgtgggcggacgcgtgggcaaaatctgatctttagatggatcaagttgattttgagcctgcccaacaatggagtgctacaagactggaagctgatgaacatccctcaacagtgaagtctgcaataggggatctctgtaaacaaccgatcctcatcagagctgggggaggaatatacaattacctttatcagctaagatcatcatctgatgaagctggtcaaacaaagtctgagggaagcagtatacttggtaaatttcagataacatggcgtacgaacctgngtgaaccaggccgtttgcagactcagaacattcatagcactgttagtgacattcctgcttttgatttaagtatnctatgttc

SEQ ID NO: 41248 - DNA, 162 bp, Zea mays
  Clone ID: LIB3062-008-Q1-K1-H4
tcccacgcgtccggcgaagtttccctcaggatagctggagcccacacgagttctatcgggtaaagccaatgatttgaggcaattaagggcaactcttatgtcattgttgcttgcttctgtggagtccaacagatgtttcgctaacataattcgacttgagtg

SEQ ID NO: 41249 - DNA, 111 bp, Zea mays
  Clone ID: LIB3062-008-Q1-K1-H5
ttcatcggcacaagctttgccaatttctcccctgatcggatcattttcacggacacttgcatattgggatccctcgctggaagtcatgtcgccgaattcgttgagactctc

SEQ ID NO: 41250 - DNA, 384 bp, Zea mays
  Clone ID: LIB3062-008-Q1-K1-H6
ggcggtaggcttgaccacaacgaggtttactgcggatcttgttatggtgctgaggagtcggatgagcggtgttgcaactcctgtgaagaagttcgtgatgcgtatcgaaagaaagggtgggctgtcaacaacgtagaattaattgatcagtgcaagagggagggctatgtacaaaggttaaaagatgaacaaggggaaggttgtaccatccatggatttgtaaatgtgaataaagtagctggcaactttcactttgcccccgggaaaagcttggaccagtcattcaacttcctgcaggacctgttgaaccttcaaccagaaacttacaatgcaaataagccacaagataaataagctgtcctttggggaagagttcccaggtgt

SEQ ID NO: 41251 - DNA, 442 bp, Zea mays
  unsure at all n locations
  Clone ID: LIB3062-008-Q1-K1-H7
tcggcaagttggtgagatggatctgttgaaccggatttttaaaacggaaacgggggagacgcgcaaggaggaggagcgtaaggaggaggtggaggcggaggcggnggagaggaagacccaggagccgncgcagcaaggccagggcctcagcctctcactcgccaacggcagtggcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcact

SEQ ID NO: 41252 - DNA, 365 bp, Zea mays
  Clone ID: LIB3062-008-Q1-K1-H9
gctggtagtacccattctcagctgtgttgctactctgtacaaggtaagatttttgtagttttatgtcaatgtccttggattacgtgctggtagtacccattctcagctgtgttttgcaattgtgagcatcggaatacaactatctagatgcattacgtgttaaatgccttggatttgttcatgtcatctatataaaaacatgtttcatgtttagcttatcatagtttatagttgagactgtaatactcatctctcacttgttttctgtcaaggtggtgcaacaaataccaattaatctggatgtttatggcttttctggtaaatatgggttgacagaaattatagcttctggcttgagctgggtg

SEQ ID NO: 41253 - DNA, 383 bp, Zea mays
  Clone ID: LIB3062-009-Q1-K1-A1
caggtttatattcgaaacagataaacataatggtgttgcagagttgttggagatcctgggcagtattatcaatgggtttgcccttccgcttaaggaagagcacaaattattccttgttcgtgcattgatccctcttcacaagccaaaatgtgtatctatgtaccatcagcagctatcatattgcatcacacagtttgttgagaaggattgcaaacttgctgacacagttattagaggcttacttaaatattggcctgtgacaaacagctcaaaggaggtgatgttcttgggtgagttagaagaggttttagaggcaacacagcttgcagagttccaaagatgcatggttccactcttccgtcagattgcccgtagcatgaaca

SEQ ID NO: 41254 - DNA, 312 bp, Zea mays
  Clone ID: LIB3062-009-Q1-K1-A10
cgaccggctgcatcacttaccaagagcttggaacggtgaagcgctcccttggccagaaccctaccgaggcagagctgcacgacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatccgtg

SEQ ID NO: 41255 - DNA, 352 bp, Zea mays
  Clone ID: LIB3062-009-Q1-K1-A12
tgctgttgttgaagtcaaaattatgggaaagcttcaagatggcgcggtgtttacaaagaaagggcatgacgaagaaccatttaaattcaagaacgatgaagaggaaattattgccggtcttgatcgtgctgtgttgaacatgaagaagggcgaagttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggcttctggtaagaagaaagaagaaaggaatgca

SEQ ID NO: 41256 - DNA, 428 bp, Zea mays
  Clone ID: LIB3062-009-Q1-K1-A2
ctcacctgaacttaaagctaatcattccatacaacaaattgttgaagttatttcagatgatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcaagagccccataatggctgccacagatgtggcagcacgtggtcttgatgtgaaggacataaagtgtgtgataaattatgattttccaacaactcttgaagattatattcacaggataggtcgaactggccgtgctggtgctagcggaactgcatttacttttttcacacacg

SEQ ID NO: 41257 - DNA, 336 bp, Zea mays
  Clone ID: LIB3062-009-Q1-K1-A3
acgcggacgcgtggccaaagccgtcgccttctaatccatcctttcttagcaacgtcagttggctgggatcacttaaacattggtaaaggctgttgctgtgctgggtagcagcagatcgtggtcaagggcaccatctttttcacccaagtgggagatggccctaccactgtcaccggaagtgtctctggcctcaagcctggcctgcatgggtatcatgtgcatgctcttggtgacactaccaatggctgcatgtcaactggaccacactacaatcctgctagcacggaacatggagcaccagaagatgataaccgccatgccggtgatcttggaaat

SEQ ID NO: 41258 - DNA, 437 bp, Zea mays
  Clone ID: LIB3062-008-Q1-K1-E5
gagaagcgaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgatgaatcggtggggcaacaaattcctattgctttcatggatagggttaaggaggatttcacacaaaggtatggtggcgggaaagctgctac

SEQ ID NO: 41259 - DNA, 368 bp, Zea mays
  Clone ID: LIB3062-008-Q1-K1-E8
cggacgcgtggggcgaacggggcgacctccaggaaaatcgcagagaatgagggggatcctcttcgggccccggcggcagccgccgccgctcccgctcttccccgccgccaagcgctcctcggcacccgcgaaccttcttttcgctcgcctctatcgcttcctcccggccagccccatcctccggctccttctcctcctcgcactcctctccctcatcccgccggccttcttccacctcccgcttcgctgcttccaccaaatgcccgagaagaagtgcgggtggatcgcgaggccacccatggtgtgcgcgcaccggggtgacttcaccaacgcctttcccaattcgatggacccatttcggatggctc

SEQ ID NO: 41260 - DNA, 338 bp, Zea mays
  Clone ID: LIB3062-008-Q1-K1-E9
atacaaacaacaggtttaccacacacaaaacatggatacatcacatgcatgtagcattatgcatgccgcaagaacatcaccaccgcaccaccgctagctacaaccagtcacaaacggctaaataaattaaacaccaagtctccacaaacagatactgacctaatagtaaagcatacaccaccaaatgaaacagatccaactctccaatgcaggcaggtaattaaactaaaaagcagtagaacacaagctatatatatagctagctagacgtacggtacgtgcaaggcccaactactgctcgtatggagctaggggaaaccacgaaccacgcatgcatg

SEQ ID NO: 41261 - DNA, 434 bp, Zea mays
  unsure at all n locations
  Clone ID: LIB3062-008-Q1-K1-F1
cagcacagtcatccacactaacgaacgaactcttgctccgatcacgagctagctgaagtcgaccatggcngctgggcttaacagcaagaagacccccgaagccgtggtggccgtgcttgtggcggccgcgctgctggcttcgtccgcttcggcggcgatcacctgcgggcaggtggggtcgtcgcttgcgccgtgcattccgtacgcgacggggaaggccagcgcgctccccgcgtcgtgctgcagcggcgtcaaaagcctcaacaaggccgcgccgaccagcgcggaccgncaggcggcgtgccgctgcctaaagagcctggccaacagcgtcaagagcgtcaacatgggcaccgtcgccaccatccccggcaagtgcggcgtctccgtcggattccccatcagcatgtncaccgactgcaacangatcagct

SEQ ID NO: 41262 - DNA, 379 bp, Zea mays
  Clone ID: LIB3062-008-Q1-K1-F10
gtccctcttgagaacttcaaattacctgttcttgatgcttccttctttgtaaaggaaagtagtggtgatgagcctcttggatccagggccgctaccatagcagaaaggaatgccaaggcagagctaaatgtgtctatcgacaacttgatttcaaaaataaaagtgaaatggcactccgggagaaatagctcaggcgagctgaatattaaagatgctatcctggcagcaatacaggcatctataattgacatattgttgccagatcccctgacgtttagctttaagcttgctaagaatggaactgttaacaatgttgattcttcaaaggattctggcgatgccctgaggtgcaaagatcctatatctgctcatgaaatga

SEQ ID NO: 41263 - DNA, 443 bp, Zea mays
  Clone ID: LIB3062-008-Q1-K1-F2
gtgggtgagcggatcgagatggcggcgtcggatgttgagtaccgctgcttcgtcggcggcctcgcgtggggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggcggcgggtacggtggtggccgtggaagcggcggctacggcggtggcgggcgccgtcgttgcgagctccccatcttccttcgttaaccatggcgacccagatcagcaagaagaagaagttcgtcagcgacggcgtgttcta

SEQ ID NO: 41264 - DNA, 439 bp, Zea mays
  Clone ID: LIB3062-008-Q1-K1-F3
actgacgagagggggagagagagaggcgaggaaggaggaaaaaaccccggggctttatccaaaatggattccggggccaaagttgttaaaaaaggccgcgccgggccttcccggcggggccggccccaaaaaaaacccgtcttttgcttcctgaaaggccgccttcaatttcccctaaggccgtattgggccgctacttaaaccagggtgctactcccacctttcgcaaccggggcccccgtctacctcgctgccgtccttcaatacctcgccgccgagctcctcgagttgccggggaacgcagcgcgggacaacaagaagaaccggatcatcccgcgacacgtactgctggcgatccgcaacgatgaggagctcgggaagctactggccggcgtcaccatcgcacacggccgggttctgcccaacatcaaccctgtgc

SEQ ID NO: 41265 - DNA, 437 bp, Zea mays
  Clone ID: LIB3062-008-Q1-K1-F5
gaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcggcgattacctgatcgagcagggcttctaaaagttcgtcatgttctgttttggtcatttgggcaccaaagtttgcgcctcatttggttctgtaatccgtgagctcgtgcatgtacttggcgtattgcatgcagtgaataatttagcttgggtttgtttgttgggggcagtgttggggacggatttggattggggtttatgcttggcatcgcgtcgtatcgaaactcagctgctgtt

SEQ ID NO: 41266 - DNA, 393 bp, Zea mays
  Clone ID: LIB3062-008-Q1-K1-F6
gttttcatgttacatcaatgacaactgcaggaagccgctggggtgtagttatgtcaaggaactctggatactctgaacaggtagtggagttggattttctttatcctagtgaaggtattcaccgacgatgggagaacggatatagaataacttctacagcagctactggcgatcaagctgctttcatattgagtatacctaaaagaaagttaatggatgagacacaagaaactcttagaacatctgcttttccaagcaaccatgtgaaggagaaatgggccaagaacctttacattgcttcaatatgctatggccggacagtgtcatgaggcttgctcggctgcatccctagttggggaagaacatgttctgatgaagttttttttggaaaaa

SEQ ID NO: 41267 - DNA, 310 bp, Zea mays
  Clone ID: LIB3062-008-Q1-K1-F7
gttttcaggtacatcaatgacaacttcaggatttcgctggtgtgtagttatgtcaagggactattgatactattaacaggttgtgaagttggattttctttatcctagtgaatgtattcaccgacgatgggagaacggatatagaataacttctacagcagctactgtcaatcaaactgctttcatatagagtatacctaacataaaattaatggatgatacacaagaaactcttagaacatctgcttttccaatcaaccatttcaatgagaaattgcccaataacctttacattgcttcaatatgctat

SEQ ID NO: 41268 - DNA, 289 bp, Zea mays
  unsure at all n locations
  Clone ID: LIB3062-008-Q1-K1-F8
gttttgtcatgcatgtgctgcgttcgcataggacgggaagctggtggctgcagtcggcgccagtggtggcggcatgatccccgccggaacgatcgaggtgttcatcaaccatttcgtcaagaacatggacccgttggcttcggtcatggcgccaagggtgtatcaccagctgatcccaaacgaggtcaggtacgagaactggacgacggtgaccggcgaccacttcgagctcgacgccgncacgagggccgacctgcacaggagaggccacgtcctgacgccgatagct

SEQ ID NO: 41269 - DNA, 304 bp, Zea mays
  Clone ID: LIB3062-008-Q1-K1-G1
atttaatactatttatataaagttttaaatatacgatgaaataagggatgtaatagtgcatctagtctagattgccttaggagctacccgcaaccaagaactcttccggcaccttcataaatcaagtccagctacaagctgcggcggcttcagcacacataagctgggtgcactctaaccaacagcaatgtactgtgactcaacaaccgccgtcgtcgttcaaccgaatccgaacaggccatacttgaagcaacagtaaatatgacattattacactacaataaacgaccaacagtattaaaac

SEQ ID NO: 41270 - DNA, 384 bp, Zea mays
  Clone ID: LIB3062-008-Q1-K1-G10
aaatgcaaggttttggtgaccaacatgctgcttttggtgctcgtggtatgggtggattccagatgcctgaacctccaataacgcctggaccatttgctcctggattgtcacgcaatgaaggtacaatccctggcattggggttgcaatgaccttggcaggccagtcttttgatggatctgatggagagcagaggccatctattccgggtcttccacctgggcaacccccgttgccaccaggtcctcatccatcacttcttgggcagcaacaacagtatcaacagatacctcagcagcaacatccccagttttcgcagccaccacctccaaacatgccccaactgcaggcaccagctcacatgctttcacattcacaaggatctc

SEQ ID NO: 41271 - DNA, 411 bp, Zea mays
  unsure at all n locations
  Clone ID: LIB3062-008-Q1-K1-G12
gcaaatcaaacaaaactggctatgaatcactactgagggtatatagggaaaccgatgtaagccaggagaaagttcgtgtgttaggttctttggcatcatcccctgaccatgatgttgtccgtgaagtattgaatttcatattgtcacctgaggtgaggaatcaggacgcaatatttttgctaagaggggtgagttcaggggcacacgaggtagcatggcaatggctgaaggaaaactgggattacatattgggagcctactctggaactctgctcacctatttcgtcaacataactgtctcgccactggccaccgacgaacatggtgatgaggcggangagtttttcaagagcagaaccaaggcgaacatcgcgaggactgtgagacagagcatcgagagggtgaagatca

SEQ ID NO: 41272 - DNA, 370 bp, Zea mays
  unsure at all n locations
  Clone ID: LIB3062-008-Q1-K1-C9
cgttccgtccaggcaaggaagaaatcgagcagccaaggagaggagaagatggctcgtacgaaggggaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccnagaagccgtcgaggcctacctcgtcggtctgttcgaggaca

SEQ ID NO: 41273 - DNA, 137 bp, Zea mays
  unsure at all n locations
  Clone ID: LIB3062-008-Q1-K1-D1
cctnccccaacccgccctacgacctgacgtccttccggttcagccccatcaaggagtccatcgtgtggcgcgagatgacccggcgctacatgacggacatgatcacccacgccgacaccgacctggtgatcgtgggc

SEQ ID NO: 41274 - DNA, 372 bp, Zea mays
  Clone ID: LIB3062-008-Q1-K1-D10
gcgattcaacaaagacgtacgtacatgcacaaaactagagcgagctgtgtgtgtgtgtgttcgtgatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgtacatacacataactagagcgagtagagataccgtctcttactgtgtgtgtgtgtgtgtgtttatcaactcctcgatgcatggcgaaagcgcatgcgcatgttggcgcgaggttcacgacggaggt

SEQ ID NO: 41275 - DNA, 406 bp, Zea mays
  unsure at all n locations
  Clone ID: LIB3062-008-Q1-K1-D12
ggattttcaacacctatgggcctaggatgaacattgatgatggccgtgttgttagcagcttcatgtgctcaggctgtgcgcggtgagcccctgactgtccagaggccaggaacacagactaggagtttctgctatgttgccgatatggttgatggtcttattaagctgatgaatggaaacaagactggaccgattaacttggggaacccaggtgaattcaccatgctggaacttgctgagaatgtgaaggagttgatcaacccagatgtgacagtgacaatgaccgagaacactcctgatgacccccgtcagaggaagccggatatcacanaggcgtaagaagttctgggatgggagcccaagatcgtnctgcgggacggcttggtgctcatggaggatgatttcc

SEQ ID NO: 41276 - DNA, 436 bp, Zea mays
  Clone ID: LIB3062-008-Q1-K1-D2
aaactttggccagctgcctgcgcccgcccaactaccccgcgcgcggcagccgtcaacaggtcgagcgatggaccacgacaccacggtcggatcgcggcagcgccagcagcagactgcctcgccagcggcggctgattccagggccatgatggcggaccttgacgcgccactgcacgccctcggattcgagatggacgaactatccccgtcgaggcttaccggacggctgcccatcactcccatctgctgccagccgttcaaggtgctgcacggcagcgtgtcggcactggcggcggatgcgctggcgagcatgtgcgcgcacatggtgtacgggtaccgacgcgtcgccggcatgcaactcagcatcaaccacttccgcagcgccgccctcagcgacaccgtcctagcgcaagccgtccacgttcacgtcggacgc

SEQ ID NO: 41277 - DNA, 344 bp, Zea mays
  Clone ID: LIB3062-008-Q1-K1-D3
caaaaaaaaaagaagccgttggagcgcctccctctcaaacggcactcttccccactggcccactcctgcgctccgtcccgcatacaaatcgtccgccaacaatcccccaaaccctactccaccacgcgatcaccgaccgacgcctctccgacgagcaactcaaccccccaccgcgcacgcgagagccggatccccacgatggcgacgatccagcaccaggcgaaaccggcggtggcggcggcgccgagcacgactactggcggtgggcagcgcgcgatggacctctacgagaagctggagaaggtcggagaggggacctacgggaaggtgtacagggcgcggga

SEQ ID NO: 41278 - DNA, 440 bp, Zea mays
  Clone ID: LIB3062-008-Q1-K1-D4
gaatcaagggagggtgaagcaccgccgctgaccgctgtccccggctccccgccgccgcacaaagacgagaggaagaggttcccggcggcgccacgactatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgagtgacatgttggcgttggtgaaaaaggaaagcgccgagcgtcagtca

SEQ ID NO: 41279 - DNA, 265 bp, Zea mays
  unsure at all n locations
  Clone ID: LIB3062-008-Q1-K1-D6
gcccattatgctactctgcctagcagggacgtggtccatccacatttccattgagccaaaaatattgtacntgtgttttcatgtttccacacaagaacagaaaggggctaaaatatttttcctttttgtcaggattgttgcttgatcccagaatcaccattctatttggaaggcgaaggcggactttttagatacatagaaaaacgtttgaaggacaatggtcatatggttatccgtgttgcttaaggtgctggaccgaaactta

SEQ ID NO: 41280 - DNA, 430 bp, Zea mays
  unsure at all n locations
  Clone ID: LIB3062-008-Q1-K1-D7
cggggccagcaggtagatccagagctgccggtagttccccgccgccacggccggccccagcgtcctgaccgggttcatggacccgcccgtcgtcggcccggcgacgaggatgttcagcgttacggccgctcccaccgcgatcccggcgagttcacccactgcgcgggtgtcggtggcgacggcggtgacgacgaagaggaggttgaaggagatgatgaactcggtgaagaacgcctgggcggtggagacggtggcgtcgggcacggtgacgccgtcggagaggaacgggtggaagacgccgcgcacgcagcgcagcttccgncgctgacgacgcacactgcccgcnnggcgnaggacatggtccggcctggtaaggcacgccttggtcgtcctcttcttccgccgcgtaacgcacggccacgacgtgtcc

SEQ ID NO: 41281 - DNA, 379 bp, Zea mays
  Clone ID: LIB3062-008-Q1-K1-D8
ttcccgggggaaatggaaccctctgaatctttgggctttggttggaatgggcaaatgtttaacacagggggggaagggcacacacacggggagttgggtgcggggttctgggtttgggcctaagtatatgatgatgatcacaatgatactagttgaatgtgtgacgtgagagacgatcgcaacaacgaccttaattttagttctagatgaaaaagtcaactgtggccttgatgacttaagttactatgactataaatgctgctgtgctgggctttgctactatcgtaaatgttctacggcttgctattaactagactgaactcttggtggtggtctgggaatctaccttcggtcttatgataaggtcttgtgtgctgtc

SEQ ID NO: 41282 - DNA, 424 bp, Zea mays
  Clone ID: LIB3062-008-Q1-K1-D9
cattttgttgatggattcttctctccaatatatgcacaactaggaatcaacatattgggtcttggcttcatcacatctgttactttcatatttttgatcggagtctttatgtcatcttgggttggggcatctgtccttagccttggcgagtggattattaagcgcatgccccttgttcgtcatatctacaatgcatcgaagcaaattagtgctgcaatatcaccagatcagaacaaacaggcattcaaggaagcggtcatcataaggcatcctcgtgttggagaatatgcgtttggtttcatcacatcgtcagtatctctccagagttattccggtcaagatgatctttactgggtctatgtcccaacgaaccatctttacattgccgatatcttcatggtgaattcaaaggatgtcataaggc

SEQ ID NO: 41283 - DNA, 442 bp, Zea mays
  unsure at all n locations
  Clone ID: LIB3062-008-Q1-K1-E1
gaatgccaagcagagcctctacccggatgtggaccaatccaaccctgatctcaacacccctttcttgtccncacgcaccaccttcaccggcgccggcgccggcgccgncacgggcaactccctctaccccaccgtcgaccccaacgagctcgcacagaacctcttccccgagacggtcgaagaagacccggaaccgccaccgcccaccacagaggagaccatcatcgctgtccccggggcgcagctccacctcatcgaccccgaccgcagcgtcgacctcggcgctggcacgctctccatcgtgcgcctccgccagggggaccactccgtcgccgtcctcgcgcgcctgatccacgagaagtcccaccgccgccgcggcctcttccgcttgttcagcagcgggcggtctgacgctggcgccgagcaggagcccgtccagtgg

SEQ ID NO: 41284 - DNA, 412 bp, Zea mays
  Clone ID: LIB3062-008-Q1-K1-E10
cccacgcgtccgtgtgaactggtgggggcacaaatttggatttttatcaggagggtttctaggagcaaaatcccgtaaaaataaatcttcacaaaaagatcctgctaatgtccgccagacatttgcagaggaagatcaagaaaatttgtacaatcttgttcaggataaagctacttctggaaagcagggtcttggcatcaaaggcctgccaatgaaagttgctggccaacgttggaagggaaacaaaacttcgtttgttgatagtgatgatgataattcagcccagcccgatgaatattcagaaatcgaagagaatggcgatgaggaagaacatatcagtgcttctgaatcaatagacacagataagaatgcagacaaagaattgcttgtggctgctagacccaaaaccaag

SEQ ID NO: 41285 - DNA, 334 bp, Zea mays
  unsure at all n locations
  Clone ID: LIB3062-008-Q1-K1-E11
cgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgtccgcggagggcgacgccgttgcgcaggcgggccgncgcgccgtgatcgggctggtggccactggcatcgtcggcggcgccttgtcgcaagcggcgcgcgccgagaccgtcaagaccatcaagattggagccccgncgccgccctccggtggactccccgggactctcaactctgaccaggcgagggac

SEQ ID NO: 41286 - DNA, 436 bp, Zea mays
  Clone ID: LIB3062-008-Q1-K1-E2
agagattgctggtcgagaagaagagatgttacatatataataactactgtgtaggcagcggcatctgctgctgggacgaagattcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgaattcgggaacttccaaaacaagggcattttcaatcttggtcaaggcaatcctcttcttggccttggccgccttcttcctcgtcgccgtcggggtgcacatgtacctcggctcctaggcggcggcgcggggcgccgtaccttctctctctcgccgcgcgcgccatcgttctcttcttttatgttctctctctatatatata

SEQ ID NO: 41287 - DNA, 397 bp, Zea mays
  Clone ID: LIB3062-008-Q1-K1-C7
ccggtggcggagaacgaggaggaggaggaggaacaggaggagttcagggacatccacgcgctgagcgcgccgccgagccagccgtcgtcgtaccgccgggcgcgcggcggcgagccgtgggggtccgccgcgggcgggagcaggcacacgtccgtccgctccgtcgggagcgacaccgcgcccagcgagcccttcccgactatgaccagggagttctcggccatggtcgccgcagcagccagcgccgcagcagccagccgtgacgcggacagcgacgtcgtgggcagggccgaagaagaagaagaagaagaacttgaagagaccaacccggttgccaattgtcccgacaggaaccccattccgttggcgggcccggggccggcggccggcggcccgg

SEQ ID NO: 41288 - DNA, 359 bp, Zea mays
  Clone ID: LIB3062-024-Q1-K1-D11
gcgagagatcacagaagctggttttgtggaacctacccctatccaatcgcaaggttagccgatgggattgggaggccgcgaccttattggcattgccgacacaggatcacgcaaaactgtcgctgacgttcctgctgctgctgctgatgtgaatgcgcaggctattcattgccatgaccatagtgcaattctcttcgtgttagctgctacacatagacttgctaataacatatagcaagaaccagggcagaactgctgcatacttcctgactgaccgtacttggatatatgtgcactgtgccaaaaggtgcacaatttcctgatctttacaaaagtgttgaaattgctatagctacacc

SEQ ID NO: 41289 - DNA, 270 bp, Zea mays
  Clone ID: LIB3062-024-Q1-K1-D12
acgatcgcggctccgctgccctgctctccaccttttccagacctgcaccatgtaccagccgcctgtacatccatccacgctcccccatgccctcaccaccgccgagtaacacctctctctccgactcccttgccttgactgattctaataattcgtcgaacgataatctcttattcccctgtcttcaaccgtactgcaatatcctgaatctatctttggacttttccccaacgtacatatcggcctaacctgcagtggctcctaccgtct

SEQ ID NO: 41290 - DNA, 160 bp, Zea mays
  unsure at all n locations
  Clone ID: LIB3062-024-Q1-K1-D3
attgctgatctatactgtactagttcatactttgtgttttctagcctttgaaattggtgcatgtccagtggctggaccagaaatcttgganagcctgtacaaaaataatactcatattgtaaatatatagcttgtctttttccccccccctataattaac

SEQ ID NO: 41291 - DNA, 162 bp, Zea mays
  Clone ID: LIB3062-024-Q1-K1-D4
agaaagtagcataaacgctaccatgcttgaggaagggcttgcccggctcgaaagaagcgagagatgggacactagggagaggaagacggctctacagaacctggaacagttccaggacaaggcaaagaaggaaaggctgcggatttggcagtacggagatgt

SEQ ID NO: 41292 - DNA, 165 bp, Zea mays
  Clone ID: LIB3062-024-Q1-K1-D5
cggaagactaacagtcatgcacctctggccttatcactcccaacgatgaccggtgctgcgttaaatactcatacaccaaaagctgatgagccggatgctgatctaagtgaccaatatgctgtactggtatctaatcgctgtaattacacagaatcgaaacttttt

SEQ ID NO: 41293 - DNA, 239 bp, Zea mays
  Clone ID: LIB3062-024-Q1-K1-D6
ctccactcgccgcaggccgccgggcgccgccgaggggatcggagcaagatgttcttccacatcgtgctggagcggaacatgcagctgcacccacgacactttcggccgcacctacgcgacaagctcgtttccaagctcatcaaggacgtcgagggcacctgcagcgggcggcacgggttcgttgtggcgatcacgggtgttgaagacatcggcaaggggctaatactgggaggcaaagg

SEQ ID NO: 41294 - DNA, 117 bp, Zea mays
  Clone ID: LIB3062-024-Q1-K1-D8
acgatcacatacgaacaaaagcatctcgatctcatccgacacacgaggaagaagagatcaagtggcggacgaacaggggagtcgtggatcgcgtgcacacagcaagggctgaatttg

SEQ ID NO: 41295 - DNA, 182 bp, Zea mays
  Clone ID: LIB3062-024-Q1-K1-D9
ataaagcacggaatcttactttgtcgaacctatccttttccaatcgcatcgctggcccatgggattcgataccctgcaccttattgtcatctcatagacaggatcaatgaaaactcttgcttaccttttacctgtcattattcatctcaatgcgccgtctattcttttccccgtctatcatc

SEQ ID NO: 41296 - DNA, 397 bp, Zea mays
  Clone ID: LIB3062-024-Q1-K1-E1
agtacgtggaggagcagccatggcttcatcggtggccgccgcggcgagcacattcctgggcacccgcctggcggacccggcgccacagaacgggcgcatcgtggcccggttcgggttcgggttgggcggcaaggcgaaacctgctccgaaaaaaggggccaaaacatcgaacctcttttgaccggccgtttgggttccccgggccctggcccccgaattccttgaagggttggttggccgccaattacggtttcaacccgtcgggcttcggaaggccctggaggaccttcaattccaggtggacttgcttgaacaaaaccttgcccagaattaaggccgccggattattgggacccgggtcgaggtcttccaagtcaaattcaacccgttgcaaccc

SEQ ID NO: 41297 - DNA, 430 bp, Zea mays
  Clone ID: LIB3062-024-Q1-K1-E10
ccagagggtggcttcaattcaacatcagcttgcatctttgaaacttaaagatgcaccagtcgttggtgcctttaatcctgtgaagggagagatagtcctctcacaatttagccttgacaactcctggaacagagctatgattgttaatggacctcgctctgtagaatctctaaacgacaagtttgaagtattctatattgactatggcaaccaagaggtggttccctacagtcgtctacgacccgtggacccatctgtttcctcttctcctgctcttgctcagttatgcagccttgctttcataaaagtgcccagtcttgaggatgactttggtcaggaagcagcagagtatctaagtgaatgtttgctcagtagctcaaagcaatatcgggcaatgattgaagaacgtgatgcttctgggggaaaatca

SEQ ID NO: 41298 - DNA, 450 bp, Zea mays
  Clone ID: LIB3062-024-Q1-K1-E12
ctttccgcttgctttccagtttgcggcatcagtcggtggcgcctgcgatggagtctctgtgcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctggccgcttcacgggaccaggagaggaaccgcttggcgctgctcatgtctgccgcgctccttcaaggcgcgtccgttggtccgctcgtcgaccttggtattgacttggattcgaggattctcgtcactgcgttcgtcgggaccgcagttgcttttgcatgct

SEQ ID NO: 41299 - DNA, 232 bp, Zea mays
  Clone ID: LIB3062-024-Q1-K1-E3
cttttcatgtatgagtatgatagctacttgcccatcacttgcaaggccaaatatgcatatttccccagcatttgtctctttccaatggccttggcacagagtcacttaacaatttagttcaaatcgtggtggttcccagcctgtattttctaattgattatttttagtttcgatctaaaatccaattcttgcatttggcaaaaaatttctaactattttgttggtatgattt

SEQ ID NO: 41300 - DNA, 241 bp, Zea mays
  unsure at all n locations
  Clone ID: LIB3062-024-Q1-K1-E4
cgagcttcggtttcgacggacgcagccgtcaccgcctcaccggcccggccatgggcgccgccgccgcctgctctcttcgcctctgccacacgtcaccatccgctgcaacggtagggccgcgatgactccggcggttcgggtggggaatcctcgcgcgcccggtccgggcgccgcggtggtggaggacgnagaggaggcggcggtcgcttggcgggagctgcgcggcaaggcccgcggagtc

SEQ ID NO: 41301 - DNA, 116 bp, Zea mays
  Clone ID: LIB3062-024-Q1-K1-E6
gtcacgtgacttatattgttgtacgcattaaggtcggcctgaaaaggatcagatcatgtgtagaaacaatatagtttagtgaaaaattggacccggcactatgaccaataattatg

SEQ ID NO: 41302 - DNA, 211 bp, Zea mays
  Clone ID: LIB3062-024-Q1-K1-E7
gtgaccgtcagcctgcccgtcgccggtgtgcagtgaggtctgtggccatcagcgggccagccgtcgattggagccagcaccgcgaggtctgttgccgtcgatcgttgattggagccgccgtccgacgagccgtgggctcgtggccgatgccgccgtcaattaggggtcatcagtcgctgattggagttgtcgcccgatgattggtgggttt

SEQ ID NO: 41303 - DNA, 437 bp, Zea mays
  Clone ID: LIB3062-024-Q1-K1-E9
cgagaagccgaagaaaattcgaagacgaggagcagctacactgcggacggacttcgggcatggagggccagttccaggttggcaaggaggaggtcatccaagcatggtacatggatgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgctattgccttgagggcaagcgctactttgatgtgagggaccaagatgatcagtggatc

SEQ ID NO: 41304 - DNA, 125 bp, Zea mays
  Clone ID: LIB3062-024-Q1-K1-F1
gcaactgcttggagcctccgcacaacataaaaccccacgggtagtctcggatctccacgcgcccaaaacattcgaagcttattcgatgtcttgcgcggcgttctggaatctgaatcttcaatctt

SEQ ID NO: 41305 - DNA, 421 bp, Zea mays
  Clone ID: LIB3062-024-Q1-K1-F10
atggcaggttcaaggacattttccaggaggtgtatgaagctggttggaaaaccaaatttgagagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaaccagtacgaacagtattgcctcaatctttgcgtggacaagaggacttgcacacagggcaaagcttgatgacaatgctagactacttgacttcacccagaagcttg

SEQ ID NO: 41306 - DNA, 442 bp, Zea mays
  unsure at all n locations
  Clone ID: LIB3062-024-Q1-K1-F11
agggcattctgccgtgggaactggaggaatcaggaagtccttgctgagcaggaagacaacatgtccagctgtgtccttcagctcggctggctcatcatcttccttcaacgatgaagtagtcatggctgaaatggttgtggtggctgcaccagttgacgtccactaccctgaatctggcaaaccagggtagctgatcaataatgtcaattgtcgcagttttcatcttcgccgccatcattattttgctggttttgtaagttaagttccagcatttggtagcattgatcattttatgagaattgaggctccatctagaatttgctgagatgtgatctctcagcctttagaacggagagcttccatgccttaagcattgtaattttgaaccgaggctattggcaatgcaagttccccaaaaaaaaaaaatannaaaaaaaataaa

SEQ ID NO: 41307 - DNA, 438 bp, Zea mays
  Clone ID: LIB3062-024-Q1-K1-F12
gcagtggctcactttgagaggaccaactgatgcagatttgctttaacctctcatccaaacagcattagggcaagttgtcttctgtactgtgagagaaattgcgtgcatggttcggattcaccagaatctgtatacagagagatctcatttttcttctgagaagctgaatccgtatctgtggaacatgatgagctatagacgccacactggtatcagtgtcaatattgtccggctcactggacaccatattgagtagtatcgactctgctgcttttagcgttcgtcatgcttcttttatgaactaaacccgaagactctgctatttgaagaggtgatgtcaagtgtgacataagacatagtcatttttaaggctaatttggaaatcttatttcttttaataaaattttatttccttaacgaaatttagttatttttctt

SEQ ID NO: 41308 - DNA, 115 bp, Zea mays
  Clone ID: LIB3062-024-Q1-K1-F3
gccgcaggcggtggtggccgtgctggtggcggcggcgctgctggcttcgtccgcttcggcggcgatcacctgcaggcaggtggggtcatcgctggcgccgtgcatcccgtacgcg

SEQ ID NO: 41309 - DNA, 172 bp, Zea mays
  Clone ID: LIB3062-024-Q1-K1-F5
cggtccgattcccgggtcgccccgcgtcgcaggccggctgtccgtcgcgcggttcgatttctcgggggagacgccgtctgcccggggagacgctcgagaacctcaagctcggcatcaagtccaccaagaagctgtgcgctgttatgcttgacacgggtggaccggagctgca

SEQ ID NO: 41310 - DNA, 443 bp, Zea mays
  unsure at all n locations
  Clone ID: LIB3062-024-Q1-K1-A12
agcaaggaagactgccactagcccaagttcaggatggcgatgaaggttcaaatttatcagctgaggaaaagcatctgaatgagacattcataaaggacagtatccctccctggttggcaggatctggttacattggccttgcagcaatatcgattgcaaccgtcccaatgatctttccgcagatcaagtggtaccttgtcctctcggcatacgttgttgctcccctcctcgctttctgcaactcatatggcactggactaacggactggaatcttgcgtctacatatggaaagatcggcctcttcatttttgcatcatgggttggtcagaatggcggtgtgattgctggcttagcagcctgcggtgttatgatgtccatcgtgtccactgcagccgatctcatgcaggacttcaagaccggttacctnacactctcttcccct

SEQ ID NO: 41311 - DNA, 313 bp, Zea mays
  Clone ID: LIB3062-024-Q1-K1-A3
atggcaaggtcatcgtcgtcgagtgcgtgctgccggtcaacacggaggccacccccaaggcgcagggcgtcttccacgtctacatgatcatgctcgcgcacaaccccggcggcaaggagcggtacgagcgcgagttccgcgagctcgcaaagggcgccggcttctccgggttcaaagccacctacatctacgccaacgcctgggccatctagttcatcaagtgaaccaccgtcgccgtgatgagatggcatggctgccacaaaccttgcttgcttggtcctcgaatagtacgtcgccgtcctcgtcttcttct

SEQ ID NO: 41312 - DNA, 189 bp, Zea mays
  Clone ID: LIB3062-024-Q1-K1-A7
gtcatttctgagggaatgcatagtctgtatgtggtttcgtacgtgtgtgttgggacggggacttgcacattacatcacatcattcattgcgttcatatacattcatttagacattcataggatcatcatcatcatatcatagagcacagacatttgcttcggttttaatgacaaggctttggcgaatac

SEQ ID NO: 41313 - DNA, 435 bp, Zea mays
  Clone ID: LIB3062-024-Q1-K1-A9
cgccgacgcgtccgatccagccaggcgcggcgtgcttcgagcccaacaccatggtcgcgcacgcctcctacgccgggaacgactactaccagcgcaagggccggtccattggaacctgcgacttcgccggcgccgcctacgtcgtcaaccaggcaccgaagatgggcaagtgcgacctcccatcgacgacggtctgagctgaagcagcagcggcgaggaccgtaacgtcagcggccatctcgaggaacaaaggaatcgatggcatgcagcagcagctcagctcatcagtcgccctagagactggagactctgggggacgccggaatctttgcccaccctttcagactttctttaccgctgcagctgcagctttgactccagccggagcgacgccgtaaaacgaacatcgctgtactaggcggtagctgtacgcct

SEQ ID NO: 41314 - DNA, 114 bp, Zea mays
  Clone ID: LIB3062-024-Q1-K1-B1
ccttcttctcccgctcccgcagcggctagcgcggctgcgcccggcgggcaggctcgtcctcgccgcactcctgcgcggcgagcgcgccgccgttcccgtccccactcccactcc

SEQ ID NO: 41315 - DNA, 434 bp, Zea mays
  Clone ID: LIB3062-024-Q1-K1-B10
ggcctccccggcggcagcattcctggcagcagcattcccgggttcagcatgcccggcagcggcagcagccttcccgggttcagcttgcccggcagcggcagcatgcccctcttcggcggcggctccccgggcttcagcggcttcggcggcatgcccgggtcccccaccgccggctccgtccccgagcacgccaacaagccctgaactccgtctgtccgtccgatccgtcgctggagcgaggtcgggctagccagcgtgcgtggtagtagagtgatggtactgtagtacgtcgtcgtcttcatgcatgcgtggttcgtggtttcccctagctccatacgagcagtagttgggccttgcacgtaccgtacgtctagctagctatatatatagcttgtgttctactgctttttagtttaattacctgcctgcattgg

SEQ ID NO: 41316 - DNA, 413 bp, Zea mays
  unsure at all n locations
  Clone ID: LIB3062-024-Q1-K1-B11
cgcttctctctccccatctccatctgcaatcctcgctcgcccacgctcggcagccatggcgtggtcgcgcaccggagccggagccggagccggagccggcggccgtgtggtggtcttcccgttcccgttccagggccacttcaacccggtgatgcggctggcccgcgcgctgcacgcccggggcctcgcgattaccgtcttccacagcggcgccctggacccggccgactaccccgccgactaccgcttcgtgcccgtgaccgtggaggcggacccgaagctgctggcgtccgaggacatcgccgncatcgtcaccacgctgaacgccagctgcgacgcccccttcagggcccgcctctcggcgctgctggccgccgaggggagggacagcgtccggtgcgtcttcaccgacg

SEQ ID NO: 41317 - DNA, 438 bp, Zea mays
  Clone ID: LIB3062-024-Q1-K1-B12
cttcatcatctggtacacgcatgacagtttcctgggaattgacctggctagtgatggtcatacacttgtatcgtactcccagctctcaaactgggacaagtgctcctcatgggagggcttcaaggtgtcaccattcaccgcaggagcgaggacattcagcttcgatgcaaatccatgcgattacttccagggtggcaagattaaagcaacgaccctctccctgtcagtcttggtggccattgagatgttcaactcactgaatgccctgtcagaggacggcagccttgtgagcatgccaccatgggttaatccgtggcttcttctggccatgtcggtttctttcgggctgcatttcttgatcctctacgtgcctttcctcgctcaagtgtttgggatcgtgcccctcagtttgaacgaatggctcttggtggtggcagt

SEQ ID NO: 41318 - DNA, 155 bp, Zea mays
  Clone ID: LIB3062-024-Q1-K1-B3
caggcctgcccgaataatcctcctgcgtattcccctcacggcaggccaaaacccgcaggtttagggcgtcgacagattctgaaactcggcgaactacggacatggctcacgtcgccgatcccgctcccggattctcttggcgccgacgcgaggag

SEQ ID NO: 41319 - DNA, 164 bp, Zea mays
  Clone ID: LIB3062-024-Q1-K1-B4
ccctcccaagtcccaaagccgccgtcgtccgccagcccaccatggccgcgcagtcgtgcctgctcgccggcactgacgccgccaggtcccccgcggtcttcgccgctccctattcctgcgcacgccctttccactcggtccacttcgtcgccggcccgtggggc

SEQ ID NO: 41320 - DNA, 213 bp, Zea mays
  Clone ID: LIB3062-024-Q1-K1-B6
cgattcccggtcttctcattcctcgacatggagatccagcacgacagctactggtgtctgtttttggcgattctgatagcgaggggtttctccaatgccgcgctgggagagacagcaccgtcggttgtggcgggtttggccaattgttgggatgtgccaggaggaacatgaacgccgaggcagcttttagaggtctttatgtggccatcaagt

SEQ ID NO: 41321 - DNA, 224 bp, Zea mays
  Clone ID: LIB3062-024-Q1-K1-B7
gtggctgcttcgtccgtcccacccaatcgccctctcccctccgctccccaggggccaggaggagcagccagcccagccctgacgcttccttcccacccggtgcaatcgctcccaagcctgactcggtcgctggaccgaacacccgccggtggtgctctttccgcgtgctttttccggcttcttcttcgccgcccgccgcccgcggggcccttcctgaaggttcc

SEQ ID NO: 41322 - DNA, 370 bp, Zea mays
  Clone ID: LIB3062-024-Q1-K1-B9
acgcaaaaaaaaaagaagccgttggagcgcctccctctcaaacggcactcttttcactggcccgctcctccgctccctcctgcatacaaatcgtccgccaacaattccccaaaccctactccaccacgcgatcaccgaccgacgcctctccgacgagcaactcaaccccccaccgcgcacgcgagagccggatccccacgatggcgacgatccagcaccaggcgaaaccggccgtggcggcggcaccgagcacgactactggcggtgggcaacgcgcgatggacctctacgagaagctggacaaagtcggagaggggacctacgggaaagtgtacaaggcgcgggaaaaagcgaccgggcggatcgtggc

SEQ ID NO: 41323 - DNA, 161 bp, Zea mays
  Clone ID: LIB3062-024-Q1-K1-C1
gatttcttgttgggaaaaaatcggttgttcagcggattagaggcggagatgggagccggggctgaggtcatgcatcaggtcgtgccgctgctggagccgccgctccaccggtgcgtcgttaagagcgtcgatgtcatggaggaagtggttgccgtggcgcc

SEQ ID NO: 41324 - DNA, 241 bp, Zea mays
  Clone ID: LIB3062-024-Q1-K1-C11
acgttcagcaccagatccgatctcttacgccgttttcgtttgcccacctcctcacacaaaccctgaccggagcccgtaccgccggctcctactacatcaccgccgcattcgtctgccttcgtcgcctcgctaccaaggtcgatatcgacgagatcgacctcaccgaggaagacgctggctcctctgtccacggctcctacgcctcttcctcatcgatcgaagtggttgtgatccgtcacct

SEQ ID NO: 41325 - DNA, 441 bp, Zea mays
  Clone ID: LIB3062-024-Q1-K1-C12
agctgatggactcttatgcgactctcctgtttgccaagatcacggagatcagaccggaagcgttctgcaaacggtatggcctgtgcagggacacagctcttctctccggtgtgggaagtgacagcacgtgtgtgttctgccaccatctgctcgatgaaatcatgtccaaactgaaagatccagatgcggagtttgagataattcagattcttgtcaaggagtgcaataagatcgaaggtcacgtccagcaggtaggctttttggctcttcctctgtccttgtgattctgtgcaaaaggcgagctcgtcctcttccttaatgaggttcttaagagtgtttcctcagctgtattggttacccttactactttggattttggaaacagtccgagacccttattagttaacaatatcatagttgttgcaaagatactctactttt

SEQ ID NO: 41326 - DNA, 111 bp, Zea mays
  Clone ID: LIB3062-024-Q1-K1-C4
cccgggctcagacttctgctgcagcgcctccgccgccgctgccgcatctaacgcagttccctccgccgcagcccgaggcagggaggttctccagaacgacatggatctgct

SEQ ID NO: 41327 - DNA, 177 bp, Zea mays
  Clone ID: LIB3062-024-Q1-K1-C5
cggacgcgtgggagcgtgctcgcgaggccctgcttcctgctgcgatggggggcgagacgcacctgagcgtgcaggagctggcggcgtcactgggcgcgctaccgccggagttcgtgcggtctgagcaggaccagccgggcgcgaccacgtaccgcggggccagcgtgccggacgcgc

SEQ ID NO: 41328 - DNA, 477 bp, Zea mays
  Clone ID: LIB3062-023-Q1-K1-H9
gaattcccgggccaatattcaacaagagcacgagatttgaagacatgaggagatatgatgatgaaaaagcaccttacaggcggccacaggtgaagaaaccatcaagtagctctggaatggaatccagagatgatgatgttgatgctgacttttcacaacgcaagtctgggcaaagtagttcaaggcagcatgcttctaggccagaagcctcgcctttggactttgtcattcgtccacagtccaaaattgaccctgagcagatacgagctcgtgctaagcaggctgtccaagaccagcgtcggctgaagatgaacaagaaattgcagcagctgaaagcgcccaagaagaaaaaccttcaggcgtcaaagctcagcgtggaaggccgtggcatgatcaagtacctgtagatcacccactgtggcatccgcagtcagcagtgtcctgcacatgatacagcgcctgcagggattgctgaat

SEQ ID NO: 41329 - DNA, 222 bp, Zea mays
  Clone ID: LIB3062-024-Q1-K1-C7
ggagaggccgagaagcgctttagccgtagccgtagccgtagcgataagagtgagctagctggtgcacaccggcatggcggccacggcgtactccgtggcgctcctcggcggcgcgcgcctacccgccgatccgcgctccgccctcctccctcggcgcagcgtctgccagcttcgcttccaagatgcaccgaggctttacctgctccgtgcgaaggccgtttc

SEQ ID NO: 41330 - DNA, 190 bp, Zea mays
  Clone ID: LIB3062-024-Q1-K1-C8
acggtatggacattgctagagttacattacatcatcactagtatatataaggtggactgttatttgtaagcctaatgaaagtgaataattggatgcgtaatgtaagcctactctactatatatatgattgttttggaaaatcgagggagtgtgttacttgactatccccaatcacactcataaaaacttg

SEQ ID NO: 41331 - DNA, 181 bp, Zea mays
  unsure at all n locations
  Clone ID: LIB3062-024-Q1-K1-D1
atccaatctagaagcgcccctctccctctctctctctctcttcgccgtccgaagctgggcacgcgaatctaatcgacacctagccgagatgggccgcaagttcttcgtcggtggcaactggaaatgcaatggaaccacagatcaggtcgagaagattgtcaaaaccctgaatgaangacag

SEQ ID NO: 41332 - DNA, 445 bp, Zea mays
  Clone ID: LIB3062-023-Q1-K1-G10
cgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcagtggcaatattggccggctcattggacaacgtgggagagtatcgactctgctgcttctagtgttcgtcatgcttcttttatgaactaaacccgaagacgctgcaatttgaggaggggatgtcagttgtcacagaggagagagtcatttttagggctagtttggaaatctcatttttttcaagagatttttattttcctaaagggaattagtttaattttc

SEQ ID NO: 41333 - DNA, 355 bp, Zea mays
  Clone ID: LIB3062-023-Q1-K1-G12
acctctctccctcggcctcgccggcggcacatcgcatcgcagcgcttccactgttgggtgtggtggatttcctccgcccccgaacgatcgatcttttgcatggcagcagcggctagctccaaggggcgggcgatcgctgggagcttcgtcagccgcgtcctggccggcaaggccgccttcccgaggagggccgtgcacgcctcgtcgtacgacaagaaccccgaggagcatgtgcgccctgtgatactgccggacaatgtgatcggcggcgcggggagccccgacaagtactggagcccccaccccaagaccggcgtgttcggcccggcggcggttgacaccaaccagctgggcg

SEQ ID NO: 41334 - DNA, 213 bp, Zea mays
  Clone ID: LIB3062-023-Q1-K1-G2
aggcagcacagctccctacgaactcgatgctcctagctgtatctcctcttgttaaggggtgtggtcttggtaggagtaacaatagtttctggcagccgtcttcctcctcgctctctaccctaggagaggagaggagaggagaggagagaaatcctgatgctaatcttctcaagacgcataaagcgtgcctatatacaatcgactaaacacaga

SEQ ID NO: 41335 - DNA, 369 bp, Zea mays
  unsure at all n locations
  Clone ID: LIB3062-023-Q1-K1-G3
cgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggngcccgcgcggccaaagtatcctgttcgctaaccgggtggttaaccttaatccaaatggttaactttggtcggcttggggttggtggtggccatctggggttttgaatggaaggcgctttggggcaattggta

SEQ ID NO: 41336 - DNA, 368 bp, Zea mays
  Clone ID: LIB3062-023-Q1-K1-G4
agccggggtacggtcctaccaccgctgtgcctaataattggcggctagctagctagctagctgcagctgctgcgatcctggatcggcacagccggttcttgatgtggagggagcggcggcgggcgctgctcctgctggtggccggcgcggcgctgggactgatcggtgccgcgctcgcgagcgcgccgtcggaggccgcgctgaaggtcgggttctaccatgcgacgtgccccatcgcggaggacgtggtcctcgccgagatgaggctcatgctcatggaggacgccacggtcgcgccgtccctgctacggatgcactaccacgactgcttcgtgcaaggctgcgacaggtcgatcatgctccagtcg

SEQ ID NO: 41337 - DNA, 415 bp, Zea mays
  Clone ID: LIB3062-023-Q1-K1-G6
gcgaaaccgaaagagaggcagagcttggcaatggagctcccgtggggaatgctgctgccgctgctgctggtcctctccgtctcgtcctcgtcatcgtcgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctgccggggtggacggtgcaaggccacgtggagtacgtctcgggcggtccccagcccgggggcatgttcttcgcggtgccgcacggcgtgcacgcgctgcgcctcggcagccgcgcgtcggcgtcgcagaacgtgacggtgcggccgggggcgctgtacgcgc

SEQ ID NO: 41338 - DNA, 269 bp, Zea mays
  Clone ID: LIB3062-023-Q1-K1-G7
ctcaggcagatgggcattcgtgagctgttccagaatcttaacacttaaacgtgctacagtatctgacgacggaagatggttcattttactcctatttattgctacgttgtgtgtatgtgttatgcagctatgctgtatggcttatggttatgagcgccacaaatttgtttgtcaagattctggatgatatacttatgcattctgacataataggaggcaaaacctcaagattttccttatttttattttatcaattacagcattttctg

SEQ ID NO: 41339 - DNA, 264 bp, Zea mays
  Clone ID: LIB3062-023-Q1-K1-G8
cggttcgggattcgaggcacgcgtcacacgtccggtgcgagacctaccaccggtgttcctattaattggcggctagctagctagcgggctggggctgctgctatcctggatcggcacagccggttcttgatgtggagggagcggccgctggcgctgctcctgctggtggccggcgcggcgctgggactgatcggtgccgcgctcgcgagcgcgccgccggaagccgcgctgaaggtacggttctaccatgccacgtgccccatc

SEQ ID NO: 41340 - DNA, 443 bp, Zea mays
  Clone ID: LIB3062-023-Q1-K1-G9
cgcgctagctagttctattgccgcaccccatatcttcaggagggactcgttctttcagctaagtacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtactcgcgggagccgtagagcatgaaggagctccgcgaggtcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgccctcccggaggacggcacgatcttggccatggaca

SEQ ID NO: 41341 - DNA, 387 bp, Zea mays
  Clone ID: LIB3062-023-Q1-K1-H1
gatctggtggatggacagcgacgcgctcttcaccgacatgtcgttcgagctgcccctgtcacgcgtacgacggccacaacctcatcatccacggctaccaggacctcctcttcgagaagcactcctggattgcactcaacaccggcagcttcctcttcaggaattgccagtggtcgcttgacctcctggacgcgtgggcgcccatgggacccaaggggttcatccgcgatcaggcgggcaaggtactcacggcaaacctcaagggccggccagcatttgaggccgacgaccagtcggcactgattaacctcttgctctcgcaaaaggccaagtggatggacaaggtgttcattgagaattcctactacctgcatggcttctgggctg

SEQ ID NO: 41342 - DNA, 447 bp, Zea mays
  Clone ID: LIB3062-023-Q1-K1-H10
gaccaacaagtctcaggagggatcccagttctgtagaggatttggtggcattggtggcatgttgcgctaccagctggatatccgttcttttgatgagctttctgatgatgacgatgtgtatgaagactctgactagcaatcagccaatctcatgcctgtgctggcccatggaaggacgcaacagctcgacctcaccatacctacgcaggagcacacgaaaagcaactatccaaggattaatgggcatgggccagcgtcgtcctcttcaagaggagcttaagactaagatgattttgagtcacaatcatgggagtaacgtgacaagaagataccctactatatcacaattattccagtaatgcgtcgagaagataccgttgtttaagtgcacaaaccaatacagtgacgtgccaagaaagtaccgtattttaaagatgtttaattttc

SEQ ID NO: 41343 - DNA, 387 bp, Zea mays
  Clone ID: LIB3062-023-Q1-K1-H11
acggcgccggctacctgtcgtccatcacgctggtgttcaccgccggcgagtacaacgggagcaccctgtcggtgcaagggcccctgctcgggttcacgggcaccatcgagcgcgccgtggtcggcggcaccggcaagttcaggctggcgcgcgggtacatgcttttcaagatgataagcaagccgacgccggagactgacgtcaacgagatcaacctgttcgtgctcatgcaccccgctggcaagtactatcgcacacaccttgagactcgagtgagtggctactaccgcattgttgttgggcacgttgggtgaagtgtctatggccaatccaactctttcagatttggttctcttggtgaaacccaataaacatgcaacttttttg

SEQ ID NO: 41344 - DNA, 419 bp, Zea mays
  Clone ID: LIB3062-023-Q1-K1-H12
gaggatgaagagaccgacggctcttctgctgcgtgttgccgcatttgccttgaggctgagtctgagataggtgatgagctagtatcaccttgcatgtgcaagggaactcagcagtttgttcaccgttcttgtcttgaccactggcgatctgttaaggaaggatttgcattttcacactgcacaacttgcaaagctcagtttcatcttcgagtggaaacctgggaggataactcatggcgtaaaatgaagttcacggtctttgttgcaagggatgttctactcgtatttcttgctgtacagcttactattgctatcatcggtgcgattgcatactttttagacagggatggaagtttccggaacagttttagcgatggttgggaccgcttcttgtcaaagcacccaatacccttctacta

SEQ ID NO: 41345 - DNA, 337 bp, Zea mays
  Clone ID: LIB3062-023-Q1-K1-H2
aaaggcaagagtatgacaaaaaaggcattctatacgttcaagatcagaatgtagtgggattacgtgaaccggcacaaggggctaatacttacgtgcaatggtcttggtataaggtactcagtatggtgaacacgctcaagggcccacagtttgcactcatctgcagtcttggagaatctgtaatgtggggccagtggggatgaaaataatttctgatgacatacagggaagcctttgatctgaaaatggtatagtgcatcagtgccatgtttgaaagccaaatattgaccacttgagttcatcctacaagggtacaacagagttgatttttatttgt

SEQ ID NO: 41346 - DNA, 274 bp, Zea mays
  unsure at all n locations
  Clone ID: LIB3062-023-Q1-K1-H4
ggaggagcgctggaacgacggccgcgcgctgccggagcccccgacccccggcgcgctgaagaggcagctggggagcctgaagctgcagggcgaccaccaccagggcgcgggcgacgacgggcggcgcctggtggcgcgcagcaacagcgtggccaaccagagcagccggatgtcgctgtcgtcgcggtcgcggaggatctttgacaggctgtgggtcggcggagcgaagctgcccggggaggccgncgccgcgggcaaagggtcgtcggacacg

SEQ ID NO: 41347 - DNA, 199 bp, Zea mays
  Clone ID: LIB3062-023-Q1-K1-F9
gcacggaccatggacgcacgtcttcctgggcttatctatccttgggcctgttccgcttggccggtgaacatgaactgcatccgtggcagagtgcgaccgctgctgcagctgctgctgaatcaagtcatgcaactgcatgtcccttaacttggagaccgccgcccctagcagcatcacgaccatagccctagctgcgccg

SEQ ID NO: 41348 - DNA, 342 bp, Zea mays
  unsure at all n locations
  Clone ID: LIB3062-023-Q1-K1-H8
cacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgncggcgccttcgcactctacgagaagcacgaagcgaagaaggaccccgagcacgcgcacaagcacaagatca

SEQ ID NO: 41349 - DNA, 434 bp, Zea mays
  unsure at all n locations
  Clone ID: LIB3062-008-Q1-K1-B2
cgaccgcgagttctggcagttcagcgaccagctgcgcctgcagacgaccgccttctccggcctctggctcnncgactccatctggtctccggccaccggcgccggcgggcggcgcaacaacaacaccgacctactcgcggcctccgcgtcggcagccgacgccggcaagcacaacggcgtgggcctcagcctgaatgatggagggcccggactcattggctccgggaagctcgccttcggcggcagcaaggccggccgctacaacaacctcccatccgagaaggccgcgcccgtctacaaccacagcggcgccacgatcaacggcggctacgccaggagcgacaacgccggcctggcggcgttcaacaagatggggagctacttccacaacagtaacggcaacggcggcggcggcggggaggtgaagagctact

SEQ ID NO: 41350 - DNA, 249 bp, Zea mays
  unsure at all n locations
  Clone ID: LIB3062-008-Q1-K1-B3
gacgacgtctcgccgtgacaccagctgaggtgtatcacgtatatggacctgggatgaagttactaggccattcgtggcatncaacagcaaggtttagtccttgtttctgcatcacagcgtcagcatacttaaaatccctgtccctagcccatctgctgacctctctgacggtggcaagcttccactcgaggccatattcgtgtcctgcaactgcaaggttagctcacgcagtccaactgctgtggtcct

SEQ ID NO: 41351 - DNA, 435 bp, Zea mays
  unsure at all n locations
  Clone ID: LIB3062-008-Q1-K1-B4
ctctcgagggtcctggagcggcgaagcaagctgctcgccctccagcacctactgctgtgcggcctggccaggtaccacgcggggcccctgctgcagaatgctacaagatggctcttgctcatnctgagcagaatcagcttaccgatgcactatcttgtttggacgaagcattcttagcccttgcaaaggaccagtcacgtgaagccgacatcaaagcgcaggccaccatttgtgctcagtacaagatcgcagttgctctgcttcaagaaattgctcgtctgcaaagggttcaaggagctggtgctctcaatgccaaagaagaaatggccaggctatctcggcaccttgcttccctgcccatccaggccaagcacaggatcaactgcatcaggaccgccatcaagcggaacatggaggtccagaactacgcctacg

SEQ ID NO: 41352 - DNA, 445 bp, Zea mays
  unsure at all n locations
  Clone ID: LIB3062-008-Q1-K1-B5
aaaaatagccagacaatgagcttaacgcttctccagggctactcctccgctgaggacgaggacgatgccgccgccggcgccggcgctggcaccgagctgagcgagtctggtgattcgtcagccgaggaagccggatcggacgaagacgaggagtccgctcctccaaagccgccccccaagctccgccgccgaccaaaccctaaggggggagatgccggcggcagcgacgggggctccttgcttgcctccgcgctggaagccttcgctgatgtctcgggaccaccagattttttgaggcacagggttgccgagccagaagaagggacggaagccctcggtgtactcgatcgccgtgggaaaagagggagcaaacagccgncttcaggtgctgttgtggtggcaaaaccacagatagttgctatccgcgagcgagttaccacaactg

SEQ ID NO: 41353 - DNA, 384 bp, Zea mays
  Clone ID: LIB3062-008-Q1-K1-B6
aattcccgggttggttgcatccttgaatcaggtgttttaacggcttttgttcagtttattacaatgcagttccaaatgtgctctgtatttttgactttctgacttggaacaagaacccactactttggccgtgcaatattacatggaggtgcaaagtatagagcaaccggtagaggttttgtggtacgacatatcaagtttgctgagaactaccgtatttattctcgaagccattttgtgaaagggatggaagttgcacttttgttggtgatcttcctagcgtatgggtttaacaatggtggagcagttggctatattttactctctataagcagttggattatggcattgtcttggctttttgcttcctatttatttaaccca

SEQ ID NO: 41354 - DNA, 303 bp, Zea mays
  unsure at all n locations
  Clone ID: LIB3062-008-Q1-K1-B7
gtagctgtagactgtagttctgttcctccccactcactcctgcgcttcctcgccgcgcggttcctggtccctgatcctcctttggcttcgcggttcatggcgatgtggagggccgccgctaggcagctggtcgaccgggcgctcggctcaagggccgcgcacacgtctacaggcagcaaaaagatagtcggngtgttctacaaggccggggagtatgccgacaagaaccccaacttcgtcggctgcgtcgagggtgcactcggcatccgcggctggctcgagtcgcagggccatcaatacatt

SEQ ID NO: 41355 - DNA, 465 bp, Zea mays
  unsure at all n locations
  Clone ID: LIB3062-008-Q1-K1-B8
aattcccgggctgggaagcggaccaggcggcagtggccaaattcaagaaccacaagtggttcaggtctgtaaactggaagaggctggaggcccggcanatggagccaagcttccggccgaatgttgctggcaagacctgcattgcgaactttgacgagtgctggacgaacatgcccgtgcttgattctccggtggccagccctgttgcggccaacagcaactttgtggggttcagttatgtgaggcccgcaccgttcctccagaagccgagtccacttggctaaagaactacttccgtgatctgatatctaccccagagttcaaataactatctctgagtccgaatcctatgtatttcttcaagacattagtcatgggaatctaaccttattgttgtgttgtgggtaggccagccaagcgcctattgcttgagaacaacagcttggcaagtgacaatgtgcaata

SEQ ID NO: 41356 - DNA, 363 bp, Zea mays
  Clone ID: LIB3062-008-Q1-K1-B9
ccaagttcgattggagaggcgtcgctcctcgagacacctacatcgcgaatctcctcaaggactggaagtgtgcactgacagcgtccaaggctccctggaagatcgtcgtgggtcaccaccccatcagcagcgcctgcgggcatgggaacaacactgagctggaggagttgcttctcccggtcctcaggacacacggggttgacatgtccttgaatggccatgaccactgccttaagcgcgtcagcaccaaaaacagtcgttttcagctactaaccagcggcggcggttccaaggcattggctggcaagttcaagccaaccctcgacaaagtggagttcctctacgacggccaggggttcatgt

SEQ ID NO: 41357 - DNA, 440 bp, Zea mays
  unsure at all n locations
  Clone ID: LIB3062-008-Q1-K1-C1
gcgccgccagacactccgtagtctgtaccccaagcaccggctcggcggccgcggctaccatggcagggggnaagggacagaaggtctcccagggaaagaaaggtggtaagaaaaagaccggcgatcccttctctaaaaaagactggtatgacatcaaagccccatcggtcttcaatgtgcgcaacattgggaagactctcgtgtccaggacacaaggtaccaggattggctctgatggtctgaagcacagagtctttgaagtttgtctagctgatcttcagggtgacgaggatcaagcttacaggaaaatcaggctccgtgctgaagatgtgcaaggcaagaatgtgctcacaaacttctggggcatgaattttaccaccgataagctcagatctctagtaaagaagtggcagacattgattgaagcccatgttgatgtc

SEQ ID NO: 41358 - DNA, 388 bp, Zea mays
  unsure at all n locations
  Clone ID: LIB3062-008-Q1-K1-C10
ctcaaaaggttttagaacctaatattgtagttggcgcaccatcgtctgctaggttacctgaagcgtggtagtcagttaaattgtgttgttttaccagatggtcaggctaagagtagtactattggaaagggatttgtaaggattttggattcgatctctgctcccccagcttttgcaggagagttcccatctaaccaccgcatatccttggctcgtatttctggagcgcgccccatcacactccatgtttctgctgaagtgatccatataggaagtttagctgttccttctggcgcagataagtgggcgctgcanaaggatcaaagcatggagctgctcttctctgcagattttgaacctgatgcccgtatacattgtggctgcaaca

SEQ ID NO: 41359 - DNA, 220 bp, Zea mays
  Clone ID: LIB3062-008-Q1-K1-C11
tccttcattcctccatacacctatatcatcaatctcctccaagactaggaacaagcactaacttgcaaccaatgctcgcctccaacatcctctcttaccaccaccccatcatcatcccctgcagtcatcgcaacaacactgagctccacgacttccttctcccacatcctcacgacacacagttttcacatgtacttcaatgcccatgaccactaccttc

SEQ ID NO: 41360 - DNA, 317 bp, Zea mays
  Clone ID: LIB3062-008-Q1-K1-C12
attgtcacttccattttctcaataccttaagcaaggaccaatgtctcaagcccagccgcctcggtcccaagcccagtggaaacacgttaaatttcaggataaccaagctaatgccatgaaggaaccaggaactggtgggtatggctatgggacgaaaaatgacaagaataaggatgtggatacaatagcttcggacttcatcaagctgaagcacaaggcttgggcactccagaagagcacaaccatgtaccaaccttctacctaaaggtgctgcttgcagccttggatatttgcggagtgaagttaccatggcatcg

SEQ ID NO: 41361 - DNA, 437 bp, Zea mays
  Clone ID: LIB3062-008-Q1-K1-C2
ggatattgttcaggtatcatgtggaggaacacattcagttgctctaactcgagatggccggatgttgtcttatgggaggggcgaccatggtcgtctgggctacggcaggaagctgacgacaggccagcccatgggagtggacattgacctgccgccgcccaagacctgcagcagccgggacgggcagtggcaggcgaagtacgtggcttgtggcgggcggcacaccctggctattgtggtgtgggcagagaccaccgactgatcacggagtgatcaacttcctgaatcctaatctgggtgcaaatctgagtttgacaatcctgctagataattatagtgttagtgaaataagcataagttatgcgacattaggcatcataaatttttatgtatgtgcttaatttggcaaggaacaaaaatagtcgggaagaggactt

SEQ ID NO: 41362 - DNA, 216 bp, Zea mays
  unsure at all n locations
  Clone ID: LIB3062-008-Q1-K1-C3
ctgtccactttccccgtgcttctccgccgtcgatgccgcgttccagtgcgaagagactccgactcagatngccagccnctgggtccggccccaagtgtacccgctgttcgcggcgacaggcgtggccgtcggcatctgcgggtttcaactcttccggaacatcactggcaaacccggagtcaggggtaacaaagcaaggaaggcaactggtgtgct

SEQ ID NO: 41363 - DNA, 442 bp, Zea mays
  Clone ID: LIB3062-008-Q1-K1-C4
agcaattaaagatgacagactggaatatgcatcccttcaagcaatcctgtttgggccatttgttcgggctggcctatccactggtgactgggatgcaaaagctggcaacggcagtgctatttcagattggatcaccgctgtccctccagcacacaactcacagctggtaaccttcacacaagtatccaatggaaaggcatttgtcctctcaagtgcaaatggcaccctgacgatgcaagagcgacctgaagtcgacggcaccgacgccgccatccatgcgacattcagggctcaccctcaggaggactcgacagagctgcatgacatctacagcacaaccttgacgggaacttccattctgctcgaaccattcgacttgccaggaaccgtgatcaccaacaacctcactttatctgggcaaaagaacttcgaattccttttc

SEQ ID NO: 41364 - DNA, 239 bp, Zea mays
  Clone ID: LIB3062-008-Q1-K1-C5
gttgcctatgctgtaatcaacggagtcatagacgacagcttctttggggtgttcacgattgaacagatcaaggaagccgcgtccaaggtacgagtgtgaacccggggtcttgttccacaatctctgaacgtgtgttgtaggtggaaagttcataaacttagcagtaactcattgatccttgtgttctttatttctcgctgaattttgaccatagtcaaccgttcaaaagtcagtgcagc

SEQ ID NO: 41365 - DNA, 395 bp, Zea mays
  unsure at all n locations
  Clone ID: LIB3062-008-Q1-K1-B12
ccccgcagccgccctagcacccgcgacgagcaggatctgcccagttgctcttgcggtagttccggcaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcataagaagaaggctgatatcaagcagtagattttacatctagtttaccaagaattggacaccgncttagctatgttttgaattcatgtcactatatgcaatg

SEQ ID NO: 41366 - DNA, 235 bp, Zea mays
  Clone ID: LIB3062-008-Q1-K1-C6
tggctgcctcaaatattgagtaccgataattaatcatcagactcgcctggtccacttacgactacattttccacaacgccttatatatctatagcttaataatacacattactatcatcctctatcctctgactcacaagtctacctagttctgcttcttcactattctccacggatgaggtttatactaacaccatccactgcataaactgcactgaactataccatcatatca

SEQ ID NO: 41367 - DNA, 377 bp, Zea mays
  Clone ID: LIB3062-007-Q1-K1-H10
cagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacagggacgccgaggaggccagcggcgag

SEQ ID NO: 41368 - DNA, 419 bp, Zea mays
  unsure at all n locations
  Clone ID: LIB3062-007-Q1-K1-H11
aaaggattgtgaatgaacgaggaacttccatggttatgctcaaaaacatttcagaagccaagttgaagcatggcttaaagcctatagctgatgcctgcatcagagaggaacaaaaggaatatgttgatttcgagccatattatacacatatagtctgtcatgaatgctgccatggaattggacctcattctatcacccttccaagtggtaaaaaaacaacagttagaagggaacttcaagaattccattcagcattggaggaggcaaaagctgatatagttggtctctgggcactgaatntccttattaagaagggattgcttnctaagagcctgtcacaatctatgtatgtctctttcctggcttgctgcttccggtcaatccgctttgggctggaagaagctcacggaaaaaggaca

SEQ ID NO: 41369 - DNA, 361 bp, Zea mays
  Clone ID: LIB3062-007-Q1-K1-H12
cacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaagtcgctg

SEQ ID NO: 41370 - DNA, 299 bp, Zea mays
  unsure at all n locations
  Clone ID: LIB3062-007-Q1-K1-H2
tcccggcggatcatctagtagtattctagctctacctgctttccccactcgtgctctcgccattcgctcgaaccccgaagaactggcagtggcaggtgactagaggatcactactttgaactcattaaagtgtctaatgatggctgctgttttaaaaacaagtggcagtttttgtagtacacaacagcagcattttcagcaatcaagaagggatcagtttttgcatggttcttattcaaatttcaaacattgcanaagcaagaagataataagcctgctccactgtgtgctagagtgac

SEQ ID NO: 41371 - DNA, 267 bp, Zea mays
  unsure at all n locations
  Clone ID: LIB3062-007-Q1-K1-H4
tctggcacgcgagccctcaggccatcttcagggacccgntaggaagggcagacagtctgntcaggtgcgactgctacgagccgaacggngagccgatcccgagcaacaagcggcacggggccgcgaagatctttagccaccctgacgtcaaggctgaggaaccatggttcgggattgagcaggagtacacccttctccaaaaagacaccaagtggcctctcggttggccgctgggcggctaccctggccctcagggaccttactact

SEQ ID NO: 41372 - DNA, 332 bp, Zea mays
  Clone ID: LIB3062-007-Q1-K1-H6
ccggtcttgaattccgggtctgtcttgatatcatggtaaaacctgtataaaatataacaaactgaattgatggaccaaagatgtttcagttggaatagctcatatgatggttggacatgaacagaccatgaacaggaccatcatgatgaacaaaagaagcatgaacaaaccttcaacgaagaagcacagaaaatgatcaagagtgtcaaacaagcactgggaaatggtgaagggtgtcgagtctatgggacgttggatgtgcagagggtggctggtaacttccatatctcagtgcatgggttgaacatcttttgtgctgaaaggatttttga

SEQ ID NO: 41373 - DNA, 384 bp, Zea mays
  unsure at all n locations
  Clone ID: LIB3062-007-Q1-K1-H8
cccacgcgtccgcccacgcgtccgcaactggttgtgactttgtggtacagggcccgagaactgtggttaggaacaaaggagtattctactgctattgatatgtggtctgtgggctgtataatggctgagcttcttgccaaagaaccgttattcaatggaaaaacagagtttgaacagctagataagatttttagaacactcggcacacctaatgagaagatttggcctggctatgctaaattaccaggtgtgaaagtaaaatttgttaaacaaccgtataatagactaagggataagttcccagccgcttctttttctgggcgaccaatcctgtctgaagctggntttgatctatngaacagactgctgacttatgaccctgat

SEQ ID NO: 41374 - DNA, 326 bp, Zea mays
  Clone ID: LIB3062-007-Q1-K1-H9
gcggctggtggtacccattctcagctgtgttgcttctctgtacaaggtaagatttttgtaggtttatgtcaatgtccttggattacgtgctggtagtacccattctcagctgtgttttgcaattgtgagcatcggaatacaactatctatatgcattacgtgttaaatgccttggatttgttcatgtcatctatataaaaacatgtttcatgtttagcttatcatagtttatagttgagactgtaatactcatctctcacttgttttctgtcaaggtggtgcaacaaataccaattaatctggatgtttattgcttttctggtaaa

SEQ ID NO: 41375 - DNA, 375 bp, Zea mays
  Clone ID: LIB3062-008-Q1-K1-A10
gttcctggcggtgggcatgtggcgggtgtggtccgccgtcgcgcgcttcgccgccgagccgccggcgttccgcgtccgcacgtggaaccccctccccaaggggccccgcctgctggagctctacttggtggccggcggcgcgttcctggacatgtgcctggagctcggcggcggcatcctcgccggcggcgcccgggtcggcccggacagcctcatctacctcgagcacgccggcatgctgctcatgttcttcctcttcggcgcgctcgccctcctctcccagaagacaaggtctgtcgccacatttctccaccgtggatccgcgcactcttttctcgatggatcgatcgagttcccaaagttggtacagtttgt

SEQ ID NO: 41376 - DNA, 355 bp, Zea mays
  unsure at all n locations
  Clone ID: LIB3062-008-Q1-K1-A12
cttgctcttggatacaagtcggttatcatcccgattttcgctattgctgttagcatctatgtcagtttctccattgctgggatgtacggcattgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctntttggtgcctttgtcagcagagctggagtgaaggtcgtcgacg

SEQ ID NO: 41377 - DNA, 320 bp, Zea mays
  Clone ID: LIB3062-008-Q1-K1-A3
acgcctagcgacttgcagcttatttcaaggtatacgacatggctttcatctgtgttaacggcacgtaaagcttctggcggtagcgcaaattcacctgcagatgctgaatgggcactgtctatacctatagaagatttcatatatataatgcatgatgtgcatgctgtaattggcgagctttcagaatcaggcagcttcattggacatgtgaatcagttactagggtcatgccccattgaagtatttaatcttgtgaaacaaagtatactgcaagctgttgaacctttaaaggaactgttgcctgcaataatcaatgttat

SEQ ID NO: 41378 - DNA, 352 bp, Zea mays
  Clone ID: LIB3062-008-Q1-K1-A4
cacacgcacacacagacaagtgggttccaaagccaagtgtgtgtactagcaaccagctagctcgggcggcagcaggcagccatgatgtcggaggagaagcaccaccacttcttcaaccaccacaagaaggacgaggagcagcccgccggcgagtacgggtactccgagaccgaggtggtcaccggcaccggcgagggcgagtacgagaggtacaagaaggacgagaaggagcacaagcacaagcagcacctaggcgaggccggcgccatcgccgccggcgccttcgcactctacgagaagcacgacgcgaagaaggaccccgagcacgcgcacaggcacaagatcacggaag

SEQ ID NO: 41379 - DNA, 194 bp, Zea mays
  Clone ID: LIB3062-008-Q1-K1-A6
gagtgggagaagatgcagcagcagaaggagaaggagaaggagaagaaggcgatggagtcggatgcgtggctctcgcactcccactccgacacgcggacgccggagtcggagatcgacgacgacccgttcccggagctgggctctctgcccgcgttcgacgacatgggcgcagccccagcccctgccggcgtcgt

SEQ ID NO: 41380 - DNA, 282 bp, Zea mays
  Clone ID: LIB3062-008-Q1-K1-A8
ggatgggcgactgcttccgatggaccgtttgcctggggatactgcccggtgaaagaacaaaaacagacggacccaccctacttatgacgaggacccatacagctaactcataagtacaactacaggctcgccgggcaagcgctgaacctgagcactgtgggcgacccggacctggtggcgagagaccccgtggtagccttcaagacggccatctggttctggatgacgccgcagtcgcccaagccctcgtgccacgccgtgatgaccggcgactggaggccc

SEQ ID NO: 41381 - DNA, 318 bp, Zea mays
  Clone ID: LIB3062-008-Q1-K1-A9
ctttggtcaggaagcagcagagtatctaagtgaatgtttgctcagtagctcaaagcggtaccgggcaatgatcgaagaacatgatacttctggggggaaatcaaaaggacaaggaaccggaaatgttctcattgttactcttgttgatgcggagacagaaagtagcataaacgctaccatgcttgaggaagggcttgcccggctcgaaagaagcaggagatgggacactagggaaaggaaaacggttctccagaacctggaccagttccaggacaaggcaaagaaggaaaggctgcggatttggcagtacggagatgt

SEQ ID NO: 41382 - DNA, 355 bp, Zea mays
  Clone ID: LIB3062-007-Q1-K1-G9
cgcacacagccgccgggcgggcacagtgacgcggccacgcgggcgccggagctagggtttccctgatccggcagggccggggagccgccggaaaccgttgctcgatttcggcgccggaggcgcggcatcggtgtctccgaggacggcgggcgcgaggcgggctggggagctgaggcgcggcgccgagggctcagatctggtatgaccgacggcggcgaagacgggaatgctgcggcgcccagggccctctcgcgccggaggggacctgtgcgggccagcctcgatgccgacgagttcatggcgctgatgcacggctcggatcccgtcagggtcgagctcacccggctggagaacg

SEQ ID NO: 41383 - DNA, 232 bp, Zea mays
  Clone ID: LIB3062-008-Q1-K1-B1
agacgatcaagacaaatgtcatgggaactttgaatatgttgggtctggcaaagcgaattggtgcaaggtttttgttgactagcacaagtgaagtttatggtgatccgcttgagcatccacagaaggagtcatactgggggcacgttaatcctataggtgttaggagctgttacgatgaggggaagagaacagcagatactttaactatggactatcatcgaggtggtggtgt

SEQ ID NO: 41384 - DNA, 336 bp, Zea mays
  Clone ID: LIB3062-008-Q1-K1-B11
gcgcgtcactccaacgctctagtcgacgtgctgccgccggaggccgactccagcatctggttgttagcatcgtcggagaagcccaacgtcacttacaacgatattggaggatgtgacatccaaaagcaagaaatacgggaggcggttgaattacccttgactcatcatgagttgtacaagcagattggtattgatcctccaagaggggtgcttctgtatggtcctccgggtactggcaagaccatgcttgccaaagcagttgcacatcataccactgctgcttttatcagggtcgtcggttcagagtttgttcaaaagtccttgggtgagggccct

SEQ ID NO: 41385 - DNA, 387 bp, Zea mays
  unsure at all n locations
  Clone ID: LIB3062-007-Q1-K1-E9
atccaagatttctcagggctcattggaagtttttgaaaactgtggtcaacaaattgtttgagttgatgcatgagatgcatcctggagttcaggatatggcatgtgataccttcctgaaaattgttcaaaaatgcaagcgcaagtttgtgacacaacaggtgggcgagaatgaaccatttgtttctgaacttctgtccaaccttgctacaaccatcgccgatcttgagccacatcagattcatacgttttacgaatcagttggccatatgatccaagctgaatctgacaacactaatagggatgaatacctcaagagattgatgagccttnctaaccagaagtgggcagaaataatcggacaagcaagcccaaagtattgatatcctg

SEQ ID NO: 41386 - DNA, 402 bp, Zea mays
  unsure at all n locations
  Clone ID: LIB3062-007-Q1-K1-F10
cattcaagttattggcaacgaagagcccatttctgcttggaaagaagcaaagctacagttctatggtgggcctgatggtgctgccatgcagagaaggccattaatccatgttaaggattcagataatttagtggatgtggcactgactataatcagaaatgaaatatcttcagttcctatctttaagtgcatggcagattcatcaggggtgcctttccttaatcttgcaaccttacaggggatcttgaaatttctttgctcgaagctacaagaagaggctgagggctgttcccttctgcacaatcagcttctcagtattcctattggtacatggtctccacatacggngaggtcaagtagcaggcaactcagaactttgctactgagttctcctctaaatac

SEQ ID NO: 41387 - DNA, 195 bp, Zea mays
  Clone ID: LIB3062-007-Q1-K1-F11
attcccggctaagacaaacaaaaaataaaaaaaaaaaaaaaaaaaaaaaaaaaattttaaaattaaaaaaaaaaaaaataaaaaaatatgaaaaatagtaaaaattataaaatacaaaataaaaacattaataaatattaaataataaaaattatttaatctatatttaacaaaactctccccttttttaaaatc

SEQ ID NO: 41388 - DNA, 173 bp, Zea mays
  Clone ID: LIB3062-007-Q1-K1-F12
gaggacgccgcgctcgccgctatcattcgtttttggagactccttctagccccgccgccaccacaagaccaagagcaagactcggatcaaaggcgctcgccgtggtcgccgtcctggcagccgtcgtcctctcggttgcctccgctgccgatgctcccgcgcccagccccgtc

SEQ ID NO: 41389 - DNA, 404 bp, Zea mays
  unsure at all n locations
  Clone ID: LIB3062-007-Q1-K1-F2
gagctgcctgcaatccgccgctgagaagggaggatcggaagcgacgatgaggtcgtttgctcctgtctttctgtgggcggtcgtggcctggctggagctggcgggcaccgcgcagggcggcaacttctaccaggacacagagatgacctgnggcgatggccgcggcaaggtagtggacggcgggcgcgggctggacctgacgctggaccgcacgtncggctccgggttccagtccaagagcgagtacctgttcggcaagatcgacatgcagatcaagctggttgccagcaactncgtggcacggtcaccaccttctacctgtcgtcccaaggcgacncgcacgacgagatcgactccgagttcctggggcacgtgaagcgggagccctacacgctgcacaccaa

SEQ ID NO: 41390 - DNA, 362 bp, Zea mays
  unsure at all n locations
  Clone ID: LIB3062-007-Q1-K1-F4
tcccgggtttcaacattgcgagaactttcagtcatgagtccaaaaagcccacctgtttcaatgcgcttcattcctgaacanaatgacagaggagcgctgacagaagatactcatggattgtctgatcttttgtcccagcaaccatcaagatgtttgatcttgcggaccaatggggagctttctgtgcttgacatggacgatggacatgaacacactctcacaaattcaattgaactcttttgggtcacctgttcgcagtttgaagagaagggtagtcttatcaaggaggtttcatggcttgattacggtcatcggngtatgcaggtgtggtacccatcacatggagcagatcgttttaagca

SEQ ID NO: 41391 - DNA, 266 bp, Zea mays
  Clone ID: LIB3062-007-Q1-K1-F5
atctcgccggccacctcacgtcctcacctcgcgtggcctcccgttctgacttcggagtccctcgggctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagt

SEQ ID NO: 41392 - DNA, 350 bp, Zea mays
  unsure at all n locations
  Clone ID: LIB3062-007-Q1-K1-F6
gaacgacgacctaccctgtctgcggtctgcctgcaaccacacgcactggaagcatcgtgcgggtgcggcgcagcgagcgagaggagtggaggatgacggcgcccaagcctggcgggggagcggtggcagcggcgcgggcggcggcggcggggcccaggacggtgctcatgacgggggtgagcagggggctgggccgggccctggcgctcgagctggcgcgtcgcgggcacgcggtggtcggttgtggccgttccgncgagcagctccgctccctcgaggcagagatcacgtcaccgtcgcgccacttccttacccgtgccgatgtctagccagtggagctgattaatcgc

SEQ ID NO: 41393 - DNA, 326 bp, Zea mays
  Clone ID: LIB3062-007-Q1-K1-F7
gagaaacttccctcgacacctcgtagctgagagggccatacttcaatgtctgaagaaatgccctggtaaccagctacaagcgctcaagggtataccaagaacactgagaatgatgtacgtacatagttaccaaagttatctgtggaatcatgctgccagtatgagagtggaaaagtatggcatctcacaggttgtagaaggtgacttagtgtataacaaagaatgcccttcagaagaatcaacttccgtagatattctggaaactgatgatgaccatacaaattcaattgaaatcgatctatgttcttgagcacaaccaggaagaa

SEQ ID NO: 41394 - DNA, 348 bp, Zea mays
  unsure at all n locations
  Clone ID: LIB3062-007-Q1-K1-F8
ctcctatggaacctgtacagactcctcaatatgcactgttccaggatagcaagaagataggagaggttcagcatgctaatcagtttatgtttcctggatatgggtatcctcctgcatatccatttcctaccattccgttagtgtcaaacattcaagctgaaggctatcagacaaaaccagctggcacaagctaccgaacttcggaagattacctaaaacagtcaagttccacagaaatgtcacaagatataccatcaagaccactaacaatgacaccacanganaagataganaagcttaagcgccggcnacaaatgcaagcactgatagctattcaacaacaacagc

SEQ ID NO: 41395 - DNA, 307 bp, Zea mays
  Clone ID: LIB3062-007-Q1-K1-G1
cgcaagtcccggcgcgctctcctcagagaactctgtgagtcggcgcacgaggcgcccgtgctccgggccgatggtggacccgacgatttcgactggagggaccacggcgccgtcggccccgtcaagaaccagggttcgtgcgggtcgtgctggtcgatcagcgcgtctggagcgctggagggtgcgcactacctcgcaactggcaagctggaggtgctttcggagcagcagttcgtcgactgtgaccacgagtgtgattcatcggagcctgattcatgtgattcgcgttgcaatggtgggctaatga

SEQ ID NO: 41396 - DNA, 360 bp, Zea mays
  unsure at all n locations
  Clone ID: LIB3062-007-Q1-K1-G10
cacacacacacacacagacaagtggtttccaaagccaagtgtgtgtactagcaaccagctagctggggcgggagcaggcagccatcatgtcggaggagaagcaccaccacttcttcaaccaccacaagaaggacgaggagcagcccgccggcgagtacgggtactccgagaccgaggtggtcaccgncaccggcgagggcgagtacgagaggtacaagaaggaggagaaggagcacaagcacaagcagcacctcggcgaggccggcgccatcgccgccggcgccttcgcactctacgagaagcacgaggcgaagaatgaccccgagcacgcgcacaggcacaagatcacggaagaggtcg

SEQ ID NO: 41397 - DNA, 195 bp, Zea mays
  Clone ID: LIB3062-007-Q1-K1-G11
cccaagcatgcaggcaatgcgcatcatgtccgcttgcattggacgatgatgcaaattcgcatgtgattattgatgaatagtagaaagaggagtatactgagaacgagaacaggcatgcagacatatctgccgtgccttccgtggcatatctagagggagagaagaaagagtatggaggtgcaccatgaacaatca

SEQ ID NO: 41398 - DNA, 312 bp, Zea mays
  unsure at all n locations
  Clone ID: LIB3062-007-Q1-K1-G2
atggtggatcagtatgtgtgtatgactcggtgccaccagaaaaggctcaggcaatcatgcttatagctgcngctgcagcagctgcggcagccaccaaaggcagtgctgccactgcttttaatcctccaatgagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaaagctcgtacagccccgccaagtcgttcgatggcatggagt

SEQ ID NO: 41399 - DNA, 291 bp, Zea mays
  unsure at all n locations
  Clone ID: LIB3062-007-Q1-K1-G3
ttcccggtcaaatggagttactaagcccgccaagtagaaattgatttcacgcccncctttcagaaggatagatatgattaaagatttggaggcgatggccaagctcagtataccaaaagatctatcaagtgatgaagcgaatcgttatttgatagaagcatgtgtgaagtatgatgtgaaatgtccaccttcccaaacgacatcgcggttgcttgacaagttggttggccatttcttggaggagacatgtgtgaatccaacatttatcatcaatcatccagagataatgag

SEQ ID NO: 41400 - DNA, 420 bp, Zea mays
  unsure at all n locations
  Clone ID: LIB3062-007-Q1-K1-E8
catcaactgctaccgagttaagtatattctgagctcgtctgcagccaaaagcttccatttgcattgcgatgggggctctaggtcgtggcctgctagctggcatctgcgccgtcttgttagcagcagtggttgcccttgcccatggtgcggaacaggaaacagcgtcaatggtggtcggcttggccaagtgcgccgactgcaccaggaagaacatgaaagctgatgcggcattcaacggccttcaagtggctgtcaagtgcaagaacgccgacggcgtcttcgagaccaaggccctcggtgaggttgacaagtccggcagcttcagcgttcccctcccggctgacctcctncgcgaggactgcgagctgaagcaagactgcttcgngcagcttcacaacgcggccaacaagccatgccccg

SEQ ID NO: 41401 - DNA, 256 bp, Zea mays
  Clone ID: LIB3062-007-Q1-K1-G6
ggcgaatctctcgctaactgtcatcaatggcggccgagcccaagatcctagagctgtccaacggcgggatcaccgcgaggatctccaactggggcgccaccatcacctacctactcgtccccgacgcccaggggagtgtcgctgatgtggcgctcggattcgatggcttggatccgtacgtgaaaggcatgtcaccttattatggctgcatagttggccgtgtcgcgaataggatcaaggatggcaagtttacact

SEQ ID NO: 41402 - DNA, 302 bp, Zea mays
  Clone ID: LIB3062-007-Q1-K1-G7
agaaggaacgccttccgtccgctgaccgtgaaggaactaatgcgcgcgttcaacgatgccagaggtgatagttcgattggagtcatcattcttacagggaagggaaccaaggcgttctgcagtggcggtgaccaggcgttaagagattctgatggatatgtggacttcgatagctttggccgcctcaatgtcttagatctccaggtgcagattcgccgtcttccaaagcctgtcattgctatggttgctggttatgctgttggtggtggacatgttttgcacatggtgtgtgatataacaat

SEQ ID NO: 41403 - DNA, 314 bp, Zea mays
  Clone ID: LIB3062-023-Q1-K1-E2
cgggccacctcgttccccatccgctcaggccaatcaacagaagtgacgcgagcacgagcacacatcccctccctgcttcggttattcctcgttgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgac

SEQ ID NO: 41404 - DNA, 423 bp, Zea mays
  Clone ID: LIB3062-023-Q1-K1-E3
gttgattgctgggtatgatgacaatggcccacagttgtatcaggttgatccctcaggagcatacttctcctggaaggcatcagccatgggaaaaaatgtgtcaaatgcaaagacatttcttgaaaagagatacacagaggatatggagcttgatgatgccatccacactgcaattttgactttgaaagaaggatatgaggggcaaatttcctccaacaacattgaaatcggaattattccaactgaccctgaattcaaaggtctaagcccatcaaaaatcaaggatttcttggaagaagtggaataagttggctggtgatgatttactggttcaaaccagaatagcagcatcacttatgagcagccagcctgaaacttgtcttgggtttatcactctgtaaactgaattgctccagcgacatg

SEQ ID NO: 41405 - DNA, 424 bp, Zea mays
  Clone ID: LIB3062-023-Q1-K1-E4
tcggaagcgagcaaatactgttgagctgatgaagaagatgccccaagtgcgaccgcatctgcgccgagaagcgagcaaatactgttgagctgatgaagaagatgccccagatgctgctcgactacaagaaacgtaggtgggagaagaagatgaaagtggaggagagcggcaagaattgataccacgcggctcgtccagggtgcttctcttcctaaataaggtccaaactttatccaggagttttgcaggacggctagattctgacgcgtcattcccttggtggattccttctctcctgtgaagcgactttggacgcactatcctgattgtgatgctttcaaacacttgtgccactggatcgggatttcagtgagccccaattttgcagcactagtattttgttgagacaaatcagctataagca

SEQ ID NO: 41406 - DNA, 395 bp, Zea mays
  Clone ID: LIB3062-023-Q1-K1-E5
ggagaagcaccaccacttgttcaaccaccacaagaaggacgaggagcagcccgccggcgagtacgggtactccgagaccgaggtggtcaccgccaccggcgagggcgagtacgagaggtacaagaaggaagaagaagaagaggcagcaataaattaatcttaagcagctgtgggagcagcagtagtagtatcagttcaggtccagtagcggaaaaggcaggcagggcaaagatttgggaggcctttttgcaatccatctgccccatcataacccacttcgatctatccatgttagcagtacgtgtccgtccgtcctatagcatcatgcaggatgcaaaggttgccctgtgctggtgaatctttctgctatatactattctatttaattaacatat

SEQ ID NO: 41407 - DNA, 431 bp, Zea mays
  Clone ID: LIB3062-023-Q1-K1-E6
ctccgaacctcatcaaaacttgttgtaagcgatgacggtaagagagtcaaaaggcagcagccatttacagaatctgatttgcaggagctccagtcccggattgttgtagcagaaaatcttcctggtgatccctcctaccagaatcttaagaagatattttcagctgttggaagtttgatttcaatccgaacttgctatcctcagactccaaatggcactggtcctgcaactaatagatcttccaagttagatatgctttttgctaacaagctgcatgctttcgtggagtacgaaactcctgaagatgctgcgaaggctattttggagctcaatgatgagaaaaactggagaaatgggcttaaagttcggttgctgaatacttgcacggtgaagggagcaagcaaaggaaaaaacggaatgaatgaaactga

SEQ ID NO: 41408 - DNA, 393 bp, Zea mays
  Clone ID: LIB3062-023-Q1-K1-E7
gcgcccacgcgtccggttggctacctaggttctcaatgccacgtatttggcgtatgtatggaaataagtggcacattctaatcttcaattgtattattcgctctggcattgaagtgggtcgaaactgcattatactttctccgcaagacatgagcatggattatgttttaacaacagattatttgtactcttgattctttggttccatgctctcttcggtcatcttcatgttaatttgctttgcaaaccatttaatattaacagtgccgtcccctggaaatttccaaatggttatatgccttttgactattggaatttgcattataatttgcaaaccaaaaaaaacccttctttataaactacacacttgaaattcgaatttaaaaagggcaa

SEQ ID NO: 41409 - DNA, 432 bp, Zea mays
  Clone ID: LIB3062-023-Q1-K1-E8
caaagattgatcctactgcagctggtgcggtgtatgatagagaattcattgtttgttctttggacctactatcaggacttgcagaaggtcttggcgctggtattgaaagtcttgttgcacagagcaatttgagagatctacttttgcaatgctgcatggatgaagcagctgatgttcgacaaagtgcccttgcacttcttggagacctttctagggtttgcccaatacatttgcatccacgccttcaagaatttcttactgttgcagcgaagcaactgaaccctcaatctgtgaaagatgcggtatcagtagctaacaatgcttgttgggctattggagaattagcaatcaagattggcaaagaaatagcgcctgtggtgatcaccgttgtttcgtgcttggttcccattctaaaatccccagagggttcga

SEQ ID NO: 41410 - DNA, 418 bp, Zea mays
  Clone ID: LIB3062-023-Q1-K1-E9
agacaagaaaacacctgtatcaagccaacaaccgtctccctgtcacagtacaaacactcatcaccactcgagcactccacacaagagtaagcacgcaaacgacaagctcttttcatatctacaggaagcttatctttgggtcagggctagggatttctgtatacaccaactgcagcgactgcaggtaagaggggccgctcctatggttgatatgcactcaaaaaattacatgaatcagctacactcagtgaggtcgatcgagcagattaggaaacgcttcacacccagcaaatggttacagcttttattacctgtaccacagtctccggtgagaaaacatgaagccgtgtgatgttagtgaccaccaacgtggcgaggcaaactggtctacaattgtgtcgggctctgcttttggtta

SEQ ID NO: 41411 - DNA, 406 bp, Zea mays
  Clone ID: LIB3062-023-Q1-K1-F1
aagaaacagctctttgctctgtcacctactgaagttggaagcctgataagtcttgggcctgctgaatcctgtgaatttttccatgacccatccatgaaatcaagtaatgaaggaacggtgaaaaaatcgctgtcgatcactccacttggcagtgacagtggatactttgttaatataaccgttgtgaacagtgcaaaaaggactaatgatcgtctttcaatccctattacaaaaacttaatttggtgggatcccgacaaattttaattttggattggcacatattattggttgggaccaagctttaaccaattaacattcaacttcaagttcttcaacttgcaacaagcccaccgtagaacgttcacacccggatttcgaatgggaaaagtgaaacttccttttaa

SEQ ID NO: 41412 - DNA, 310 bp, Zea mays
  Clone ID: LIB3062-023-Q1-K1-F10
ttccagcttgtttcattattctgtggcgcctgcgatagactgggtggggggccaatcgcagcggaggaggacgccactcatctatgaccttcgaatctatcacacttaatagtcacatctgacccgctgcgcattgccaccttaaacatgtgtacctgaccctatgctccgcgctggccttctctgcactctgcgcgtaccttcacatccttctcaacgtccgaggcgccctaacgaccgtaggatgcgttgcctccattcactttctcattttcctgccccctttaccggaccaggataggaacctctt

SEQ ID NO: 41413 - DNA, 453 bp, Zea mays
  Clone ID: LIB3062-023-Q1-K1-F11
gaaaccgaggtctgatgtttttggtgagggtgcttcccatgatgacgaagagagcaaatctgtgtatgtcggcaacgtgccatcatctgtaagtgaggctgatcttgaaaatgagttcaagaaatttggccggcttattcctgacggtgttgctatcagaagccgaaaggagactggtggctattatgctttcgtggaattcgaggaactcagcggtgtacacaatgcgttaaaggcttcaccaattgaaataaatgggcggcagatatatgttgaggagaggaagccaaatagcggaataagaagtggaaggaggggaggacgtggccgtttcagtggtggaagccggggatattcgagaggtggaagcgacgagtacaatagtaaccgtgggaggtcaaacggttacggtcgtgctcctaaccaaaagaggggcatacttgggagccacac

SEQ ID NO: 41414 - DNA, 252 bp, Zea mays
  Clone ID: LIB3062-023-Q1-K1-F2
tctaagaactgtatctcctacctaaaaagttttctatttcactgacacatattttcacctgctatcgggacttgcacaatgtctttactctcttattaaaagtcttgttgcacaaaccattttgagagatctacttttgcaatgttacattgatcaagcatctgatgtcttacaatattccctcgcacttcatttacacctttctaggaattgccaaatacattttcatccacacctttaagaatttcttac

SEQ ID NO: 41415 - DNA, 317 bp, Zea mays
  unsure at all n locations
  Clone ID: LIB3062-023-Q1-K1-F3
ggcttctcctccccctccggttcgggttcgggttcgtgaggttctccggggttcgggggcntgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcataagtcccccggctttcgctttggcacctttttcaacgaagaagccaatccggaccgccttcaaggccttaaccggaaggaacctgaccggcccaacattac

SEQ ID NO: 41416 - DNA, 393 bp, Zea mays
  Clone ID: LIB3062-023-Q1-K1-F4
caaaggcgaggctggcaaggtaccagctgagccatgctgcaacctcatcaaaggccttgcagacttcgaggccgccgtctgcctctgcacggccatcaagggcaacgtcctcggcgtcgtcttcgatgtccctatcaagttcaatgccctcgtcaactactgtggcaagtgcgtgcccaagggctacatgtgtgcgtaagctccgcgcggttacacgctcgtagccgttcgcgtgcgtaattaagcatgcacctgcatggcacacatgtattgtgcgcctgctgatctctcctgtctcatttgggcaccttaagttctacagtcctagaaccatattccaaggcaattcttggcagttcacatgtattgtctcttggtgaatttctatttttt

SEQ ID NO: 41417 - DNA, 354 bp, Zea mays
  Clone ID: LIB3062-023-Q1-K1-F5
cccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgccttccaatgcctcatgaagcttcccggaaggcaccaccagttcaactaacactggcaacggcacaatttcaaataacttgtggaaaaacgaatcaaaaaacggggtggtggtggtgaatcggttgggccaccaattcctaatggttt

SEQ ID NO: 41418 - DNA, 387 bp, Zea mays
  Clone ID: LIB3062-023-Q1-K1-F8
attcgttatattgatttggaccggacgacgtcgacgggatggcgtagcatagcatggcctgcttgcgcaattgtatgtatgccctgtacttgcgcgtgtatgggtttcgctgtgcaaattttcgttggctcccccgattgattgaggcgtgtgtgcgtgtgtgtctcttctgaatctgaatggaaaatctgtaacctgagctaaaactgctcgtgtactacccaatagttgcttcaaactacgatggatttttttttcaaactatcacttccaaacacgcacaaatatgtactgtatttctcaatcaactaaggatcggagaaactggtttgtaaaggggattttgtaaacaccagtcaatcagacatgtaactcgacatgggccta

SEQ ID NO: 41419 - DNA, 447 bp, Zea mays
  Clone ID: LIB3062-023-Q1-K1-E11
cctgtctgtccatcagttggttgagaatgctgatgaatgcatggttcttgacaatgaagcactttatgacatttgcttccgaactctgaagctgacgacccctagctttggagacttgaaccacttgatcagtgcaacgatgagtggtgtcacttgctgcctccgcttcccaggacagcttaactctgacctgcgcaagcttgcagtcaacctgatcccgttccctcggctccacttcttcatggtcggctttgcgccactcacctcgcgtggctcgcagcagtaccgtgcactcactgtccctgagctaacccagcagatgtgggatgccaagaacatgatgtgtgctgctgacccacgccatggtcgatatctcacagcctttgtcatgttccggggcaagatgagcactaaggaggttgatgagcaaatgattaatgtccagaa

SEQ ID NO: 41420 - DNA, 112 bp, Zea mays
  Clone ID: LIB3062-023-Q1-K1-C5
cgacgcggacgatgccggacacccaagagaatgacctcgcgtaagccgactacaaggacggggcccaaactcaggcaaagatctatggcgaagacaaaggaagagacaccga

SEQ ID NO: 41421 - DNA, 408 bp, Zea mays
  Clone ID: LIB3062-023-Q1-K1-C6
acacagtacagcctcatcgccacttaccaccgtctaacgaaaaagcttcgacgagcgaagcgaaaaagatgccgccagctctgcggcgaacgatcctgctggccgcggcggcggcgacgacggcggtgctgctgctgtggccggccgtctgcgtcgcggacgacgacggcacgacgttcccgtcgtcggcgttccccttatgcccgacgcggacggccggggtctccacggtgccgttcccctggtcgacgccgacgtcgtcgtcagtggcggtgttcccgcaagatccggggttcttgacggcggacgcttgcgccgagccacggctgccggtgctcgctgggatctctgatctattggcggtattgcagagacttgctcgcggttgctgccctggactggatgcat

SEQ ID NO: 41422 - DNA, 360 bp, Zea mays
  Clone ID: LIB3062-023-Q1-K1-C7
ccccagccccgagatctgctcaacaatggcgacgcggcgccacatcctcctgctcgccgctgccttcgtgtcccttctcgcgctcgaggctgtggagggcctcgaagaggggccccgcgggcgccggctgctggtcctgctggacgacctggccgtgcggtcgtcgcactcggccttcttcggctcgctccaggcgcgcgggttcgatctcgaattcgccttgcccaccaacccaagctcttggttgaaccgttcgggccggacccttaccaaggccttgggccggtcggccccttcaacccaaggtttgggggatccatggacccaaaccccagtcctggaattaatggagcctggcct

SEQ ID NO: 41423 - DNA, 391 bp, Zea mays
  Clone ID: LIB3062-023-Q1-K1-C8
aagcgttggatctcggtgcccaagatttctgctttcgagtgcttcatgtgctcagacaaggaggctttggctgtgggcaccgagctacttgtgtttggaatggcacacattgtctttagatacagtatactgacaaactcttggacacgaggtgaggtgatgaattcttctcggtgtctatttgggtcagcaagcgttggggagaacgcatatgttgctggtggcactgattcttttggcaggattctcagctcagcagatctgtacaacttggaaacacatacttggacaccacttcttagcatgaataaggcacgtaaaaattgctctggggtgttaataaatggcaggttttgtgtcattggtggtgtgacaaacaacaacatgatct

SEQ ID NO: 41424 - DNA, 415 bp, Zea mays
  Clone ID: LIB3062-023-Q1-K1-C9
gtacgctctcagtctcgcccacggcacctggccggcgaacgacacatgtacgcttcgtcaatggctcaacaccggcagcgcaacttccagtcgtttgcaaggacgtggctgcctctcgccgatatgatcttgatgtgcttcgccgcttgcacgacggcgcagcagcaaccaccgtcactgacgcagtctacgacaacaggcactgtaccgataccgagcgtgccagcgtgcctgccaacgcaggccacgctgtcgccgtgcgtgagctacctcatcggcaactcgatgtagccgatcacggagtgctgcgaccagatactggccatgtttcagtctcaggcgccctgcttgtgcgccgctttggcatctgcggtgcccgcccatgcactcgggtacgcgctcggtcagctgctgc

SEQ ID NO: 41425 - DNA, 411 bp, Zea mays
  Clone ID: LIB3062-023-Q1-K1-D11
agagatcacaaaagctggttttgtggaacctacccctatccaatcgcaaggttggccgatggcattgagaggccgcgaccttattggcattgcagagacaggatcagggaaaactcttgcttaccttttacctgccattgttcatgtgaatgcgcagcctattctttcccctggcgatggtccaattgtcttggtgttagctcctacacgtgaacttgctgttcagatacagcaagaagcaaccaagtttggtgcatcatcaaagataaaaagtacttgcatatatggtggtgtgccaaaaggtccacaagttcgtgatcttcaaaaaggtgttgaaattggtatagctacaccaggacgactaattgatatggatgaatcacatcatacaaacttgcgaaaggtcacata

SEQ ID NO: 41426 - DNA, 456 bp, Zea mays
  Clone ID: LIB3062-023-Q1-K1-D12
cccacgcgtccgctgttacttctccctccgtcgccactcccctcccattcaccgccaccgggaattccataccgtgctccgccacctctgctgagagcgagaagagatggcaggcaagggtgatgggccggcaatcggcatcgatctcggcacgacgtactcttgcgtcggcgtctggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgactcctctgtccagagtgatattaagctgtggcccttcaaggtcattcctgggcccggtgagaaaccaatgatagttgttcagcacaaggtggaggagaaaca

SEQ ID NO: 41427 - DNA, 414 bp, Zea mays
  Clone ID: LIB3062-023-Q1-K1-D6
ctcacaattccagctcaggccaccagcaagcacatcgcaaaggcagcaagtaagcaagcgagtaaccacaccacaactacagggaggaagagcagaacagaggcagagagagagagagccatggcggcggtcgccgtgagcgggaggctgcggacgctggggcgcggcgcgtcgggcgccgtggtgtcgctggcgtgggacgccgcgtcgggggagctggtcgcggtcaagtcggccggcgcgagcggcgcggcggcgctgaagcgggagcacgcggtgctggccgggctgcgctcgccgcatgtcgtgcgctgcgtcagcggcggcgaggcggcggcggcggaagaggggtcttcgtaccagctctttctcgagtacgcccccggcgggtcgctcgccgacaaggtggcccgg

SEQ ID NO: 41428 - DNA, 147 bp, Zea mays
  Clone ID: LIB3062-023-Q1-K1-D7
cggacgcgtgggtggtgatagaaccaataaggatgtttgtagctagcttataatgagggcgtgaattgcagcttaatttgcttcactcccctcctattttttattaccttttctctttttgcaaagcaatattctccttacaatgtc

SEQ ID NO: 41429 - DNA, 414 bp, Zea mays
  Clone ID: LIB3062-023-Q1-K1-D8
gcgagacgcgagtcgtcctcctctctgtcttcgctcggcgatctatcaaggagggtgagggggagatggcggagaatccgcagctgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccacttgtgtttgtgcatggtgagaagttcaatcagcccatatttcactgcaacaacatctctggattcgttgaaccagtcgttccagacaatcagaacagggccctgtactcaactcacaccttcaagatct

SEQ ID NO: 41430 - DNA, 463 bp, Zea mays
  unsure at all n locations
  Clone ID: LIB3062-023-Q1-K1-D9
ctttaattttcagaatatccgggataaatgggctggccaaaggggaaatagaaacaaaattacaaaagctaggacacctgatgttgaagataggggtgaacccagtacaaaagattccactgctgcagcaatgaacatttctggagaaggccctttcataaataataaaacaaattggttagcaatacagaggcaattgtcacacttggagaggcagcaaactagtctcatgaacatgttgcaggatttcatgggagggtctcatgacagcatggttacattggagaacagagtacgtggtcttgagagagttgttgaggaaatggctagagaaatatcactctcctcaggcaggagaagtggtggtccagcgttgggctttgattcatctnctggcagatcatctaaacacaatggtttccatgaatattctaattcgaaatatggaaagaagtgtgatgga

SEQ ID NO: 41431 - DNA, 236 bp, Zea mays
  unsure at all n locations
  Clone ID: LIB3062-023-Q1-K1-E1
acctgnacagaataaatcaatccctggcttcgccactgagagagaatatctcccgaaaatcatagggccaggaaaaactttccagtcaactaaagttggcgacatcatgactggagaggacaaactgatcacagtgaatcccgacaccaaagtcctgcaggcaatgcagctcatgacagaaaaccgcgtcagacacatcccggtgatcgacggcacggggatgctggggatggtct

SEQ ID NO: 41432 - DNA, 398 bp, Zea mays
  Clone ID: LIB3062-023-Q1-K1-E10
atcgcagctccgctgccctgctctccaccttctccagacctccaccatggacgagccgccggtccatccaccgcccctcccccatgccctcaccaccgccgagtaacacctcctcgccgccgcccttgccttgacggattcgaataattcgtggaagagaagttcttattcccttgccttcagccgtactgcggcggcggaatctctctctggacttctccccgatgtccgtggcggccgagcaggaggtggcgccggccgtcgtggccgtggccgtggccgaggcggaagagtgggaggtgtgcgcctgctgcgggctcagggaggagtgcacgccggcatacgcggccggcgtgcgcgcgcggtacggccggcgctggctgtgcgggctctgcggc

SEQ ID NO: 41433 - DNA, 262 bp, Zea mays
  Clone ID: LIB3062-023-Q1-K1-C4
gaattcccgggcgccggcgctgtccaacggcgcgctgcgggtgggcgccggcgttgcgctggcgctcgcgctgggaggcgtgtcgtggactgcgcgcggcgggagcgccggcgccgggcccgggcccgtcacgcagccggccatggtgtgcgccctcaacgccgtgaccgacgccgcggtccgcgccttcgcggagcagcgcggctcggcgaccatgaagacgagcgtggacgcgctctcggactcgctgttccgtcgggag

SEQ ID NO: 41434 - DNA, 412 bp, Zea mays
  Clone ID: LIB3062-023-Q1-K1-B10
ccggcagcctcctggcgggtacgacggccttcatgatctccggttgttgaggttgaggcctgcgtacccggcagcctcctggcggcgacagcagcattttgctgggctagcgtgcatatgaatcttgctgccctatgccgccgccgcacaggtggttggtccgtcagtgtgtggtcttgttttcgtggtcaggccatgtgtcccatctccggtccttcagatgatctggttcgcatctgtcttgtgtatggttttgatatgtgttggttgtgacatgccccatggaacaaccctatcgctatgctgttttgttgtgtacaatggatgacgtgtgctgccgttttgttgtgtgtacaatggatatgtctggttgttgaataagaagaaattggtatatggtaccaatagtccg

SEQ ID NO: 41435 - DNA, 471 bp, Zea mays
  Clone ID: LIB3062-023-Q1-K1-B12
ctcagatggttctgcctgcaagaagctagagtcatccacggcagcctcgttcgcagccaaagtttgggtgtcgccgtcagaacgatacgccattgtccctgacgagaacgtccgtaaagcaggcggaggcacggcacgaggcaacggcgccgacgcgaacgtgccggagaacgacgtgaagaggatgcgcgtgcagtcatcgtagtaggtcttctactaccgtgcactccaccccacccccgttaaccctactactagtagtaagtactacgaagaaccggtgccccatctagcggcgcccgatttttgtgcgttacgttctgcctaaaagtgctttccgtcgacggacggacctcctggtgttgagatggtagcggtagcactgcctcgcggcgatggtgtgtgtgtgttgtgacgtgattcacctcttagagtagaaaggtggctagcccaatcgacctgtgtgtgttg

SEQ ID NO: 41436 - DNA, 408 bp, Zea mays
  Clone ID: LIB3062-023-Q1-K1-B3
gctcgatcgagactcgagaggcatggtgagtgtaccggaggagaaggccaagctgggcttcggcggactggtgggcgacctgagggaggtgtacgagagcggcaggacgcacggcctggagtgtctgcaggcgcagctcaagagcactcgtcaggctactggaggagaatgatgaggagatcttcaacatgctacaactagaaccggggaaggcaccgtgccaaggcctatagagacgaggttgggcttctgaaaagttccgattgaaacaagtgcaaaaacttaagaaatgggccggttccgaaaaaggttaaaagccaattggttgctttccagacaaagggcttgttgttccaaagacggttggggtcatgcttcaattattatgctggaaccttccaataaggc

SEQ ID NO: 41437 - DNA, 261 bp, Zea mays
  Clone ID: LIB3062-023-Q1-K1-B4
ctcgctccaagcacaccaccactccacagtgcacttcactctacagcaacgacagaagagtgagcagcagacagcagcagctgctgccatggaggcgtggagatctctcctcgcgagcttcgtgctcgccgtgctggccgcgcaggccttggtggctgtggtcgagtccaggaccggccccgtggagcaggcgagccaagcaggtgacgacgtgaagaagccggactgcgtgccggtgatagacccgcgctcggtcccggg

SEQ ID NO: 41438 - DNA, 390 bp, Zea mays
  Clone ID: LIB3062-023-Q1-K1-B6
cgtggtcgcgccctcgcaggcggacgacgtcgccgccgccgccgccgccgccgcggcggcggcgatgtacggcggcggcatggagttcgaccactcgtattgctacgacgacgggatggtgagcgggagcagcgactgctggcagagcggcggcggatggcatagcagcgtggatggcgacgacgacggcgccggcgacatgacgctctggagctactgagctgtagagtctgtcttcagcgcaggaggttgggagaggagaccacgctctggagctactactggacagggaagaaagtgggggagccgggagcgagttcgaatttgaattcagaaactctgtactggcactggcacacgcggggaacgcgccacgcaagagcgagcgct

SEQ ID NO: 41439 - DNA, 293 bp, Zea mays
  Clone ID: LIB3062-023-Q1-K1-B7
atctattacacaactctcatacatcatgtccaccttgcaaagggttcgttgatgcctgatgtagacagcacagtcgttatctgtgtgaggggatcgttgtgattcaaaaacgtgcgaagatactaccattactcgtacttggactaccgttctgtgcatagtctgaaggctgctatcaatagaggactactttagctaatgggatgcagactgactatgagactgatagctgacaatgaaacttccttgctcgaaaatggatggcattcccattcggtatttgggaaagaatt

SEQ ID NO: 41440 - DNA, 354 bp, Zea mays
  Clone ID: LIB3062-023-Q1-K1-B8
cgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactacctcaaggacgcggtgctggacggcggcatcccgttcaacaaggcgtacgggatgacggcgttcgagtaccacggcacggacgcgcgcttcaaccgcgtgttcaacgagggcatgaagaaccactcggtgatcatcaccaagaagctgctggacttctacacgggc

SEQ ID NO: 41441 - DNA, 444 bp, Zea mays
  Clone ID: LIB3062-023-Q1-K1-B9
cgtccttctcttgccgacttcctcgcgttcatttcttcaccccacccgccccccaacgccaaatctaggagcaaaggtccggaaccttctagccgcacctagggtttggattggcgccgagcatggcgtacgtcgaccacgccttctccatctccgacgaggacgacctcgtcggcggcgccatggggggcccgcgcggggcgcccgtgaaggagatcgccttcgccgccgcgctgctcgccttcggggcgctcggtaccatcggtggcctgctaatggccgtcaaccgcgtcggaagggaccgcgcgcacggaattttcttcatgatgttgggcattgtaatgttcatccctgggttctactacacaaggatcgcctactatgcttacaaaggttacaagggcttctctttttcgaacattccaccgatctgaaagagtgtgc

SEQ ID NO: 41442 - DNA, 408 bp, Zea mays
  Clone ID: LIB3062-023-Q1-K1-C1
cccacgcgtccgcttccgtgatgcccaagagaaggtcctcccgtatgctgactacatggtcggcaacgaaactgaggcaaagatctttgccaaagtcagaggatgggagactgagaatattgaggagattgctttgaagatctctcaacttcctttggcttcaggcaagcaaaagaaggttgctgggaatacctaaggtgcttattcaatgggtggtggttaagattggaaaggggaaaccttccctgggaacctaatggccaaggggaaacttggtgacaccaacggggcaagtgaagctttcggtggaaggtttcttttacaagtgggtctaagccagggccttgaaaaatgccttaaggccaggtggtattccggaaacgttatcattcaacggccgggctggac

SEQ ID NO: 41443 - DNA, 416 bp, Zea mays
  Clone ID: LIB3062-023-Q1-K1-C10
gacgacggcatcgagcaggtcctcggcaccatggacccgtcgacgcacaacgtgacgcgccacctgtggccgtggacgaagtcccaggaggctggcttcgcgcactgcgctctgagggcccgggagagctgcgagtgggtggggttcatcgacgtcgacgagttcctccacttccccggcaaccagacgaccctgccagacatcctgcggagctactcgaacaggccgcgggtgggcgagctgaggacagcatgccacagcttcgggccctcggggcggaccagaatccccaagcaaggcgtgacgacgggctacacctgccggctcgcggcgccggagcgccacaagtcgatcgtgaggcccgacgcgctgaacccgtcgctcgtcaacgtggtgcaccacttccacctgaggga

SEQ ID NO: 41444 - DNA, 395 bp, Zea mays
  unsure at all n locations
  Clone ID: LIB3062-023-Q1-K1-C11
gtcaccaccacatccgcctcttccgcgccgcgatggcccgctctacacaaaccctgacctagcccgtccgcgcctcctcctccccaccgcgcattcgcctccctccgttgcctcgctaccaaggtcgagatcgtcgagatcgacctcaccgaggaagacgctggctcctcggcccacggctcctccccctcgtccccatcgatcgaggtggttgggatccggcgcctggaggaggccatccacggcgtcatggtgcgccgcgccgctcccgattggctgcccttcgtgcctggagggtcctactgggtgcccccgctgcgcctnccgcacgaggtcaccgcgtttgtcggccggatcgcggcctcaggaggcgcctncggggtcgccaagttcat

SEQ ID NO: 41445 - DNA, 445 bp, Zea mays
  Clone ID: LIB3062-023-Q1-K1-C12
gggaggtggtgaagaagcaggcacaagtgatgctgctatgacactcgtgccagaacctgtggcacctgagacggtgggttcgacggcggtcgttgctgtcatctgctcctcacatatcattgtctccaactgtggagattcacgggcagtgctctgccgaggcaagcagcctgtgcctctgtcggtggatcataaacctaacagggaggatgagtatgcaaggattgaggcagagggtggcaaggtcatacaatggaacggttatcgagttttcggtgttcttgcaatgtcgcgatcaattggtgacagatatctgaagccatggataattccagtcccagaggtaacaatagttccgcgggctaaagatgacgagtgccttattcttgccagcgacggcctctgggatgtaatgtcaaatgaagaggtatgtgaaatcgctcgc

SEQ ID NO: 41446 - DNA, 379 bp, Zea mays
  Clone ID: LIB3062-023-Q1-K1-C2
acccacgcggccgcgcgatgctccgtctgctcgcttcctactacgtcgtccggtgccagatggagggccgggactgccggtacgagcgccgctactccgccgcgcccgtctgcaagtggctcacccccaacgaggacggcgtgtccatggccgacctcgcgctcatgaaccaggacaaggtcctcatggagagctggtactacctcaaggacgcggtgctggacggcggcatcccgttcaacaaggcgtacggtatgacggcgttcgaataccacggcacggacgcccccctttacccggtgtttcaacaaggcctgaaaaacccctccgtgatccttacccaaaaactgctggacttttacacgggctttaaggcctt

SEQ ID NO: 41447 - DNA, 415 bp, Zea mays
  Clone ID: LIB3062-023-Q1-K1-C3
gattcctggaccaagtcattacagcttggtcctttattttgtctcaaactccttgaagaaaggatcgctgttgcagcgttttgccgatggtgatgatgattttagaaacagcagactgaagcttatcccatctgttccaaaggggtcttggatagtgcggcaaagtgttggaagcacaccttgcttgctggggaaagccgtggactgcaactatttgcgtggtcctgactacttaaaagtggatgtaaatatcggttcgtccgcggtagccaacggggtcctggccttgtggttggccgttgttacaactttggtagtcaccttggcgttcttattccagccaaccacttccaacaggttccaaaagcagttcttaggccctgcccggttgtaaaacatggaactttttgcggcc

SEQ ID NO: 41448 - DNA, 396 bp, Zea mays
  Clone ID: LIB3062-023-Q1-K1-B1
agcagaagaagagggtcgaaaagcaagactaaagcagattactgaatttaaagaaagctgcacaggttggtgctttgtccagatatatacagcttgctgcaaaggccttgcccatcacaagaactaaagctgaccttccacaaaaatctagcaaagccgatcttggagagcgttagtagcatcgcttcctcaagtacaaccagccgcacaaatattgacgagaaccttccttgtgagaaaccttctaagcacccttgcaaaactacaaaggtacttccaatttctcaagggaaaggaattggccatcttgaaaaacatccagatgacgaaatccttgactgtctacttgccaaaaactctgattaacccattgatgttagcaaggcaaataccatg

SEQ ID NO: 41449 - DNA, 173 bp, Zea mays
  Clone ID: LIB3062-007-Q1-K1-C9
cccaaaaggcagtacaatgcttgaacgatatagtgaccaatgcactgattcatgcccaagagtggcttcaggacatgtcagccttgaagaaccatgccatcttccggttttgcgcaattccccaaataatggcaattggaacatgtgctctttgctaccattaccagcctttc

SEQ ID NO: 41450 - DNA, 263 bp, Zea mays
  unsure at all n locations
  Clone ID: LIB3062-007-Q1-K1-D1
gaaatcttgcaatccacccctcgaaagaaaacctcaatcaacaccagaagctttcgatcccaccgaggaagaagagaggaatggcgtccgangaggagggagtcgtgatcgcctgccacaccaaggccgagttcgacgcccacatggccaaggccaaggaggccggcaagctggtgatcattgacttcacggccttctggtgcggnccctgccgcttcatcgcgccactgttcgtcgagcacgccaagaagttcaccccagct

SEQ ID NO: 41451 - DNA, 388 bp, Zea mays
  unsure at all n locations
  Clone ID: LIB3062-007-Q1-K1-D11
cttttagtttttcaagctgataggtgctggagggaggaaggtgccgaagttatgctagaactatcagaaagcaataagtggtgtatagttgtgaagatacaaggtgttactaggtacttgcttaaaccttcagatatgaggtcatatgtcattaatcgtcatactcaatcctacatgtggacagttgatgatgcatggaagcttgagttcactgataggtgggactggctgttattcaaagagttgcatgttgtgggctgtgagcgtaattctcagggaaaggcaatcccaattcctggggtacatgaagtttctggtgagatggaagggattgttacagatcctttcttacgccctgtgccagactatatcangatggtggatgatg

SEQ ID NO: 41452 - DNA, 318 bp, Zea mays
  Clone ID: LIB3062-007-Q1-K1-D12
gtcccgggcatagttcacgtcctgaagaacgggagcatggaggcacgggagaacgctgcggccggactctgcagcctgtcggtggtggacgaatacaaggtcacgatcgggggcacaggagccatccctgccctcgtggtcttgctgagcgagggcaggcagcgcgggaagaaggacgcggcggctgccctattcaacctttgcatctaccaggggaacaagggccgcgccatacgggctggcctcgtgccactcgtcatggggctcgtgacgaaccccaccggagctctgctggacgaggccatggcgatcctgtcg

SEQ ID NO: 41453 - DNA, 326 bp, Zea mays
  unsure at all n locations
  Clone ID: LIB3062-007-Q1-K1-D2
cttggaattgagcctttgatgatggaagctcttgagaagattgagaaggacattaagaaaccactgttgaggagcgacaagaagaacatggccaccctcttggcagagtttgacaagattaacaaaaagcttggctttcggaaggaggatcttcccaagatcgaggaagagcttgaattggaaattgccaaaagtgagctgactgaacttaagaaggaatgcgttgaagcaatggagactcaactcaagagggaggagtttcaagatgaggagatgcctgatgtcaggaaaatggacatcagaaactttctgtangcctgatcgac

SEQ ID NO: 41454 - DNA, 248 bp, Zea mays
  unsure at all n locations
  Clone ID: LIB3062-007-Q1-K1-D3
ggcaagggagaaattgaagaagaaaattgctacatacaaaaatggtgttgttattcggaaacagggggttgaaagggcaaaagaggcttttgctaaagatgaagcagatttagcaaaattgaagggcgaagagaaaatgctccaaggacttgttgataaactcaaagagcaaaagaaattaatagagaatgcagaggaagaagagcgtttaaaaaaaaaaaaaannnaaaaaaaaaaaaaagggcggc

SEQ ID NO: 41455 - DNA, 291 bp, Zea mays
  unsure at all n locations
  Clone ID: LIB3062-007-Q1-K1-D5
acggggtccaatttgctgtcatgataccaacggtctcggagctttttgggctaagggacttcggggtaatgtacaacttcatgctgttagtgaatccactcggtgcattctttttctcagctcttcttgctggctacatctatgacaaggaagcagcaaggcagcacccaggtgtactggagccttccgactgctatgggcctgactgtttcagattgactttctatgtctgcgccgtcgtgtgttgctgcggtaccctgttgngcgtgttcttcatatcgaggataaagc

SEQ ID NO: 41456 - DNA, 326 bp, Zea mays
  unsure at all n locations
  Clone ID: LIB3062-007-Q1-K1-D6
gtcgctgccagccgccgccgcgtccgcctcgtcaagcgcagcagccgccgcagcacgtcgctctcgtgatctcagccatggcggangtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggtgcgctactccaagaaagcggttcgcaaggcgcagtgcccgatcgttgagcgccttacannactcctcatgatgcancgggcgcaacaaccggcaagaaggtca

SEQ ID NO: 41457 - DNA, 247 bp, Zea mays
  unsure at all n locations
  Clone ID: LIB3062-007-Q1-K1-D7
ggccgacggcaccacgatgggggagatcgtgatgcgcgggaacggcgtcatgaaggggtacctgaagaacccggaggcgagcgcggaggcgttcgagaacgggtggttccactcgggcgacctgngcgtgcggcacggcgacgggtacgtcgaggtgagggaccgcgccaaggacatcatcatctncggcggngagaacatcagcagcctggaggtggagaaggcngtgtacctgcacccggcggtg

SEQ ID NO: 41458 - DNA, 382 bp, Zea mays
  unsure at all n locations
  Clone ID: LIB3062-007-Q1-K1-D8
gcatccagatcgaggaggccaacagcgccaagaagctggtggtgattgacttcactgcaacatggggtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggaaggcgacgtcaaggacagggtcgttggcgcagcaaaggaagagctagcaaggaagcttgaactacacatggcctcgtagatcagtgatgccgtaatgtagtattcgcctaaataagaggacgcctngcctcaactctgaaaaaactaatgcttctgtgatggtaa

SEQ ID NO: 41459 - DNA, 376 bp, Zea mays
  Clone ID: LIB3062-007-Q1-K1-D9
atcaattcaagatccaatctttgctgctgccactcggcgatccgatcgttctcgatcaaggtcggtggccgtggctcgctgccgccatcacctcctcctccttcccgtcttacttgccttggctgctgctgctgcgcggcaggcgcagagtcatggggaagcctccgccgtcttcatcgatgcctcgtcgcaccgctaccttcgggaccagcaagccgaccaccaggacgcttcaatgtcgttaaatgaagtttctgcggttgtttctgtcttgcttggttttgcaccgtcaacatccctaccagctatttcttcttcgaagttgaacaaagttcttcttcctaatccatttgatagaccgcgtgctgttttcctc

SEQ ID NO: 41460 - DNA, 265 bp, Zea mays
  unsure at all n locations
  Clone ID: LIB3062-007-Q1-K1-E1
cccgctcgtcctcctcctctcctcctggacagcagagcacagcacaacacaccgagaaagaacaagcggccgccagcggagctcagaaccaccatcagcagcagcagcacacccggtcaaccttccacacacgcgcgcacacacacatggcgtcgcagcagaggcaacagcaagcgggagcggcggcggcggcgtccttcgccgtgggcttcgaggactatcctgccgtgatggcngagcggctgggcgaggaccggctgatgcg

SEQ ID NO: 41461 - DNA, 376 bp, Zea mays
  Clone ID: LIB3062-007-Q1-K1-E10
caagtgggcgacaaggtccgttcaagaaagcttaaaaactcttgcggtcctgaaactatggaaagccctgatggaaccatagttggcattgaggacgatggcgagcgtgacgcttacgttcttgtacgagtccacgcgctacacaaccctttaaaggttcgcttttcaacggtggagagggtaacatatggttttgctgctggagactgggtgcggctgagggaggaggacaagaagcgctctcaggttggcattcttcacagcatcgaccgtgacggtgcagtggcagttggtctgataggagtggatcccccttggaagggcaattattcagacctccagatggctgaagcctactgtgtcggacagtttgtgc

SEQ ID NO: 41462 - DNA, 410 bp, Zea mays
  unsure at all n locations
  Clone ID: LIB3062-007-Q1-K1-E11
ctccgctgggccaccagctttgaccgccgcctcccttcccctccgctactgctcctcctcaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccanagaaacgtgagatttatgatcagtatggtgaagatgcccttaaggaanggaatggcggtggaggat

SEQ ID NO: 41463 - DNA, 326 bp, Zea mays
  Clone ID: LIB3062-007-Q1-K1-E2
ttcccgggtccaacgccatccatcccgacctcgcaacgcaagcaaagaaagcccaggcaggcgtgtgcacggcgcggcggtgcaaccaagggtgggtgaacccgcagagaggggcagctagcttccttccttcccaggcgcgcgggagaggttagccgccgtataagtagacagccagccagccatgtcgtcggtgtcgtcgtcgctgtccaacttcctgctctgctgcttctacccgtcatccgccggccaccaccgcggcggcgcctactactacagcagccacccgacgagcgccagcaccctgcactaccacgagggcacct

SEQ ID NO: 41464 - DNA, 304 bp, Zea mays
  Clone ID: LIB3062-007-Q1-K1-E3
cccggtcgagcgacgcgttcggaaaaggccctggaacagcttaaaggcactgaaggaaaaactgtagctgctggccaacacatggatgttgttttgcacactttgcagatcggctagctctacatggattatgatctgatatcaaaatccatcgataaatgaaagaacttgtttgaggaatgacgcgattgtcagaggaagaacacgttgaaagtatatgaaggctcgtacttgattgcaaccaaaaacttcaagaaagctgccagcttatttttagactcgatttcgagctttacaacttatg

SEQ ID NO: 41465 - DNA, 325 bp, Zea mays
  unsure at all n locations
  Clone ID: LIB3062-007-Q1-K1-E4
cgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgncccagtccgcgtacggtggngccggngacgcctacggccacagcggccaaggctacgcgcccccgncggcctacggcgccgggggccggtacggcaacgtcgtccacgtcgcgcacgaagtcggcgacgagaggccttactacggcngcgg

SEQ ID NO: 41466 - DNA, 346 bp, Zea mays
  unsure at all n locations
  Clone ID: LIB3062-007-Q1-K1-E6
cggacgcgtgggcttccacagccgcaacctctatccctcgtctggtatcgtctctgccacaccccgctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcataagctgcaccgncagtggaccttctggtacgacatccagtccaagcccaagcccggcgctgcgtggggcacctncctcaaaaaggcgtacaccttcgacaccgtcgaagagttttggggctgggatgatcatg

SEQ ID NO: 41467 - DNA, 312 bp, Zea mays
  unsure at all n locations
  Clone ID: LIB3062-007-Q1-K1-C8
gaggaattgttcccttctgcaaggggcttgatgtcattcagcaagcacaatctggtacaggaaagacagcaaccttctgttctgggatcttgcagcagcttgactatggtctggttgaatgccaggccctggttcttgctcccacccgtgagcttgcacagcaaattgagaaagttatgcgcgcacttggtgactaccttggtgttaaagtccatgcatgcgttggaggaacatctgttcgtgaggaccaaaggattctcgccagtggtgtgcatgttgnttgtggtacaccctgtcgtgtgtttgacatgc

SEQ ID NO: 41468 - DNA, 282 bp, Zea mays
  Clone ID: LIB3062-007-Q1-K1-E7
gcttatattagtacgaaagcaagggggtcatctaccgcgtgtatcatcactcttaaagatcaggggatccatgctgtaaatcttggggatagtggtttcgtagtagtccgagatggccgcactgttctcaggtcaccctcacagcagcatgatttcaattttacttatcagctcgagagtggaggtggcagtgatcttcctagttccgcacaagtatttcacttttccgtttgccccggtgatgttatcgttgctggcacggatggactatttgacaattta

SEQ ID NO: 41469 - DNA, 228 bp, Zea mays
  Clone ID: LIB3062-007-Q1-K1-A8
ctgtccaacacatccagtgcatggcatctgtagctatctgcccgaaggctgccgcgatcgacgataacctcgtgcatgacgtgaaactcgctgctgactagactaggatccccatggttcactagctggtgctggacttcatgaacttccacgagctgtgcaagaacatcaacaccgatgaggccgacggctattctgccggtacccagcctgtcatcctgaacaccg

SEQ ID NO: 41470 - DNA, 420 bp, Zea mays
  Clone ID: LIB3062-007-Q1-K1-A9
ctgtcacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggacccagagcacgcgcacaggcacaagatcacggaggaggtcgctgccgcggcggccgtcggcgccggcggctacgtattccacgagcaccacgagaag

SEQ ID NO: 41471 - DNA, 298 bp, Zea mays
  Clone ID: LIB3062-007-Q1-K1-B1
ctccttcactgtcgcagccgccccttgtagaagcttcgaggctgctgctgctgcgcccatggccggggaaggcaggacgccgtccctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaatccagaggcagaagaaactaacactgctgcagaggaaacacct

SEQ ID NO: 41472 - DNA, 407 bp, Zea mays
  unsure at all n locations
  Clone ID: LIB3062-007-Q1-K1-B10
cttgtgcaaaacaatgcataggcaaccagaacatgtgatgatgttcttgcttgctgagatgggaacaagtggatccctggatgggcggcaaaggttggttatcaaaggaagatttgcaccaaaaaatttcgaagcgatacttaggagatatatcaatgaatatgtcatatgcaatggttgcaagagtccggataccattctttctaaagagaacaggttgttcttcctccgatgcgagcagtgtggttcatcgaggtctgttgctcccatcaaggctggattcgttgcccaagtgggccgtcgtaaggctggatcttaagctacctactacttgcctgaagtcgctttccgatgaagacaatgcanactagtttgctggttcacataaatcattgttgcactttccc

SEQ ID NO: 41473 - DNA, 72 bp, Zea mays
  Clone ID: LIB3062-007-Q1-K1-B12
gtcggttgggttcttctgccccttcggttcgggttttggttcctgaaggtcttcggggttccgtttcggggg

SEQ ID NO: 41474 - DNA, 348 bp, Zea mays
  Clone ID: LIB3062-007-Q1-K1-B2
ggcagttggttgactgtgtgacaactttgagctatgtcatattacgaaagaaggggtggagacaggggtagtgggcgtattcaaggaagtggtgggcgaggtggacatgtcctgcgtggaagatcaggattggctccccgaggacttcttggggttaactcccgtccatctgcacgcactattgctaaggcaaggccaaacctgtcactatgtttttgttcatggtcaagttcctgactaaagtagaaactgaatggggagagcatgcctaagcttacattatatggaggggcaggagtatctgtgatgtctgtgactaatgcgttctctgtcagtattggttggagg

SEQ ID NO: 41475 - DNA, 355 bp, Zea mays
  unsure at all n locations
  Clone ID: LIB3062-007-Q1-K1-B5
gtgacgaaccctctattcgagaagaggccgaagcagttcggcatcggcggcgcgttgccgcccaggaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctttttaagatgcttctcaagtaccggcctgaagacaaggctgccaagaaggagaggcttctgaagagggcccaagctgagaatgaagganaaactgttgagtcgaagaaaccaattgttgtgaagtatggccctaaccatgtgacttacc

SEQ ID NO: 41476 - DNA, 348 bp, Zea mays
  unsure at all n locations
  Clone ID: LIB3062-007-Q1-K1-B6
cggacgcgtgggctagtccacacggcagacgccgccgccgggggagaggagaggaggggaggggagcggctccaagggaacaggtgagatggcaatcctgtacgcgctggtggcgcgcggcacggtggtgctggcggagcacagcgcggcagccaccaacgcgggcgctatcgcgcgccaggtcctcgagcgccttcccgacggcggcgccgacagccacgtctcctacacgcaggaccgctacgtcttccacgccaagcgcaccgacggcatcaccgngctctgcatggccgacgacgccgncggaagacggattcccttcgcattnntggaggatattcatggaag

SEQ ID NO: 41477 - DNA, 368 bp, Zea mays
  unsure at all n locations
  Clone ID: LIB3062-007-Q1-K1-B7
ggctgggcttgtgccaagcttgaatcctcttgtgaaggagtttctcaatgctgctggtgacaagcggaaggaagtcctctctaaaatagaagaggatgttgctaagctcagcggttctgcagccaactaagaagctacaagtgaatgccgaggagagcagcgatgacttggctaacccaccgaaagtagacgagaagcttggtgctgtccctcatggcctgtccaccgactctgangttgcccagagggaagccgagtctatctctaggaagactctcacgagctcagccgagaagtttgagtttcaagctgangtttncagactcatggacatcatcatcaacttactctacagcaacaaggatatc

SEQ ID NO: 41478 - DNA, 356 bp, Zea mays
  Clone ID: LIB3062-007-Q1-K1-C1
cgccagaacgtttgtttcctttatctaaaaaaaggtaaaacatctagcctcagtcgtgtggccagtgaagattcatacatcctcagcgcagtgccaggggcactctcagtatttatgttggacgatattgcggctagtgtacatgccattttggagccccatttgcttctggaaaggtgtagtggtactgtggtagtatggcacaaccagtgagatatggcttctcattgttgctagcagatattcctgagctcctctagacatgataatttcacctgcaggcagtgtatctcttgtaactaattccaattttttattacttttattatacattataactagttatgtcaaatatg

SEQ ID NO: 41479 - DNA, 312 bp, Zea mays
  Clone ID: LIB3062-007-Q1-K1-C10
ctcctgcgctgcgccgtccttcacctccgccgccgaatccgagactctgatctcgggttcaccggagcgcgcagagcacccctgactcccggcccgatccgcgctctcctctccgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaggagaatcttctgagaggcatttatgcatatggttttgag

SEQ ID NO: 41480 - DNA, 228 bp, Zea mays
  Clone ID: LIB3062-007-Q1-K1-C11
ccaagttcgattggagaggcgtcgctcctcgagacacctacatcgcgaatctcctcaaggactggaagtgggcactgacagcgttcaaggctacctggaagatcgtcctgggtcatcaccccatcagcagcgcctgcgggcatgggaacaacactgagctggaggagctgcttatgcccatcctcaggacacacgggcttgacatgaacttgaatggccatgaccact

SEQ ID NO: 41481 - DNA, 295 bp, Zea mays
  unsure at all n locations
  Clone ID: LIB3062-007-Q1-K1-C12
cttttcgagtttagaacctctaaaatttcccccactcgccagtcgcagcagcacctgtagccatggacgccagcggagcgggtagcggggggaagaagggtgcggccgggcgcaaggcaagcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgncgtcctggagtacctcgccgccgaggttctggagttggc

SEQ ID NO: 41482 - DNA, 306 bp, Zea mays
  Clone ID: LIB3062-007-Q1-K1-C2
aatagacatggctcccctattcttgaggataaagcggcggcagttggaaaaccaagatgttacaagtcgtggcgcgagatcacagtcatacccatcttccagtggttctcgagaagagtttgtggaaagaagtagagatgctgcagcagagctccgtccaaaacgagtgaaaatccggctaccttctagtgccagtaggcagattgagcagcagcgcagttcggggcagcgatttgcaagggaggacaagttgccgcttgcattttagggaatcacaggtactaacctctactgggcagacgaatt

SEQ ID NO: 41483 - DNA, 315 bp, Zea mays
  Clone ID: LIB3062-007-Q1-K1-C4
cagtagttagagcgaccaatagatgagttcctccccgtcctttggtctcctggctgtagcagcatggctcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacgtcgagttaggcgccaactggggtgagggcgtgaacggcggcaagatgaa

SEQ ID NO: 41484 - DNA, 325 bp, Zea mays
  Clone ID: LIB3062-007-Q1-K1-C5
gttctagatcgcgagcgccgccctttttttttttttttacatttatttttagtttagaaaaccgaagggcgacgggcggagcttacaaagccggtgccggtgagcaatcatgaatttacggagcacactgtagtgtgcagtgtgcccccactgatgtctagaacgacgactgatgatgatagatcacccacgctgccacgcagcgacgtgactgcgacgggtcccactgatgtaccgcgcagtgacttcaatctttggacgttccagtggatggattcgcgacggagatcccgccgtcgacgaacaggttgtggccgctgatgta

SEQ ID NO: 41485 - DNA, 404 bp, Zea mays
  unsure at all n locations
  Clone ID: LIB3062-007-Q1-K1-A7
accgggtccgagccagcgcgtctcgggagaagcgaccaccactttcttcaaccaccacaatgaaggacgaggagacagcccggcggcgagtacggggtactctcgagtaccgatagtggtcaaccgtccaccggcgagggcgagtaccgagaggtacatagaagggangagaaaggagcaccaagcaccaagcagcactcttcggcgaggccggctgccattcgccgnncggcgccttcgcacttcttacgagaanngcacgaggcganagaaaggaaccccgagcactgcgcacaaggcaccaagatcacggganngaggtcgcttgccgcggcgggccgtcgggcgccgggcggctacgtatttccacgagcacccacgnagaagaagaagggacccacaag

SEQ ID NO: 41486 - DNA, 318 bp, Zea mays
  Clone ID: LIB3062-007-Q1-K1-C6
ccgcattccacgcgcactccgctgcctcactccgagactccgccgctgcttccaacttccgttgcgcacgagcgaaacatccggagctagcaagggaggaagaggaggaggaggaagcgatggcggggggcggggataaggtggactacgtcttcaaagtggtgctcatcggcgactccgctgtcggcaagtcgcagatccttgcgcgcttcgcccgcaacgagtttagcctcgactcgaaggccaccattggggtcgagttccagactcggactctcgtcatcgaacacaagtccgtcaaggcgcagatctgggaca

SEQ ID NO: 41487 - DNA, 318 bp, Zea mays
  Clone ID: LIB3062-007-Q1-K1-C7
ggaccgaccagagtaccggacacacagcgaggtggaggaagaaggaagcaagagggaggaccgaggaggcctaggccctagggtagtcccgtccggtcccctgcggcgcaagtccggccggcgggcgggctgactgcctggcgtcggtagggggcgacggcgatctatatctgtcgatgggctactggtgggaccgcgtcgtgctgccggtgcggcgggcctggctcggcgtcgcgtcccgcttcggagttcgccagaccggtacggcgcgagggcgaggctcggcgttcatcggcggcttccgtacaatcttccgtc

SEQ ID NO: 41488 - DNA, 351 bp, Zea mays
  Clone ID: LIB3062-006-Q1-K1-G3
cggtggggtgcgccttcaaccacgcggtgctggacggcacctccacgtggcacttcatgtcctcatgggccgagctctgccgcggcgtacccctgtcgctgcagcccatccacgaccggtccctgtcccgctccgtgcgcgtgcggctggagctgccggcgtccgccgaggcccacgagaagacggacccgaacgggccgaagaaggcgctggtggcccgcgtcttctcgttcccggagcccaccgtggcgcgcatcaaggccgcggccaacgcggcgctgccgtcgggcgcaaagcccttcttcacgttccagtccctgggggcgcacatctgtgcgcgccgtctccgcg

SEQ ID NO: 41489 - DNA, 462 bp, Zea mays
  Clone ID: LIB3062-006-Q1-K1-G4
gccccgttccgaccttgcccctgcggtctcccgagtcccgaagcatccccttccaaaaccctcggcgcgccggggtcacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagcgcaaaagctgctggaaatgaggttattgggattgattctggggacaacgaactcatgtgtttctgttatggacggaaagaacccacaagttattgagaatgctgaaggtgcgagaacaacaccatctgctgtcgcatttactcagaagggcgaaagacttgttggaactccagccaagcgccatgcattaaccaacccccagaatac

SEQ ID NO: 41490 - DNA, 376 bp, Zea mays
  unsure at all n locations
  Clone ID: LIB3062-006-Q1-K1-G5
ctcagtgacgtcttgctacatcgcaacattctctttctctcgctcggcggtcagcttcataggcgngtgccggacgccagtgtgcaacgtggtcatgtccacggttgtgctcctcaccttgctgctcatcacgccgctgttcaagtacaccccgaacgcgatcctgggctcgatcatcatctctgccgtcatcagcctcgtcgactacgaggcggcgatcctcatctggaaagtcgacaagatggacttcgtcgcctgcatgggggccttcttcggcgtggttatcaagtctgtcgagataggcctcttgattgctgggtcaatctcgtttgccaaaaatacttgttcaaggtacaagacccagtactgggctgct

SEQ ID NO: 41491 - DNA, 459 bp, Zea mays
  unsure at all n locations
  Clone ID: LIB3062-006-Q1-K1-G8
cttagaatggagcgtgattcaattgaagacaaaatccatcatcttgaatggtctcttaagctggatgatatctcagaaaaccagaaggagaaattgttctctgaacatgacaatctgctgaaacagagagggcatgttcgtggtcttcatcaagaagctcagaggcaacatcatcagaagtttcataaggtgtggggacagctcatgaagactgggtaccaaaattccagatttgctcatcaggttgagagatttgcatgcttgtacagcagccaggttacaaacttcggtttgtattcccctgacaaatactatcgtccgagcgaagattacatgccccacgagnttgatgtgcttgngctgtangagcagcccctactgctggtcggagttcctcgttgtaattgatccatagcaggataggagggtgacatcgtagttgccgtattatataacagg

SEQ ID NO: 41492 - DNA, 350 bp, Zea mays
  Clone ID: LIB3062-006-Q1-K1-H2
tcggacagataggattctgatgcacaagtattatcatcttgtctctgttctcattttctatcctgcaggtatattgcagacttctttcttggacttggcatttggtgcatcatttacagttctcttgatattgtctatgatacgaatttcgtaaatatactctcttggacatgttgtgcatcagtttatgaactactttactgatcatcgtgttactaagactcttattgtcaaccactattcactcttactgtgctgagctcttcctaattgtacatcatccagattacatgactgagcacttgtccctttagccagaattttcaacttagcgataggtcataccatag

SEQ ID NO: 41493 - DNA, 383 bp, Zea mays
  Clone ID: LIB3062-006-Q1-K1-H3
tcggagagccatggagaagaaggcacacaagctgatgatgcaaaccaaaatcaatgaaaccaaggatgtcatgaaggggagggctaatgagcttgacaaaatgaggatggaaagaggcaaacttgacaaaggaggatactcatcaatatctggtccacgcgtgattgaaaaaactttcagtgacatgagcatcagtggttctggattaggtggactgagcactgacatggactcatttgctagcaagcccaaaggccgtccatctacagcagctactgcacctggtaaaggttttggtatgaaattaggcaagacacagaagacaaatcaattccttgaatctttgaaaagctgaaggaaaaagtcattttgggaggatgtac

SEQ ID NO: 41494 - DNA, 466 bp, Zea mays
  Clone ID: LIB3062-006-Q1-K1-H4
tccatctacctgctccttcgactccttcttgatccagccaagccagggatcgccatgtcggactcggaggggcaccacgtcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagacatattcaacgggaaaaagctcgaagatattggtccttcgtcacacaactgtgatattccgcatgtgaaccgtactgagtaccagctgattgatatatcagaggatggatttgtgagccttcttacttcagatggcaacactaacgatgatcttaaactcccaactgatgagactcttgtggcccagatcaaggaagggttcgaaagcggcaaggatc

SEQ ID NO: 41495 - DNA, 251 bp, Zea mays
  Clone ID: LIB3062-006-Q1-K1-H5
gtggatctggcatggatctcaggagcaaagcaaggaccctctccggcccggtgaccgatcccagggggctgcccaagtggaactacgacggctccagcacgggccaggcccccggcgaggacagcgaggtcatcttgtacccgcaggccatcttcaaggacccattcaggaggggcaacaacatccttgtgatgtgcgattgctacaccccagccggcgagccaatccccaccaacaagaagtacaacgcc

SEQ ID NO: 41496 - DNA, 442 bp, Zea mays
  Clone ID: LIB3062-006-Q1-K1-H8
atcgagccggcggcttgcggcggcatcagcgatggcggcgaagcgggagatctcgagcaccctgaggaacctcaagtttatgcagcgcggcgcggctgcgcagaaggccgaggagaaggccgaggtggaggtacaggaggaggaggtggtgatggcgccgagtggaggcttcgcctcgtacgcgcatgtcgttaggaagtgcatagttatcatggagggtaatcctcatccaggagctataaagggtcggatgtctttccaaaatttcaatccatgtatcgataaactaaatgaagaggcaagaggtgaccagcacacagaatcagcttaccccagtaactgtgaccaagacaatgcaaactccagcatagggaatgaagttccagcatcaagatgtagagattttggcattcccagttcaaaaagcatatctctaaatgaa

SEQ ID NO: 41497 - DNA, 377 bp, Zea mays
  unsure at all n locations
  Clone ID: LIB3062-007-Q1-K1-A10
aattccggtcgagcacgcgtccgcccattgatgacatggtagacgaacagcaagggattagggattctgatgcggaagataatgattgtggacggccaaatgataagatcccagatacttcatcagcagatgcaagaaaaggaagggacattcaaggaataccctgngagcagataaacataacccgtaaaaaatacagacagtccagattagaacagtacanaaattatgagaatgtacctaactctggagaagaagctatgaaagattgcaaaccaacagagaaaggtgggatatactatgagtntagacgaaatactagatcggntaaatcaactattctacattntcagcttagaaattttgtatgggcaacg

SEQ ID NO: 41498 - DNA, 366 bp, Zea mays
  unsure at all n locations
  Clone ID: LIB3062-007-Q1-K1-A11
attcatcagattcagatcagatcgtagcagccaaggattccgcgctccgggggtgccatgaaggtgaagcggctctctccctgccttctcctcctcgccttctttgccaccgcggcgtacgcggcgtcagcgtcggcgtcgcgcgcggcggccgtcgtcaggggcgcggacgccccgtcgcagtcggagttggagtcggacccggagaaccagtgcgtgtacacggtgtacgtgcggacggngtccatctggaagggcggcacggactcgaccatcggcgtgacgctgctgggccccgacagcacgggcatccggatccgggacctgacgacgtggggcggcctcatgggcgccggccacgactac

SEQ ID NO: 41499 - DNA, 385 bp, Zea mays
  unsure at all n locations
  Clone ID: LIB3062-007-Q1-K1-A12
caagaagagagccgatcgaccgagagctagcacgcgatggcgaggtcttccaaaatgatggtggcggcagctctgctggagctgnccgtggccgtgtcgaccgccgaggcgaggaacatcaagacgacgacggagaagaaggacgacgcggtggtgcagccgcagaccttcccgcccttcgaccgcctcggcggcggcgcgtccccggcgttcggcggcctacccggcggcagcattcctggcagcagcattcccgggttcagcatgcccggcagcggcagcagcctttccgggttcagcttgccccgcagcggcaacatgcccctcttcgggcggcggtccccgggctttaacggcttcggcgggatgcccgggtcccccaccg

SEQ ID NO: 41500 - DNA, 280 bp, Zea mays
  Clone ID: LIB3062-007-Q1-K1-A2
gtcccgaattggcagcgcagagagccagaggatgcgttaatgttactctactcctatatagcagcggcactattggcctcctttccccacttccacttcgctctgtcctcccatgcgccggattaccactgaccacttcacagtcacagtagtacagagcggcagagtggagaagtagactctaagtgagatggcggccgtggtggcggcggtggaggcaggggtggtggcggtggcaagcgggaggggatgcagcaaccggctggtgcggggcctgtac

SEQ ID NO: 41501 - DNA, 341 bp, Zea mays
  unsure at all n locations
  Clone ID: LIB3062-007-Q1-K1-A3
caggagtctgcttccgttccattgcatcccagtcccagccaaagcaggatgccgcacgccaagagggactcggaggtgacgagcctggcgccgtcgtcgcctccgcggtcgcctccacggacccgcggcgccgtctactacgtgcagagcccgtcccgcgactcgcacgacggcgagacgatcaaggcggccacgtctgtgcactccacccccgcgctgagccccatggcgtcgccgcgccactcgcactcccactcccactcgtccatgggcagggactcctnctncagccgattctcgggccacggncacaacaagcgcaaggccgacaagggcggcag

SEQ ID NO: 41502 - DNA, 358 bp, Zea mays
  unsure at all n locations
  Clone ID: LIB3062-007-Q1-K1-A4
cgtgcttgtttgctctagggtttttgccacgccgccgccgctctgccccttccaccccaccgatagaccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatnggacagaaagggatgggagtggcaagtcgaagcaaagcaggagtgagaagaagagccgcaggggcatgctgaagctnggcatgaagcccatcactggtgtcagccgggtcactgtgaagaaaagcaagaata

SEQ ID NO: 41503 - DNA, 355 bp, Zea mays
  Clone ID: LIB3062-006-Q1-K1-G2
tcttgctcttcgcaacttgctctatctctcactctccacgggacttcatgtacactttcctaactccagtgtccaacgtcatcatatacacagatgtactcataaccttgctgctcatcactccactattcaagtacaccccgaactctatcctgtactctatcatcatctctgccgatataagcctcatccactactagacggcgatcctcatctggaaagtcgacaatatagactttatctcctgcatgttggcctccttttacgttattttcaactctatcgatataggcctcttgaatactccgtcaatcttgtttcccaaaatactttttcaaataacaaaaaccattac

SEQ ID NO: 41504 - DNA, 410 bp, Zea mays
  Clone ID: LIB3062-022-Q1-K1-H12
ataacttatcaccgtctgtagaatgctcttatgtgacatgtgagaagattcgtccttcgggctctgatgctgtccaggatgcttgaacttatgatatcgaagatgcttagaactctactggtgtacagacctcatctgcttgtgaagctagtctcgatgaaatgcacaatgcttgtgcgaaattctcatacaatcacagatgattgctgaatgcattcatccgtaaaaaccctggattgctgctgaagtcattctcgctgatgttgaaaattcctcgcctgattgattttgacaatcaacgtgcatattttcggtctaaaatcaagcatcagtatgatcatcatcatcatagccctgctagaatctctgtgcatcgtccatatattcttgaggactcctacaatcagctt

SEQ ID NO: 41505 - DNA, 358 bp, Zea mays
  Clone ID: LIB3062-022-Q1-K1-H2
gttcctccaggatggagagtctctccacactggaagacgacgatatcaacaccagcaaagaagttactggccattcctcgagtgacatggatttaccacacgatggccttcagtcgccggagtacattctcaccggtgacaggccaagattcggaggaagggcctctatcagcagagggaagagccttctgcctctgttcgatgcagtcggcgacgaggcctgtgaccgaatgccgtcatctgctggagcaggagaggcagaccaggccgacgatgcagcaacgaagccggtttccgtgcttgtcaaagagcacgagaggctggcgatcatagaggaggtcgaccatgtctacgaaag

SEQ ID NO: 41506 - DNA, 253 bp, Zea mays
  Clone ID: LIB3062-022-Q1-K1-H3
tatgggtatgggtcctggtgccggtgccggttatggtggcggaatgggaatgaaccggccaatgggcatggggatgggaatgaatcaacaacagatgaggatggggatgaaccaacaaccgatgggaatggggatggggatgaaccaacaaccgatgggaggaatgaacatggggatggggatgaaccatgggatgccgatgcgtccttcaatggggatgggtcctggtggaatgcccggtgctggctacaat

SEQ ID NO: 41507 - DNA, 143 bp, Zea mays
  Clone ID: LIB3062-022-Q1-K1-H4
agttatggagttttaatgggaatgaaccggccaatggtcatggggattggattgaatgaacaacagactacaatggccatgaaccatcatcctatgggacatggcatgattgatgaaccaacaaccgatgtcaaataatgaac

SEQ ID NO: 41508 - DNA, 464 bp, Zea mays
  Clone ID: LIB3062-022-Q1-K1-H5
gggatatcctctggcattagagaatattcatcttgacaagaaattatctatatgtgaagatatgtctgacaagggctatagctcagttcggtagagcaactcgtttacacgtgcgccaatgcttttcaagggaactttttatgcaatgaacataattgaccttgttgcaaaatcaatgtcttacttcatggattcgaaagaatagaagaacagtagcctgacaatgacaaacagctggttcagtccgattcaggtgccaattaaggtgcttactcaaatagaactcctattgatttgctagttgataaggtaaatatccagcccactcaatgctaggcgtaatgaggataagggcctccaaaaaacttcttttcgttctatgaactttaaggtgtatgaagtctcatagtaaactcttgcagcggaacgatagagactccatttcacttaggttgatttaattt

SEQ ID NO: 41509 - DNA, 462 bp, Zea mays
  Clone ID: LIB3062-022-Q1-K1-H6
gcgtggatatcctgtggcattagagaatattcatcttgacaagaaattatctatatgtggagatatgtatgactagggctatagctcaggtcagtagagcaactcgcttacacgtgcgccaatgctttacaagggaactttttatgcaatgaacatagttgaccttgttgcataatcaatgtctaacttcatggattcgaaagaatagaacaacagtagcctgacaatgacacacagctggttcactccgattcaggtgccaattacggtgcttactcaaatcgaactcctattgatttgctagttgataaggtaaatatccagcccactcaatgctaggcgtaatgaggataaagacctacaaaaaacttctgttcgttctatgaactgtaaggtgtatgaagtctcatagtaaactcttgcagcggaacgatatagactccatttcacttaggccgattt

SEQ ID NO: 41510 - DNA, 475 bp, Zea mays
  Clone ID: LIB3062-022-Q1-K1-H7
cgactgtggccaccctcctcggccgcctgtacttcaactccggcggcaacagcaagtggatgggcacgctgacgcagtctggcggctcgccgcttctggtcgtcccgctcctcctgtcgccggcgcgctcggcggaggagcgccggccggcggcgctcaagatggttgccatctacgcgggcatcggggtcatgatcggcttcgacaacctcatgtactcgtacgcgctgcagtacctgccggtgtccaccttctcgctcgtggccgcgacgcagctgggcttcaacgccatcacctcgcgcctcatcaacgcgcagcggttcacggcgctgatcgccaactccgtggtcgtgctcaccttctccgtcgcgatcctcggcgtcagatcctcctgcgacgagacctacagcaacgtgccgcgcggcaagtacccactggggttcgtactcgtgctggccgactcgacggtgttcgc

SEQ ID NO: 41511 - DNA, 483 bp, Zea mays
  unsure at all n locations
  Clone ID: LIB3062-022-Q1-K1-H8
tgagcctttgattagtaagcaatggtttgttacgatggagccattggctgaaaaggctctccatgctgttgaaaaggggcaattaaccattcttccggagagatttgagaagatttataatcattggctaacgaacataaaggattggtgtataagtagacaattgtggtggggtcatcgtataccagtttggtatattgttggaaagaaatgtgaagaagactatattgttgctagaaccgaagaggaggcacttgcagaagctcatgaaaaatatggaaaatcagttgaaatatatcaagaccctgatgttcttgatacttggttctcaagtgctctgtggcctttcagcacgcttggttggcctgatctttccaaggaggattataagcatttttatccttcaactgttctggagacaggccacgatattttgttcttctgggttgcacgaatggtcatgatgggaatngagttcacagg

SEQ ID NO: 41512 - DNA, 444 bp, Zea mays
  Clone ID: LIB3062-023-Q1-K1-A11
acgcgcttgcagccgccgccgcgtccgcctcgccaagcgcagcagccgccgcagcacatcgctctgttgaggtcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgtggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccattcaggtcgtcgtcgacgcgatcaataacagtggaccccgtgaggatgccacccgt

SEQ ID NO: 41513 - DNA, 453 bp, Zea mays
  Clone ID: LIB3062-023-Q1-K1-A12
ccaggagatacagcgagcgagcgaccaaagccatggctctccgcaccctggcatcgaagaaggtccgatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccaaaagcaccacgccacctacgtcgccaactacaacaaggcgctggagcagcttgacactgccgtctccaagggcgacgcctccgctgtcgtccagctgcagggcgccatcaagttcaacggcggcggtcatgtgaaccattcaatcttctggaagaacctcaagcccattagcgaaggtggcggggagccgcctcatgggaaacttggctgggccatcgatgaggattttggttcgtttg

SEQ ID NO: 41514 - DNA, 260 bp, Zea mays
  Clone ID: LIB3062-023-Q1-K1-A2
cccacgcgtccgcccacgcgtccgccctactccacccctcgcagctcgctggtcgtcgcgccgtggtcgtgtttgaccaaatatcgcagcgagctccacctcgatctgtgcagccccagttgtgacctcgtcgaatcccggtgaggacccgttgttctccttgtgtttattcctctctggtacatgtattcgacgccgattaattaaatgcctaatcatgtgtatatgtgtgtgattatgcgtgtgatttttgcggagga

SEQ ID NO: 41515 - DNA, 222 bp, Zea mays
  Clone ID: LIB3062-023-Q1-K1-A4
tcgcttgaggacactgttgtgtccttttccttaagaagggggctttaagaatgatatacggggggcattttgtccacatggatgcctaccccaatgtgggtatgtaaggcatgattatgcctgtccggctgaaaaaaaggctacctaaggaccctatacctgtccggactccagttttgtagatctattctttcactgaaagtacaattttaattgacaatt

SEQ ID NO: 41516 - DNA, 421 bp, Zea mays
  Clone ID: LIB3062-023-Q1-K1-A5
ccgacgacatcgtggacttggctcacggcaagcggctgtgggagctagccaaggacaagtatgagccgctgtggatcaaaggcggtgggcactgcaacctggagacgtacccggagtacatcaggcacatgcgcaagttcataagcgccatggagaagctggccaaggacagcagcaaggcggcccaggcgccgccgccgtcgagcatggccgccgaagaaagacacaccaagtgcttgagattcgggaagagatgagatgccggcgacctggacctgggaaggaaacgcggtgcagcagcaaccctagttcgtgtatcatccgtgtgagattgagttcagacttcagagtagagagtagacagagtggagtgacagacagacctgtggctgctgtagtatgctgtacgtgctggagttca

SEQ ID NO: 41517 - DNA, 395 bp, Zea mays
  Clone ID: LIB3062-023-Q1-K1-A6
caaaggatctcttctgtcagtattgaggcaatttgctcgtttgaagaatgacaaacaagctatttctgtcgggtttgttgggtaccccaatgttgggaagtcatcaattattaacacactacggtcgaatagtgtctgcaaggttgctccaatacctggagagacaaaagtgtggcagtacatcactctcactaaaaagatattttagattgattgtcccggtgttgtatatgaaaacaatgattcagaaactgatataattcttaaaggtgtggttcgggtgacaaatttggcggatgctgcttaacacattggtgaagttcttaagcgtgttaaaaaggagcatcttcaaagagcgtaccaaattcaagattggtcttatgataaccattttc

SEQ ID NO: 41518 - DNA, 233 bp, Zea mays
  Clone ID: LIB3062-023-Q1-K1-A8
cttgaggagactgtcgggtcatgtactagaagaatggtcctctatcaagaatatgtgaagggcatatcgtcaacagggatgcaatccaattgtggttttgaagggcaagttaatgcatgctggactcacaaaatgactactaaggaactagatacaatacggtttgccggttttctagtttcagttattcatggaaagtacgatatcattgcacaattgtgccatgcaaaacg

SEQ ID NO: 41519 - DNA, 387 bp, Zea mays
  Clone ID: LIB3062-023-Q1-K1-A9
cggacgcgtgggctgtacttcctcagcctcatcctatccaagaacgcagaaccgagacccaggaactcgcagcaggccagcagccatggccgcccccgcaacgagctcccttctgagcacgctgctgcagctaccactcgctccgttctcggggaagagctcgccgccgtccgtggtgcacgtggcgcgccgggcgccgacggcggtggtggcggccaagggatacaatgtgcagatcctggtggacgagaacgagggggaggagtccatcttccgcaggttccggcgggaggtgatgcgcgccggcgtgctgcaagagatcaagcgccgccggaggtaccagagcaagacggacgataagaagcgcaaggcgcgcgagggcggacg

SEQ ID NO: 41520 - DNA, 445 bp, Zea mays
  Clone ID: LIB3062-022-Q1-K1-H11
gtgtgagtcacgcatgaacactcaaaatggtgaccgtccattttttgattttctggaatcatccctcagacatagagcagaaatggtggctttggaagctgcacggaagataacagagatggatgttacaagccgtgaattggcaccagcaattactttgttacagttatacttgagttcatccaagcctgtgcttcgatttgctgctgtccggactctcaataaggttgctaggacacgacctctggcggtgacaaactgcaatgtggacttggagagtttgttgtcagaccagaacaggagtatagcgaccctggcaattactactcttcttaaaactggcaatgaatcaagtgtggatcgtctcattaaacaaattacccttttcatgtctgacatagcagatgaattcaagatagttgttgttgaagctatacggtctttg

SEQ ID NO: 41521 - DNA, 476 bp, Zea mays
  Clone ID: LIB3062-022-Q1-K1-F5
ggaaaaaacactttgatcactcattcatcgtgaagctccttaatcttcttgactccgaggatcgaagagagagggattgcttgaaaactattctgcacagggtatatgggaagttcatggtacaccgtcctttcatccgcaaagcagtgagcaacatattctaccagtttgtctttgagactgatcggcacaatgggatcgcggagctgctggaggtctttggcagtgtcattagtgggtttgcattgcctctgaaagaagaacacaagatctttctttggagagttctgattccgttacacaaaccaaaatctgttggtgtgtatcttcagcagttgacctactgtgtaacacagtttctggaaaaggacccaaagcttgcaagctcagtgataattggtttgttaagatattggccgataacaaactgtcagaaggaagtgatgtttctcagtgagattgaagagatcttggag

SEQ ID NO: 41522 - DNA, 316 bp, Zea mays
  Clone ID: LIB3062-022-Q1-K1-F8
acccactcggtcggaccttgacaggcagcctcccaaggcatacgtctgacgttccacggccacgtcatgcgtcataggaattgtgtgatctgatacgagttccgtcgcgactaatgaagaagggcgtgtgaggcataaaattatacttgtatgtttttttcatttgttttttcttttgcttcgctatctttactttttaccagtatattgccgtgagttgacagtgctagcttttggaattcacacatatatttggcgtaaaatgaattccaagagctatcagcgccattctttatcttgtcagcctaccctattt

SEQ ID NO: 41523 - DNA, 257 bp, Zea mays
  Clone ID: LIB3062-022-Q1-K1-F9
actcccagctgctccctcctcgccttcggcttatgtcctcctgctcgtccgctggggccgtgccgatcgatcacttggtgctcttcaaggcccaatcggaggcggtagcctcgatcaccgcggcggcgataacctcctcgctgcaagcactgaccacgctcgttcctcaactactctacatccactcatgaccgctgctccagatacagcacccggacgactaaacacttggcctcacactactactccacaccctc

SEQ ID NO: 41524 - DNA, 360 bp, Zea mays
  Clone ID: LIB3062-022-Q1-K1-G1
aaaccgccaagtgatcatgcctcttgttgttccagcgctagagcagaacattcagaatcactgggaccaggcggtcctgaatctgaccgtgaatgtcaagaaaatgttatctgagatggacgacgatctcttctcgtcatgcctggccaagtacaaggacgaagaagaaaaacgcgcgtcgctagaagcgaagcgtagacttacgtgggagaagctcgagtcagctgcagctttccagccagtgactggccatacagccgtcctagtaggccaccggccgtcagcaaatctgatcgccaccatgatctagctcatgcatgtatgccgaacaagcgaaagtggtgctcttccccccttttg

SEQ ID NO: 41525 - DNA, 394 bp, Zea mays
  Clone ID: LIB3062-022-Q1-K1-G10
cacagatttgaaatggcggtgatcgagatatatgatcaatctagggcgggcaataaagaggtcacgaagctcatactagggaagcataatcttttggcaccaattacatcttatgcccgccctgaggtggcagtaaaatcccagtcatactttttcacccattcagtaaaagcaatggcagttacacaaacggctaaggggatcacttccaagcagcttctgttgggtactattggtgaccaggttttggcacttgataagcgctatcttgatccacgccgttcagtgaacccgacacagcaagaaaaagaagagggcattataccattaacagattctttgcctataataccccagtcctttgtgacgcactctcatcaagtggaggccctgc

SEQ ID NO: 41526 - DNA, 430 bp, Zea mays
  Clone ID: LIB3062-022-Q1-K1-G11
cacagatttgaaatggcggtgatcgagatatatgatcaatctagggctgtcaagcaacatggcaccaatctcatactagggaagcataatcttttcgcaccaattacatattatacccgcactgtggttgcagaaaactaccagtcatactatttcacccattcagtaaaagcaatggcagatacacaaactgctaaggggatcacttacaagcagcttctgctcggcactattggtgaccatcttctagcactgcatgggcgctatcttgatcgacgcccttcagtgaaccctacacaactcgaggaacaagatggcataataccattaacagatactttacctataacaccccaatcctttgtgacgcactatgatcaagtggatgcactacgatccattgcatatattcctgcatagctggagtcca

SEQ ID NO: 41527 - DNA, 288 bp, Zea mays
  Clone ID: LIB3062-022-Q1-K1-G2
cgcagccgagggcatgtacacgggccagttcgtctactgcggtcgccgcgccaccctctccatgggcaacgggctgcccctccgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgctatgattgggcaggttgctggtggaag

SEQ ID NO: 41528 - DNA, 220 bp, Zea mays
  Clone ID: LIB3062-022-Q1-K1-G3
acatcttcatctaccacaatctctctaatcatgcgtgtccaaatcacggacgatgactaaaaactcgcgttccgtcaaacgaatcgtaaacgtacatcggagaagctccagtcatctgcagccttccagacagtgactggccatacagctgctctaataggtcatcgtgctgcactaaatatgatcgacaagatgatgtatctcatgcatgaatgcccaa

SEQ ID NO: 41529 - DNA, 263 bp, Zea mays
  Clone ID: LIB3062-022-Q1-K1-G4
gccgaggcattcgtacgatcgggtggctcgtggtcagagtccatctgctgatcgaggatgccgagctctgatccgtcaaggaccacttggtcaccactgattacatgacctacatgttcaagtacatctccgtgcacggacaatggtagcacagcgacatatccctaacggtctccaatactcttctattctgcgagatgccagtcaactactttaggatcaggaactccgaagagatcccgtggcgtgaggctggtgctgag

SEQ ID NO: 41530 - DNA, 310 bp, Zea mays
  Clone ID: LIB3062-022-Q1-K1-G5
catcatccctctccttgttttatcgctttatcacatcattcacaatcactagaaccagggggtcctttatctgaccttcaatgtcaacaaaatgttatctgatatgcactaccatctcttctcctcatgcctctccaattacaacgactaataataaaaactctcatctctagaaacgaatcatacacttacttactagaatctctagtcatcttcatctttccagccatttactagccatacatctcttctaatatgccacccttcttcaacaaatctgatcgccaacattatcctactcattcattta

SEQ ID NO: 41531 - DNA, 481 bp, Zea mays
  Clone ID: LIB3062-022-Q1-K1-G6
attcgtttgcttttcgtcttcgtcctctctttgcccagctgtcggtcgcccgcgccgtcgtcttcgctccggcggccgggctgcgaaaccctagcgaggcgagcgagagagaaactagcggccatgttcagctacaggaaggctggcccggacctcgaggccggcgggtcctcgctgctgtacccggggatgacggagagccccgagctgcggtgggcgttcgtccgcaagatctacgtcatcctagccgtccagctcgccatgacggccgcggtctccgccttcgtcgtcaaggtgcccgccgtctccaacttcttcgtctcctccaacgccggggtcgcactctacatcttcctcatcatcctgcctttcctcgtgctgtgccctctgcgctactaccaccagaagcatccggtcaatctgctgctgctcggcctcttcaccgtcgccatcagctttgccgtcggcatgacatgcgctt

SEQ ID NO: 41532 - DNA, 444 bp, Zea mays
  Clone ID: LIB3062-022-Q1-K1-G7
ccgggcccggagaggagaggatggccggccggagcagcctctccatggtcgcgtcgcaccgggtcttcacgccggtcaacccagtgggcggcgccgaccacggcgtggagctcgacgaggccgacgtcatctggggcggcggcggcggcggcgggtacccggcgtcgtcctcaccgtcgtcgtcgccgttcctgtcctccgcggtcgacccgtacgcgcggtcgccgccggtggccgcgccgtccaagcagaagccgcgtggggtggtggccggcgctccggggccggcgtcggtgcccgtcaacatcccggactggtccaagatcctgggcgccgagtacgccgggagcggttgggcggcgcacgacgaccgcgctgacgacgacgcgggggccttctgtggcgccgggggccggcgctgggtgccgtcccacgaggtgctgc

SEQ ID NO: 41533 - DNA, 437 bp, Zea mays
  Clone ID: LIB3062-022-Q1-K1-G8
gcgccgcgcctctccggcgcgggcctgcacaggctgctggccgacgacgtggtgttcgcggcgctcaaggacagcgcggccatggggtacctggctcccgagtacgcgacgacggggcggtccacggacaagcagggcgacgtgtacgcgttcggcgtggtggtgctgcaggtgctggcggggcggcgcgccgtgtcgccgccccacctccagcagggcggcggcggctgcgggcggctggacgacctcgtggacccgcgcctgcgcgggcggttctcgcgcgccgaggccgccaagctcgccggcgtcgcgctgctctgcaccgacgaggcgcccgcgcagcggcccgccatggccgccgtgctgcagcagctcggcaccagcagccagtgatcgtcgtggtcggccggtacggtggtgggccggagtcggagctc

SEQ ID NO: 41534 - DNA, 430 bp, Zea mays
  Clone ID: LIB3062-022-Q1-K1-G9
cgtcacgcccccaacacccccacaacccgaagcagcgaaagctcccctaacccgctccgcgcatccgatcgcaaggaagaagagggagatgagctactacgggcagcagccccccgtcggcgtcccgccgcagcaaggctacccgggcaaggacggctacccgccagcggggtacccgccggccggcgcagggctaccctccgcagggctacccgccgcagtacgcgcagccgccgcctccacagcagcagcagagcagcgggccttccttcatggagggatgcttggctgccctctgctgctgctgcctcctggacgcctgcttctgagagtgagaggggccgaccgacggattcgacacggcgacaagtgaaactactagctttctatgcgagggagagagagagagagctggaactggattgagcct

SEQ ID NO: 41535 - DNA, 360 bp, Zea mays
  Clone ID: LIB3062-022-Q1-K1-H1
atctcactctccgctggtcgctcactcttgcagctccacccttcactcagtcttagtctcttaggagctctgggctctagctagccgcgccactccttcgtgtagccatcagccttctcatcgccaccaatggccactgccgaggtccagaccccgaccgtcgtggcggccgaggaagcgcccgtggtggagaccccgtcgccggccgtcgtgcccgaggagtctgcccccgccgaggccgaggccgatgccgacgctgctgctcctgctgatcccgaggagcttcccgcggccgatcagcatgcagccgccgaagcggatgccccggctcctgctggtgccgatgagcccgtcgcgggc

SEQ ID NO: 41536 - DNA, 407 bp, Zea mays
  Clone ID: LIB3062-022-Q1-K1-F4
gacgtggacaggtaccctcccaaggcgtacgtctgatgggccagggccacgtcatgcggcatagcaattgtatgatctgatacgagttccgtcacgacgaaggaagaagggcgtgtgaggcagaaaattatacttgtatgtttttttcatttgttttttcttttgcttcgttttcttttctttttcccagtagattgccgtgagtagacagtgctggcttttggaattcagacgtgtatgtggcgtaaaatgaattccaagagctagcagtgccattctttatcttctcagcctaccctatttgttgtctagtcccttttgcctctctttggcgttctagacacccgggaagtgtaatggacagacgaacaccaccagtgtgcaattcacatgactagagagaactt

SEQ ID NO: 41537 - DNA, 223 bp, Zea mays
  Clone ID: LIB3062-022-Q1-K1-E11
ttgtcctactgctcgtccgctgtggcctagccgatctagcacttggagctcttcaaggcccgctcggagtcggtgtccttggtcgccgcatcaacgatggtctcctcgctacaagcgctggccacgctcgtaccgggcctgtcctacattcacgcaggaccggtgctccgactacagtccccggccgctgaggctcttggccccacgcaccttcttcacaccc

SEQ ID NO: 41538 - DNA, 412 bp, Zea mays
  unsure at all n locations
  Clone ID: LIB3062-022-Q1-K1-E12
caaagagcaaggcacagtgctatagaggtaaaacgggggagaggacgagcgaggagacagtgggaacgagccttgcgcaggcggtgacggcgctgatgggcacgtgcgcgcggcagctgtcgcgggcggctcggcggctgcaccggcgcccgcgcgcgcggcaggcgctcgcggcgtccttgtcgtcgcgcgccatcgtgccgttcctcgagaaggccgccgggtccaagaggaggaggagacgcgaacaggatgagccgagcttcgaggcagaggaggacggggtgtggaggaaggagataatgatgggggagcgctgccagccgctggaattctccggggccatctactacgacgccgagggccgtcgtctcgagcagccgncgaccccgcgctcgccgcttcgcagccc

SEQ ID NO: 41539 - DNA, 306 bp, Zea mays
  Clone ID: LIB3062-022-Q1-K1-E2
gtccggcgtcggagaacaacagaacaagaccaccggaccatggaatcgctgacgcttcgcgctgggaccggggtctcgccgctgcagcgactccggctgctccgcggaccgcagctcgcgacgtactttcgcgccacggcctccggcgccgagccggacactatccgtgcgcatgaacgggctgcacatgccctacccgttcgtgatcaggtcatcgacgacgggcaccacctacaccgtgacgaagtagcgcctctacgagggctactaccccgtgatcgacaagacagtgtcattgcatgctga

SEQ ID NO: 41540 - DNA, 456 bp, Zea mays
  unsure at all n locations
  Clone ID: LIB3062-022-Q1-K1-E3
tgctgccttcgcttccctggtcagctgaattctgacctccggaagcttgcagtgaacctgatgcgcttccgacgtctgcacttcttcatggttggatttgctccactgacctcgcggggctcccagcagtaccgcgctctcaccgtgccagagctgacccagcagatgtgggactccaagaacatgatgtgtgctgctgaccctcgtcatggccggtacctcacggcatctgctatgttccgtgggaagatgagcaccaaggaagtggatgaacagatgctgaacgtgcagaacaagaactcttcctacttcgtagagtggatccccaacaacgtgaagtcgagtgtgtgtgacattccaccaattggcctgaagatgtccttcacattcgttggcaactcaacctncatccaagagatgttccgccgcgtcagcgagcagttcacggccatgttc

SEQ ID NO: 41541 - DNA, 366 bp, Zea mays
  Clone ID: LIB3062-022-Q1-K1-E4
gcgccgtcaccgcgcacctctggcgttgcatgtgcgtctcgcgcgggctcgccccgggctcgggcactcgggtccgcgtgccggccaacgtccgccaccgcctgcgcccgccgctcccgcggagctacttcggcaacgccatcgtgcgcgacctcgtgaccacccgggtggaggacgtcctggaacgcccgctcgggttcgtggcgcatgcgatcaaggacgcggtggaccgcgtcaatgacgcctacgtgcgctccgtggtcgactacctggaggtggagtcggagaaaggcagccaggcggcgcgcgggcagctcatgccggagtccgacctgggggtggtcagctggctcgggatgcccatgt

SEQ ID NO: 41542 - DNA, 475 bp, Zea mays
  Clone ID: LIB3062-022-Q1-K1-E5
attgtttcagtgtcagcatgtgccgatttaactttaccaagtggtgctggcctctgtatagaagctattcatggtcctacgttcttggtatgtgtctgatagctcatgctacctttcgtttgttcatcttttttctatcatattttgttgtgttcaagtgggtaacatctgttctacagtatctagacataggttacactttaaaatccgcttgttcttcaatcaactgactgaacagtccaaccttctagagttaatgggcggcaaatgtgcaattctctactatagtcaagttgacgaccgctagtgaagataaatggtgtggagtaccgtaattcacccgattcctttttctctcccacaacaggttgcccatagttgggaggctcttgacggctggctagatgccatacgccttgtctacactatttttgcgagagggaagagcgatgtgcttgccggtattattactggt

SEQ ID NO: 41543 - DNA, 468 bp, Zea mays
  unsure at all n locations
  Clone ID: LIB3062-022-Q1-K1-E6
tcgttccacgcgtccgcttagcagctggtgaccagaagtgtgcatctacaattgaaatgcttaaaggcattgtgaaagaggacagcactactaactctgctaaacaacacatggccttattatgtctgggagaaattgggaggaggaaggacctcagcaatcatgttcaaattgagaacatcgtcattgaatcgtttcaatcaccttttgaggagattaagtccgcagcatcctatgcacttggaaacattgctgttggcaacctctccaagtatttaccatttattttggatcagattgacaatcaacagaagaagcaatatctgatgctccattcacttaaagaggtaatcgtgcgacaatctgttgatcatactggccagagtgagctacaggattcanacattgagaagatattggcattgctcttcaatcactgtgaaagtgacgaggagggagttcggaatg

SEQ ID NO: 41544 - DNA, 492 bp, Zea mays
  Clone ID: LIB3062-022-Q1-K1-E7
ttggatcagctcaggatcagcaccgggtgaaggtccatcagttaataaccctagtggatttcaagtcaaaggagatagagaggctactgatggagctcaaaagcaagagtgatgagttccataaccaaaaaagatgtgatgaggcaaagctgaatgctctgtcagaagaaatcgacctactcaattccaagatcgacaagctatccagtgagagaaatgagctattcgaaaagaatgagcagaaagaaaaggaattagctggaattagcgaaaaggacatgcaattgcaagacaaaactgctgagattacttcactaaataaagagcttgtattcctcaaggaccaagtgaagatgcatttggacgaactgcacagtttaaaacgtttgaagaacgagagggaggaaacaattggaaaactgcaaatagatattgggtcactgaaactccagtgtgacaacttgaaaacttcgctgtccaagaaagagtctg

SEQ ID NO: 41545 - DNA, 245 bp, Zea mays
  unsure at all n locations
  Clone ID: LIB3062-022-Q1-K1-E8
gtgtgatcaccaacagctagtgctagtcccccttccttccatccatccatggcatgcgtcaggagccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctncggctcgagctggacgagaactccgaggcgatcatct

SEQ ID NO: 41546 - DNA, 400 bp, Zea mays
  Clone ID: LIB3062-022-Q1-K1-E9
acccatgcgtcagcagacgaatctgcactgatcacagatgcgcaaagacaccatattgagggaacccggacccgatccaaggctgataacacttgcgtcccctaacctggccgacctgcatcccagcaaccatggcattggcctacaatacatcgacctaggccatgaacgcgaatgaggagtgccaacgctggttcatggatatgaagacgaacaaagtgcaccgcttcacgctgtacaacatcgacgagcggacgcacgccgtgctggtgtacaaggtacagcgtccaccagcaaggacacatcaagctcgtggtcgcactgcccgacgacgactgccagtacgccgtcttcgacttcgacttagtgactgttaactactgtcagaatagcatgatct

SEQ ID NO: 41547 - DNA, 78 bp, Zea mays
  Clone ID: LIB3062-022-Q1-K1-F1
cggaactagccactcgtccgatcacagctatctagcactacatactaactatctcttcttcaccctacttaatccaac

SEQ ID NO: 41548 - DNA, 424 bp, Zea mays
  Clone ID: LIB3062-022-Q1-K1-F10
cgcagcggaacgcgctcctcatcgccgccgcgctgctcctctactggatcctgttctccggcacccagctcgtcgtcaggctcgagcagatgcagcagcgcgtcgacaagctcaggaagcgcgacgactgatggatccgcatccatccggtgggctcgttcttcctcttcctgccttgtgttcctgctttatgttgtggtgctcatgttttagatctcggatcgtaatttgagacctgctggtagcatctgcttcctttgccttgccgtcttcagataaaaaagaacagcgctcttggaaacgatgataatgtttaggatgtttggacgaatggtatctgtcgtaattgatgtcttcatccatgagttggttggtgtcactcaatgtacactgagatattggttaatagctactagtgctgttt

SEQ ID NO: 41549 - DNA, 425 bp, Zea mays
  Clone ID: LIB3062-022-Q1-K1-F11
ccgtgactttcatgtatgagcctgacatacgtatcaatgaagaactaatggaaacattgacggtggaagagagaatgagcttgattgaaagcagccctacaaaagtatttgagcttgattctgccaatcaggtggtggtgaaaaacgcggaggcatacacctacgacgacgaggtgatcaagcacgccgaggccatcgggaagccaggcttggtggagatcaccgccaaggaggacagcttcgtcttcaccgtagaaacaaccggcgccatcacagcctacgagctgatcatgaacgcgatcacggtcctgaggcagaagctggatgccgtccgccttcatgacgacgacggcgaccttggcgagctcggcgcccaccttggtgggccttatgagctttgagcaagaaggaatcgccctgtggcc

SEQ ID NO: 41550 - DNA, 354 bp, Zea mays
  Clone ID: LIB3062-022-Q1-K1-F2
cggacgcgtgggcccgtcctgtccttccacccggcggcttaaaccctagttctcactcccatcggcgcttgagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacaatttgatctgattttcgataaagagtttgagctgtcgcacacatcaaaaactaccagcggtttctttactggc

SEQ ID NO: 41551 - DNA, 377 bp, Zea mays
  Clone ID: LIB3062-022-Q1-K1-F3
cccactcgtcacgatccgcctattcacaaactatccttacactttcatgcttaaactccataatctacttcactcgcatcatcgcactacataaatatggcctgaaaactattcttcacaatgtctatcctaaattcattgttcaccgtcctcttatactctacattacaactaccattttctaacacttctttttttaaactgatcaacactaattaatccttaatctatctaaaaacttacgatcatacactaatcattttaactttcttttctaacaagaacacactctctctctttgaacagatcttataccatgacataaaccattctctcatcataaacactatcatcattttatctactgtctaacacat

SEQ ID NO: 41552 - DNA, 446 bp, Zea mays
  Clone ID: LIB3062-022-Q1-K1-E10
gatgccttgtgccgaggagcaagaagaagagggctccaacaagatgccccctttatcttctccttccatgctcctggtcccgcagcaccacctccaaatcttctcgggcctgcctctgcctctgcctcctgaggtgctgaacgacagctctgctacttctgatctgcatgatggccgggaaagcagcatgccggagtcatggagccagctgcttcttgggggattagtcggagaccacgagagatacaacgctgccacagctttactgtcaaaaggattagaggagcgacctgcagcttacaattgctacgaccctggacatggtggtggtgaggagatccagacaccggggaccaacattaggtctcatcaggtgagccagacgctcttagcgtcgtcctctcctaggtcctgcatcaccacaagcctcggcagcaacatgctgg

SEQ ID NO: 41553 - DNA, 461 bp, Zea mays
  Clone ID: LIB3062-006-Q1-K1-D8
caaggaaatcgatgtccagcttagtccagaggagaaagaaagtttagatgagatcatcaaggaggctgagagcgacttggagtctgaggaagtcctggatcaatcccttgccattgttgccaagaatgaaggtttggacaaggacacaactacaaaactcacaatttacactgtaggtggtgttttgaagaatctgacagagggccccttgagtgttatggataagcacatatatgcaggacacactgtcaaaccatttcccagcctgattgaagctggaaagactggttgtttcatcatctcaaatatatttgctaaaggtgttgaggctggagtggtgtacaccggcaacaacaaaaataaagttccatgtgcatggctactttgcttcatcgaaaacaaggctaacgtgaggatttatggagagtgtggaaacaaaaataaattcatcaatgtcgact

SEQ ID NO: 41554 - DNA, 386 bp, Zea mays
  unsure at all n locations
  Clone ID: LIB3062-006-Q1-K1-E1
tttacttgctcttcttgaacatgccatcgctgctgtcaagggtgttcaggatggatcccagaactatgaggcctacttattattcccagttcatttagaangaacattacatgatataactaaaaccatgcttgaaaagaaggaattcttcccaacaattactgttctccagatatttcgccagctttgttctggattaaagcacatgcacagttttgatccaccatatgcgcacaatggggttaaaccagataatgtcctcataacacacaggaagcagtctcatctagcaattntgatggattttgagagtgctggtccaacaagaaagactattagatcacaaactgaagctttgcagttacaagaatgggcttcagagcact

SEQ ID NO: 41555 - DNA, 437 bp, Zea mays
  Clone ID: LIB3062-006-Q1-K1-E2
gctctgcgcaatctccacctccgcaatctgcacctccctactagtagtactcttcggtgcagtgggcatcccgacatctgaccgactctcaaagttcacagctccaatcctggtgcaagcgcacagtagcggagcaagatgcggggaggagaccggccatcggcgtcgctccagctactctcgctgggcctcgtgctcctctacttcttcacctcaggcagcaccgttggtctcgtggagggacagaagacgttgtgcatcgcgaagccgtccgcgtcgaacgagatcctggcgcacaacctggactacgcgtgctcccaggtgagctgcgccgtgatccaaaaaggcgggccgtgctactacccggacaggcccgtgttccgcgccagcgtcgccatgaacctctaatacgcctacagcggcaggcacccctggaa

SEQ ID NO: 41556 - DNA, 375 bp, Zea mays
  Clone ID: LIB3062-006-Q1-K1-E6
acgaacaggcaacagcccagccgctgtcgccctcgttccgtagtacggcgccgccagggggtcagtgaccatgatcatctgcaagaagaaccgccgcgagatctgcaaatacctcttacatgagggggtcttgtacgccaagaaggactacatcctggccaagcaccccaagcttgatgtgcccaacttggaggtgattaagctcatgcagagcttcaagtcgaaggagtatgtgagggaaaccttctcatggcagtactactactggtacctcaccaacgatggcattgagcaccttcgcagcttcctcaacctgccatcagaggttgtgcctaataccctcaagaagtcttccaagcccccgtctcgcccctt

SEQ ID NO: 41557 - DNA, 461 bp, Zea mays
  unsure at all n locations
  Clone ID: LIB3062-006-Q1-K1-E7
atctcgttatgtatgttcagtccccagaaacaaaggatctaacagtttcattaacaagctctggtgggttgcaaaacttggcttcagctacaataacagtttctggcacatcaaattggacaaaagtggagcagaagctggttgctaaaggaaccaatagaacatcaaggcttcaaataacaacgaacaaaaaaggagttgtttggcttgatcaagtatcactcatgcctgaagacacatacaagggacatggtttccgcacagaacttatatccatgcttttggatttgaaaccacgattcttgagatttcctggaggttgttttgtagaaggtgactggctaagaaatgcattcagatggagagagtcaattggtcaatgggaagagaggcctggacacttcggngatgtttggcattactggactgatgatgggcttggatattatgagttccttcag

SEQ ID NO: 41558 - DNA, 465 bp, Zea mays
  Clone ID: LIB3062-006-Q1-K1-E8
ctttgagctcagtagcaaacaagaagcagcaagatagtgatcctccatgggaaacaccctcgggtttggcgtaggtgtcggcctcggcctcggcctcgccgtcggcgccgctgctctgatccaggcttttggtccgaaaattgacgaggaagtggtggtttctcagtatcaatgcaacaccgaggacattgacgagttgtctgccgaggagctgcgcgatgcgatgagctatgtgatgcacaatccgatgctgatccaggtgccggtgttaggaacaacgaagacattctggcgattatctgaggaagccactaggatcagcagaaaactttcattgatactgcgcaaccaccactcagcctgcaagtacctcgaagctcctctgcaggtgtccaatgtctggattgggagcactgggagtgtcaagctaaggggggtcagtttcactggcagcggtttctttag

SEQ ID NO: 41559 - DNA, 440 bp, Zea mays
  Clone ID: LIB3062-006-Q1-K1-F2
gcggagctgtacgaaacggcatctgggagacgcacacgcccgctcgaagcggcgaagcctcgaacggggtgaaaggcatactgtgagaccccccgcgtagcttgatcttcgagatggaggcggcgctagtggagcggctggaggccgcggtggcgcggctcgaggccgtcgtggcctacggcgcctcgctcgcgtcggcggcggcgcgcgacctcgacgctcctgaggcccggatggatccagctatcgtggcctacgacgagttcgtcgcggaggccgtcggacggctcacggctgcggccgaaaagatcggcgggaaggtgcttgacgccaccaaagtgctcgccgaagcatttgccgtcgacaaagacctgctcgtacaagccaagcagctccagaaaccagcatcaatggctgatgcacatggcttttttaagccc

SEQ ID NO: 41560 - DNA, 224 bp, Zea mays
  Clone ID: LIB3062-006-Q1-K1-F3
acttgctctcttgcgcttcctaggcgcttttgcacacatagcgacggtagtgcaactccgcgttcactcggacacacaagctcactgccgtctcctgatcacgaaagctcactccaagccgcccctctgctattctacaaaccatctactccaaagtagatatcaaccgcttgagcactgaacattacagcctgtacgttatctccatttaccagcacttcatg

SEQ ID NO: 41561 - DNA, 466 bp, Zea mays
  Clone ID: LIB3062-006-Q1-K1-F4
ttccgtgtcgacccactcgtgcggctaaagtcgcagaacttcttatggagggtgttcattacaccgttgaactaaagggcaataatgtagatcttgcagatgacggtgtagcacatgctgagattattcttgggacagatgatctatgggatgagaatgatccatgggcaaggtttgtgatgaatgctttgaaggcaaaagtgttctaccgaagggatgtccagtatattgtcagggatgggaaagctattataattaatgagttaaccggccgagttgaacccaagagaagatggtctgatggtatccaccaagcagtataagcaaaataaggcctaaaaatccatactcggtaattgtggctcaaatcacatatcagtcattgcttaagctttatcctaaactttctgggatgacaggaactgctaatacagaagaaaaggagttttcaaagatgttcaagatg

SEQ ID NO: 41562 - DNA, 310 bp, Zea mays
  Clone ID: LIB3062-006-Q1-K1-F5
tcgccctcaaattcgttccgtccaggcaaggaagaaatcgagcagccaaggagaggagaagatggctcgtacgaagcagacggcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatacggaagttgccctgtcagcgcctggtccgtgagatcgctcaggacttcaagacggatctg

SEQ ID NO: 41563 - DNA, 386 bp, Zea mays
  Clone ID: LIB3062-006-Q1-K1-F6
gtaaagccatccccattacctgacagctggaagttggctgaaattttcacaactggagttgtcgttggatatagtcatgatggtaccataatgactatatccaaggatcgtgtaaagccatccccattacctgacagctggaagttggctgaaattttcacaactggagttgtccttggtggatatcaggcaatgatgactgtcatcttcttttgggctgcatacaagacaaactttttcccaaaaatatttcatgtggaaagccttgagaagacagctcaagatgatttccaaaagcttgcatctgctgtttacctgcaagttagcaccatcagccaggccctcatcttcgtgacaaggtccctgaactggtcatttgtcgagcg

SEQ ID NO: 41564 - DNA, 396 bp, Zea mays
  Clone ID: LIB3062-006-Q1-K1-F7
cggacgcgtgggcgacgcggcagcgaggaggaagcaaaggaaaggggatatgtcgaggccgtccgacaggagcgacgcgcacctctccgccgaggacgaggcggcgctggaggccgaggtgcgggagtactacgacgacgcggcgccaaagcgccacaccaagccctcccgcagcgagcactccgtcgtgtacgtcgacgcgctcgtcccggacgtcggcggcaactcccacccggagctggacaagttccaagagctggaagcacacaccgagaggttggtgtacgatggcgccaatgtgggagatgagttcgtggagactgagtactacaaggacctcggcggcgtctgcgagcagcaccacacgaccggtacgggttcatcaagatggacaaa

SEQ ID NO: 41565 - DNA, 311 bp, Zea mays
  Clone ID: LIB3062-006-Q1-K1-F8
gagaagtctttaggtggggtcaaagatggtgtcgctgaagttgcaaaagctccttgcctcgaggtacctcaagtgtgggaaaggcaaggtgtggcttgacccaaatgaagttagtgagatctccatggcaaactcccgccagaatatcctgaagttggttaaggatgggtttatcatcaagaagcctcataagatccactctagatcccgtgcaagaagggcacatgacgccaagcaaatgggacgccactcaagatatggtaagcgtaagggtaccaaggaggctaggctacccaccaaggttctgtgga

SEQ ID NO: 41566 - DNA, 359 bp, Zea mays
  Clone ID: LIB3062-006-Q1-K1-G1
ctacggaacatcgtacgctcaatgacgtcttgctacatcgcaacaggctctttctctcgctcggcggtcaggttcatggccaggtgcccgacgccagtgtccaacgtggtcatgtccaccgttgtgctcctgaccttgctgatcatcacgccgctgttcaagtacaccccgaacgcgatcctgggctcgatcatcatctctgccgtcatacgcctcgtcgactaccatgcggcgatcctcatctggaaagtcgacaagatggacttcgtcgactgcatgggggccttcttcggcgtcgatttcaagtctgtcgagataggcctcttgattgctgtgtccatctcggttgccaaaatact

SEQ ID NO: 41567 - DNA, 419 bp, Zea mays
  unsure at all n locations
  Clone ID: LIB3062-006-Q1-K1-D7
cacaggatgctgaacgaggatgagctacgtgatgctgtgctgcttgtttttgccaacaagcaagatcttcggaatgccggaatgctgctgagattactgacaagcttggattacactccctgcgccatcgacactggtacatccagagcacttgtgccacaactggcgagggtctgtatgaaggcctggactggctgtccagcaacattgcgagcaaggcttgaggcctaccttgaatatcaactgcgaactgactaggaactccggatgtatcatggaaactcaagacagaatcgcagttgcaatctgatagatgtcttctaccggcactatatatganatactgttagatgtgtaatgatggtactgttcaacgcttattacgctactatactgttggatgttctttggacctgttt

SEQ ID NO: 41568 - DNA, 465 bp, Zea mays
  Clone ID: LIB3062-006-Q1-K1-B6
ctctcgtggaagagcagaggcagcaaggacctgctcttccgagtctgcatcgtgtgcgcgtttggcagcgcgcttttcaccaatgacacatgctgtgttgtcctcaccgagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaat

SEQ ID NO: 41569 - DNA, 380 bp, Zea mays
  unsure at all n locations
  Clone ID: LIB3062-006-Q1-K1-B7
cgatagtagttctgtaagttttggcatggctgcaccaggcggtacatttgaaagggcgtcatcggtcaatcctcgccattcttttcaagggattgatctaaatctatctccaagagagtttcccggagaatcacatcttgctgaatcacaagtttcaactgatagcgtatcaactcccactggaagagctggaagaactatttcaggaaggcgtgaaatacaacggtacattcagagtttgttcagaccaagtctacctagtagaccagacacgtaccacaatattgcgcagaacagtggtggtgtatcaaganatgaaccgaaccgctggaactttccttcttcatcagaagcatacacatcacagaatctgcctgatg

SEQ ID NO: 41570 - DNA, 355 bp, Zea mays
  Clone ID: LIB3062-006-Q1-K1-C1
acgatcgagtacagtcgggtaggtaatctggtggtacgacgactgacgacgacatggcggtcaccaggagcaaggggtcatcgtcctcgagctctgcgcagcgggcagcagctgccgtcctgctcgtggcggtgtccgtactggaggtgggctcagcagcggtgtgcgacatgagcaacgagcagttcatgtcgtgccagcccgcagcggtcaagacgacggacccgacggacgcgccgttgcaggcgtgctgcaacgcgcttgcagcggcggaacctaagtgcctgtgcggctacaagaactcgacggggatgggcgtatacaacatagaccacaagcgcgccatggagctttc

SEQ ID NO: 41571 - DNA, 340 bp, Zea mays
  Clone ID: LIB3062-006-Q1-K1-C2
ctctaggtaatctgtggtacacactgacacacatgcttccaccaggcacattggtcatttcctagagctctcacactttcacatctgcctccttctctcgcgtgtccgtcctgtcgtaccgcttccctatgtcgacatatcaacgaccattcatgtcctgccaccctcttctccaatacgactgacccttctgccgctccttctcatgcgtgctgcgactctctgactttgtctaacctcaagttcctgttcggctacaataactctccctgtatgggcgtctacaacatcgacccctatcgctccatgtaactttctgccaagttctgccttatcactc

SEQ ID NO: 41572 - DNA, 416 bp, Zea mays
  Clone ID: LIB3062-006-Q1-K1-C3
gtgtatgaattcattaagaaaagttgggggttctttatattttggtattctgattttgccattggtgcagcaggttgaatatattgggtcctgattattgtgcctcgtcatggatttattgcgttcattgaaccagaaaattgcatcgcactgtctacatttgtattcttgtttaccaagatatcttcaatgggtgatattgatgacaagagagatctcactcctgaggtacacaagatcgatggagacattgttgagttgaatcttcagcttaaaggagatgtactgtagagatattcaatgggtgatattgatgacaagagagatctaatcctgaggcacacaagatcgatggaaagattgctgagttgaatcttgagcttaaaggagacttcttacagtctaaccatgatcac

SEQ ID NO: 41573 - DNA, 410 bp, Zea mays
  Clone ID: LIB3062-006-Q1-K1-C4
cgcagaaaaagaaaaagaaaaggcaaaggcaaaggaatcccaatcaggcaagcaaaaggaagaacgagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgtcggcctgacccacaccttcgggtccatcggcaagcaggtgtggtacgacagggaagtgacggcgttcgtggagccggggcggatgcacggtctcgccggggtgaaaagcaaggagctcctcatctgggtcaccatc

SEQ ID NO: 41574 - DNA, 400 bp, Zea mays
  Clone ID: LIB3062-006-Q1-K1-C6
tcttgtttgtttttttttttttgtttttttttttttttttttttttttttttttttttttttttttttttatgttttttagattaatttttaaattttttttgattttatttattattttttttctttttcttattttattttttttaaaaaacaaaaaaacaaaaaaaaaaaaaattcataaaaaaaattttcctccccaaaaaactttttttaaaaaacaacctaaaaaattttaaaaatatttttcccactaaaaaaacgttaaaaaaattttcctatatctctaaccatacatttaaaaacataattttttaattttaccacaaaaaaaaaatcaccctttttaaaatattattttaaaaaaatttttattgcaaaaaaaaaaaaccccccttttt

SEQ ID NO: 41575 - DNA, 397 bp, Zea mays
  Clone ID: LIB3062-006-Q1-K1-C7
aatcaacataagataaattgttgtagctcaatcctatagtcatactgagctactgattagggtgttcaggaatgaaccattagatttcctgtgctaaaatgaggattgatcataagactaatgacgatcaagactatcaaggcccctacaaacaaagctcatgggaaattagaaagtgaaatgaaataccatgttgaaaacagggccaaagtagctagcaattcaaagaggcaaaatgctgcaaaatataatgcttcatgaggtcagtaaatacatatttggtaattccatgctaatacactgatgctttaagatgcctgagacatctatcttctttgttagttgttttcggtgttgtcaaaatctcatgtgccacaatggatgaaagaacaacatg

SEQ ID NO: 41576 - DNA, 459 bp, Zea mays
  Clone ID: LIB3062-006-Q1-K1-C8
gggctcggttagtccacagccctagaggctgcagctgcacacttcccttcctctggtttcgccggttaaactttccccacttgttgctggccttcgaatctgcggtttgttcgagcttgtaaggatctctccttcttcactctagcaaggaagcgaagaacagggaagcaaggacatggatgctttcagtgcagtgatggacaaggtaaagagccacccagaaatgatggagaaggtcagtgcagtgatggacaaggtgaagaagagccacccagaagcggtggaaaaggtcaaggacgaggtgaagatccttgctgatgctctccatctgcgtagacatggatccaaagataaagaacctgagtctgaagagaaggccgtagaaggcgaggcagcgcatagcgtcgaggaggaggaaggtacctctgctgacaagactgcagaacctaatgtgttgga

SEQ ID NO: 41577 - DNA, 395 bp, Zea mays
  unsure at all n locations
  Clone ID: LIB3062-006-Q1-K1-D1
tcaacataagataaattgttgtagctcaatcctatagtcatactgagctactgattaggatgttcaggaatgaaccattagatttcctgtgctaaaatgaggattgatcataagactaatgacgatcaagactatcaaggcccctacaaacaaagctcatgggaaattagaaagtgaaatgaaataccatgttgaaaacagggccaaagtagctagcaattcaaagaggcaaaatgctgcaaaatataatgcttcatgaggtcagtaaatacatatttggtaattccatgctaatacactgatgctttaagatgcctgagacatctatcttctttgntagttgttttcggtgttgtcaaaatctcangtgccacaatggatgaaagaacaacatg

SEQ ID NO: 41578 - DNA, 414 bp, Zea mays
  Clone ID: LIB3062-006-Q1-K1-D3
gaactagcaagggcaatagcagcttcgctagaggtagtcattgaagcatcagacgccagtgatggtgatatgggtgaagctgaacctgaggaggaaaatgagcccagcttaaacatcaagcctgattatcctcctctccctgaagaacctaaaggaagcagggagcttctctgcagggttgcgattcggctaccgaacaatcaaaggatccaaagaaacttccttcacacagatcctatcaagctcctgtggtcattctgcgctcctcaggttgaggacggcgagaagaaggctttccacttcgtacaggccattcctggagcatcccagaagctgcagtttggaagcgacctaactttcaaggaagcggtgcttgccaactcgatgatcaacctcttgtgggactgatacgct

SEQ ID NO: 41579 - DNA, 454 bp, Zea mays
  Clone ID: LIB3062-006-Q1-K1-D4
agctgcagcacgacctcctggtgtcgatcatgacccgcgtgggcgcgccggacctcctctgggggggctctgggcgcgcctgctcttcgtggcgggccgcggcgcgggacccactcgcgtggcgacgcgtcgacctccgcgactgggtcgccctcacctccggccggcgcgccgcgagacctggacactccagctctcgcgtatccgttcacgccgcgctcgtcggcatcctggaggtcgccgccaagttggccgaagggcggatcgaggccgtgttgctccccgagtttgctgatgaagaccatctcttgttcctcgctgagaggtgcccaaacctgcactatttcagccttactagcacctgtatgacttacgatcagttctgcaaggcgaaaggtggacttcaatcgcttaaaggcatggcaatggatgagagtctgactaactatgatgt

SEQ ID NO: 41580 - DNA, 309 bp, Zea mays
  Clone ID: LIB3062-006-Q1-K1-D5
tcaacataagataaattgttgtagctcaatcctattttcatactgagctactgattaggatgttcaggaatcatccattagatttgctgggctaaaatgatgattgatcataatactaatgactatcaatactatcaaagcccctacaaacaaagctcatgggaaattacaaagtgaaattaaataccatgttgaaaacaggtccaaaatatctagcaattcaaagaagcaaaatgctgcaaaatataatgcttcatgatgtcaataaatacatatttggtaattccatgctaatacactgatgcttta

SEQ ID NO: 41581 - DNA, 433 bp, Zea mays
  Clone ID: LIB3062-006-Q1-K1-B4
aattatctgacggtgcatgccatgcccatgacacccctcgggtgcgagtgcgacatggcccctggagcttctggccagtcgtggcctctccctcgctgcggcctgctggtcttggcccttgcactggcgacgaccgccgcggtgggcagcgcgcagctgtcgtcggagagctactacgacgcgtcctgccccgccgtccttctcaccatcaggaccgccgtctcgacggccgtgctgctggagccccgcatgggggcctcccttctccgcctccacttccacgactgtttcgtgcatggttgcgacgcgtcggtgctgctagacgacactgcgagcttcaccggcgagaagggggcggggccgaacgcggtgtcgctccggggcttcgacgtgatcgacaacatcaagatgctgctggagctgctgtgcccgc

SEQ ID NO: 41582 - DNA, 365 bp, Zea mays
  Clone ID: LIB3062-005-Q1-K1-G6
agtccatctcctgctgagagatgtttgttttacccttctttgcttcctccacctgacacccaagtaagcaactgcagtgacgttggtttcggctgcacccaaactacatgactgaagaaacttgtggcctgtgtaacgcgaatccatcagaacgccaaagttatggcttctggttgtggcaaattatggttcctccctgttcggttgagtggttgcattctggaggtatcttgttctggactcaggctaatgattgtgcgtgcgactgtttcagagtcatttcaaaggttatccactttcgttggagttgatttcataactaaaaaaaaaaatttaataatataaatcataaaaaaaaagggcgg

SEQ ID NO: 41583 - DNA, 229 bp, Zea mays
  Clone ID: LIB3062-005-Q1-K1-G7
agcacgcctgagctgtggcatataccatgcttgattgacatgcaggaaatggcagttactctggggtatgtctcctgtgtcatcagattagacagctcactcagtgcattgcgataccacttatgaatactgcactctgtgctcggactacaattcacactgctaacggtggactactctactgctctcccagaactgcgaagacgctattggctagggctataagtac

SEQ ID NO: 41584 - DNA, 280 bp, Zea mays
  Clone ID: LIB3062-005-Q1-K1-G8
gtgaaagaaggacgaggatcagcaagaggcttaagaagcttcaagacctcgtgccgaacatgtgcaagcatacgaatacgtcggacatgttggaccttgctgtggattacatcaaagagctcaaggaccaagtcgagaagcttaaacacgaccaagcaaactgctgttgcctaggcaacaagagctgctgctgatgcttgagaggcagactgaagaaggtttttatgccgtaacaatgtgactgttaaaccagagctgttgctttaggagaccatgccgt

SEQ ID NO: 41585 - DNA, 269 bp, Zea mays
  Clone ID: LIB3062-005-Q1-K1-H1
accaccgtcgacccacgcttcctaaaaacttattcttaacccatttcaacatttatctaattattccaacatatgcgactccagtgcaattattaagggcccttcgataacacctcataaatattgcattactcaacttacaatctaaattacaaactataatcctatactaactcatcaatttcaatttttaaccaaaattatccacccaaatgttcattataacacattttaaatttgctttgatatattaaacatttcatagatcc

SEQ ID NO: 41586 - DNA, 322 bp, Zea mays
  Clone ID: LIB3062-005-Q1-K1-H3
cgccagtcctcgaaatctccaaggattttctgcggcgaaccccttcgtgacgtgacccaatgggagaggcgtggccgtcgatcgccaaggacgtcaccgagttgatcgggaacactccgctggtgtacctcaacaaggtgaccgatgggtgcgtcggccgcgtcgacgccaagctcgagtccatggagccctgctccagcgtcaaggataggattggctacagcatgatcacggacgcagaggagaaagggctgattacttcaagcgtgagtgttctgattgaaccaactagcggcaacacaggcattggactggcctttat

SEQ ID NO: 41587 - DNA, 226 bp, Zea mays
  Clone ID: LIB3062-005-Q1-K1-H4
gtcacgcactcgtcgctctagtatgttttgcttcgctgttctcgcgccgtgtcgggggactttactggtatctgttgactgcagtctacgaaccgaacgtgggtttaaatcttttttgaactcatcccaactaacacagtaactctaaagcaatcggaatggataccactcctagtcatcagtgctactttactacattcggatgggactgacagcattcccacac

SEQ ID NO: 41588 - DNA, 392 bp, Zea mays
  Clone ID: LIB3062-005-Q1-K1-H5
gagagaagtcagctgaccctgatatccagttaatatgtgatgattccaacatattgagagtggagtgctcttatcaagggcccttctgaaacaccttatgaaggtggtgtgtttcaacttgcgttcgcaattccagagcagtatcctctactgcctcctcaagttcgatttttaaccaaaattttccacccaaatgtgcatttcaagacaggtgaaatttgtcttgatatattgaagaatgcatggagccctgcatggacccttcagtctgtttgtagagcgataattgctctgatggcccatcctgaaccagacagcccacttaactgtgattcaggcaatctcctgcggtcgggtgacatcagaggctatcaatcaatggcccgcatgta

SEQ ID NO: 41589 - DNA, 432 bp, Zea mays
  unsure at all n locations
  Clone ID: LIB3062-005-Q1-K1-H7
agcgaagcagagcactggcatgagcatggaccgcatggcgcggcgttccgtgtcgcgtgctcctggctctggctctgctggccagcgcagcgtcggcagactcgtggctgcacgagaagttcacgacggagggcaacgtgcgcgcggactacaacgcgcatgggcagcaagtgacgtctctgatcctgacgcagcagttcggcggcgccttcagctcgcggcatatgtacctgtacggggagttcagcatccagatgaggctgatcctcggcaactgcgcgggcaccgtgacctncttctacctgtcgtcaggcgacgaggcccgggcacgacgagatcgacatggagttcatgggcaacgccagcgngcagcccatggtgctgaacaccaacgtgtgggccaacggcgaactgcaagaaggagcaccagtt

SEQ ID NO: 41590 - DNA, 250 bp, Zea mays
  Clone ID: LIB3062-005-Q1-K1-H8
ctcacgcacctccgtccgtcgtctagtatgcttcttgccttccgcctgcttcctccgccgcccgcctccggggcggccggttcctgctcatcctctctgatctgcaggttctgacgaaccgaaccgttggggtttcaaatcttcttttgcagactccgatcccaactcaaaacacagagaactctgaaagctaatcggcaatggataaccacatccatagtcaggcagctgctaaccttactaccagttc

SEQ ID NO: 41591 - DNA, 403 bp, Zea mays
  unsure at all n locations
  Clone ID: LIB3062-006-Q1-K1-A2
aacgcagaagctgcactgcatacatcgagctaactatctgcagcgatgtctcgctcctgctgcggcgccgtgggggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtcgccggcgaggccgagcggcggcatggccacgcatggcgacgaccagagctcgtcgggcggcagtggcagcagcggtgagcacggcaaggaggatggcgagaagcagggcaagagctgcctcaccaaggangagtgccacaagaagaagatgatctgcggcaaggggctgcacgctctcggcgcacagc

SEQ ID NO: 41592 - DNA, 450 bp, Zea mays
  Clone ID: LIB3062-006-Q1-K1-A3
caggcttacgggaatgcttgtttggagtatattaaatacattgttttcccttggtttggaagatttgaggtcagccgtaaggggagcaatggtggtaacaagacatttacatgcatgaatgaactaatttctgattacgagactggtgctttgcatcctgccgatgtcaaacctgcactggcaaaagcaataaatgaaattttgcagcctgttcgtgatcatttcaacaacaacaacgaagccaaagttcttcttaacactgtcaagaagtacagagtaaccaattgaggagtggaagctgtccatctttagggcatgtttacattagggtggatatcgccgtttgaaattcttgtatgctattctgttactagttgcataggtagctcaaaagtttcatgtttctagatatataaaaagaatactttacttgttgactacttgatgtgc

SEQ ID NO: 41593 - DNA, 345 bp, Zea mays
  Clone ID: LIB3062-006-Q1-K1-A4
atattaaatacatttatttccattgatttgtaatatttcatgtcatgcgtaatgagaacaattgtcgtggcattacatttacatgcatgaatgaactaatttctgattactagactgttactttgcattctaccaatgtcaaacctgcactgccaaaagcattaaataatatttttcactctcttcataatcatttcaactacatcatctatacctaagttcttcttaacactactaataattacataataaccaattgactacttgaacctttccatctttaaggcatgtttacattatggtgaatatcgtcacttcaaattcttgtatactattctgatacta

SEQ ID NO: 41594 - DNA, 304 bp, Zea mays
  Clone ID: LIB3062-006-Q1-K1-A5
tcggactagttctagagatcatatcgcgcccaccggtcaagatatttatctacgatgggtgtagtcggcctaatacagctgcacagctgagactccactacttctaagatgacgactgcttgccagcaccaaatgatgaactctatgataagtggctcctgcaatttatcagcttcatgatcatccacaatcctggtcgactacgacatacatctactagttgaaaaccattagtgtactcatcatgtgtaattttgtgttacgactctgggaaaatcataacgacaacgtttataaaattaaa

SEQ ID NO: 41595 - DNA, 466 bp, Zea mays
  Clone ID: LIB3062-006-Q1-K1-A6
accgaaacctgcagtcgggtcatctcgtccacgaaacgtacggacttcgggcatggggcccaaggccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgtcaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcacttgaaaactggaccaagcattactgatgcagcaatgagcaggatctcac

SEQ ID NO: 41596 - DNA, 339 bp, Zea mays
  unsure at all n locations
  Clone ID: LIB3062-006-Q1-K1-A7
atctcttccaaatcccaccagcaaatccccaattcctccgagttcgagcgaccatgtcggngcggggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgtcatggacgtcgtctacgccctcaaagcgccaggtc

SEQ ID NO: 41597 - DNA, 196 bp, Zea mays
  Clone ID: LIB3062-006-Q1-K1-B1
ctaatactgacattttgctggtgcgtatggtactttgcttcgtggaacatgaatttcacgtgttctgacggtattacaatgccttatgtgacactcttctatcttttactaaacatccgaatctatccttcgagtatatttaatcgcattaattctatttgaaatgtatttcgcaacaatgtccaatttactcgaa

SEQ ID NO: 41598 - DNA, 425 bp, Zea mays
  Clone ID: LIB3062-006-Q1-K1-B2
tttattgtcagattcatcactctcaagatgacaatatcattgctgcacaagaaattccataggtttcttgtggaaatggtccacctcaatatgactctaatgtaccttcatgcttctagcctgctcgtagttcaactcatatgccattttgtcaaactgaagaagcccataaagagatctgcgctgctacaattattcatacagcatttatagctttcctggcaaggagagcccgccgagctttaaaagggttggttaggcttcaagcccttgtaagaggtcatatagtaagaaagcgagcagctactacactccgttgtatgcaagcttttgtcacggttcatgcccgtgttatagcaaagcgaattcacatggctttggaaaaccagactgatcggcaaaatacttcaccagagcacacgatc

SEQ ID NO: 41599 - DNA, 359 bp, Zea mays
  Clone ID: LIB3062-006-Q1-K1-B3
acgcgcacgcgtccgctacgatccaacagttctatagcaagagagaggaagacacaccgcagagtgagcaggctaagaacttgcaggagcagcatgaatggcggcgactcgtcgcctatcttgctttctcctcgccgtgcttctggcaggagtggccgctgccaccgccttcgacgaagcggctgctgccggcttcgggcttggccacggctcgcgtttcgcgcgcaagcatggacgtgctgccgatgagatgccccagccggagccacaacctaaaactaagccggagccccatatgcagacactgccccagccagaacctaaaccgaaacctatgccacatccagagccaaagcctg

SEQ ID NO: 41600 - DNA, 393 bp, Zea mays
  Clone ID: LIB3062-005-Q1-K1-G5
gttagggagggagagagggaagaggagcgcaaggcgggggggtgcgcggggcggcgcctcgcgtctgcggcggcgctcggcttccggcgagccacccgcgtcaggtttcgacgttcaacaagcggagtcctgggaatgcatatacccagaaccccaccttggcactgggtaatatctgccactctcttatgctcgccagtccatcataaacgcagtcgctggttgcatctgatgcaagaacatcctgttcctcagacactaactggacatagccctgatttcgttcatcgtatcttggtgcactctcataatctcgttccttctcctactgactggggccgacctgaacgaccagagaggcgaggagaacatgtacttcggtagcttctgcta

SEQ ID NO: 41601 - DNA, 483 bp, Zea mays
  Clone ID: LIB3062-022-Q1-K1-C6
cgtgaggttctccggggttcggcttcgtgggtgagcggatcgagatggcggcgtcggatgttgagtaccggtgcttcgggggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaagaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggctggcgccgtgatggcggcggcggctacggcggtggcggcggctacggtggtggcggctgcggctacggtggtggtggcggcagctacggcggtggcaaccgtggcggcg

SEQ ID NO: 41602 - DNA, 456 bp, Zea mays
  Clone ID: LIB3062-022-Q1-K1-C7
ctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcagggcggcgcgcacgacgagatcgacttcgagttcctgggcaacgtgtccggcgagccctacacgctgcacaccaacgtgttcacgcggtggcaggggcagcgggagcagcagttccgcctctggttcgaccccaccgtcgacttccacacctac

SEQ ID NO: 41603 - DNA, 225 bp, Zea mays
  Clone ID: LIB3062-022-Q1-K1-C8
aactacccactcggtcggacctatatactaggcttcagaaataccccatttgagatcttttcatcccttgtttcctaacaggctatagggtcaacacttctaaatgcaatcaccttcagactaatccaatcaatcttagccactgtgcataccttactcatatcgatagtccagctcgcttcccgcttaaagatcaatggaaaacaatagcctcaacagatctgc

SEQ ID NO: 41604 - DNA, 425 bp, Zea mays
  Clone ID: LIB3062-022-Q1-K1-D10
gccaagggaaccaagattcatcgcaggagttccagcctagaagaataagcttgcttgccgggttttcttccctcggatggcgagacaagaacaagggcaagcagaacggctctgatgagtcaacaaacggtaagctcaataatagcaccgatcaaggggttgaaacacccaaaaaggacgactcgccaaaagagggtgaacagattgtccgaacaccggaaagagacaatgaactgagactagggacacccaagatggatagtgaggtaccaagtgtggaaatggcggcaaacagtacgaatgggctggaggaccagttggaggagataaaattggattgatatcctttggctggtctctaagtcgcaacataaggtgccattaaattatgtattggtgtatccattttccacctctattctttt

SEQ ID NO: 41605 - DNA, 417 bp, Zea mays
  Clone ID: LIB3062-022-Q1-K1-D11
ctgaccatctatcacttcgaccttcccagctctgcagatgaatacatcggcctgcgagtccgagaatcatcgatgattttaccgcttacgcagacgtgtgcttccggagcttctgcgacagggtgaagcactggatcacggcgaacgagcccaacatcgagcccatcggcggctacgaccaacgctacctaccgccgctccgatgctgctacccgtttggactgggcgtcacctgcacccacggcaacttcacgacggatccgtacgccgtcgtccaccacctactgctcgcgcatgcgtcggctgtgttcctctacagacgcaagtaccagggcgagcaaggaggacggattggactgacgttgctggcctggtggtatgagccagcgacgcagaaacccgacgatgtagaagcag

SEQ ID NO: 41606 - DNA, 427 bp, Zea mays
  unsure at all n locations
  Clone ID: LIB3062-022-Q1-K1-D12
caaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagccttgcaatgagtgcaaggggactggagagagcatcaatgagaaggaccgctgcccagggtgcaagggtgagaaggtcattcaagagaagaaggttcttgaagttcatgttgagaaggggatgcaacacaaccagaagatcaccttccctggtgaagctgatgaagcgcctgatactgtcactggagacattgtattcgtcctgcagcagaaggatcactccaaattcanaggaaagggtgaagatctcttctatgagcacaccttgtc

SEQ ID NO: 41607 - DNA, 347 bp, Zea mays
  Clone ID: LIB3062-022-Q1-K1-D2
agtgtatttacgaggataaagagtttacagagttcaaagcttttgatcctctgtttcctaacaggccacaagaggaacactgcgaaatgcatgccccttgggaagaaaccaaaaaatctcagccatggtggcaagtagctgatgtcgatggtttggcttcccttgtcgctgaaagagcaatggaaaacattgtcaacaatgatctgccaagacccactcagacagtccgggttcatggacctcaagtgaagggccctgaaaacaaggatgattatgggatgtctgttgtttctgggggccaagagccagatcctgtacatgacactatggagtgcagctacagtgtt

SEQ ID NO: 41608 - DNA, 450 bp, Zea mays
  Clone ID: LIB3062-022-Q1-K1-D3
gaagaaaaggagatagagtacaggttacagacaggcagagagcaaagatgtgtggtggtgcgaggctcgcggagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccatgagcagcggagccggcgccgggcgcccgaccagcatcagtacatgggcgtccggcgccgtccgtggggcaagtgggccgccgagatccgcgaccccgtcaagggcgttcgcgtctggctcagcacctttcccttcggcgatgccgtcgcgcgcgcctacgaccacg

SEQ ID NO: 41609 - DNA, 473 bp, Zea mays
  unsure at all n locations
  Clone ID: LIB3062-022-Q1-K1-D4
tcgcggacgcgtggggttagaatggatcctcgaaacaaagaagttaatctcgatagtttaatgtatggtacaaggggtggactaacagaacaagaactaataaaacaagaagcagaatacatttaccgttaccgttacaatggtggtggggcaactcaagtttggctaagttctggaagatttgttgtaatagatctttcagcgggcccttgtacatatgggaaaatagaaactgaagaaggcagtgtcagctataggtcaatgccacggctgtcacaaataatcttcccaagaggacttgctgccccaagtgctagttcaacgcaagatattttcattgggcagctcggaggtgcaattgcaactaccattgagcatgtgatagctcctgatataagatttgaaactgttgacatggcagtgaggttgcttgtacctattatngtgctacagaaccacaataggtacaacat

SEQ ID NO: 41610 - DNA, 477 bp, Zea mays
  Clone ID: LIB3062-022-Q1-K1-D5
cctgaaccggactaagctgttcccccctgctaatttcaagatcgtgggtgcatcagcgctgaagccggactatgcctgtggccagccggtgcctgtcagcccaaccgcgttcccagacccgagcgggcttgactcgacgacgcttgctgtggcaacatggcaggtcgtgtgcaacattaccacgacaaagggggccaagcccaagtgttgtgtgaccttctcggcgtactacaacgactcagtgatcccctgcagcacctgcgcttgtgggtgccctgcaaacaggcgagggccaacgtgcagcaccaccgcacaatccatgctgctgccaccggaggcgctgcttgtgccattcgacaaccggtcacagaaggcgttggcgtgggctgagctgaagcattacaatgtgccccggccgatgccttgcggtgacttctgtggcgtgagcatcaattggcatgtctcaacggactacaa

SEQ ID NO: 41611 - DNA, 226 bp, Zea mays
  Clone ID: LIB3062-022-Q1-K1-D6
ggtgggtacaacactcaacacaactgagatcattcaactacctacatcacatcagggcatagggcgtactatccgacacacatgcccatacattaaaaaaccaacagatatgatccatggctgcaagtatctcatgtcgacgattagtcttacattatcgctgaaaaagcactggataacattgacaacaatgatctgccaaaacccactcatacagtacacgttc

SEQ ID NO: 41612 - DNA, 475 bp, Zea mays
  unsure at all n locations
  Clone ID: LIB3062-022-Q1-K1-D7
gtggacttaatgatcattgccagaggaacacccggattctccggtgcagaccttgctaacttggtaaatgttgctgcacttaaggctgccatggatggcgcaaaatctgtcacaatgaatgatcttgagtatgcaaaggaccgaatcatgatgggtagtgagcgaaagtcggcagttatctctgatgaatgcaggaagctgacagcataccatgagggtgggcatgcccttgttgccatccacacagaaggagctcaccctgtccacaaggctaccatcgtacccaggggggtggccctaggaatggtggcccaactccctgacaaagaccagactagtgtgtcaaggaaacagatgctagcgaaactggatgtctgcatgggaggccgcgtggcagaagagcttatatttggggatactgaggtgacctncggtgcgtcgtcagacttccagcatgcaactgcaatggcaagag

SEQ ID NO: 41613 - DNA, 460 bp, Zea mays
  Clone ID: LIB3062-022-Q1-K1-D8
caatgctgcacaaggcattctatcttcattcttctttaagtatgcagacacaattttgaagaggtattcgtcaactgttgccacaatatttactggcctagcttctgctgcatttttggggcattccttgaccattaattctctcctgggcatatcagtggtgtttatttcaatgcaccagttcttctctgcgcttgcaaaagtcaaagatgacaaaccagctgactcaatagagttggaagatacacaaaatgaccgcccatctgaatcttcttttgtaaatatgactgctggtgccgctgatgatgcaagccatcggattggaactgatgagaggcagccgctattgcctatatgaacttgtttgttgaggtaggacagaagagaggggatagaagaagaggctccttgttgccgtgtgagcagcagatttgatgtagcattgataggcgaataaaca

SEQ ID NO: 41614 - DNA, 431 bp, Zea mays
  Clone ID: LIB3062-022-Q1-K1-D9
gtgcacgcaagcagagaggcgtggaacttttcctttgctgggccataatgcaaggatttgtcatgatgctgcagaatagatatgggcgtcaaagattatatactaggattgctttggggaaggctaaaagaatggatgttgtatggggagagactgctggtgttgaaggtcaattgttgctgttgtgccctctccttttcctcctgcagggattcgagggttatgttgggtttttacttctgcgcacagctcatactggcgttgtccctgagtggcaggttgtggtatgcgggatcctgctgatcgcgattgcaatcggtaactttgcaaacacagtggacaccctggttaccaagttccggttcaaggcgaagatgaagaaatccaatggcaaacgggaccttgacacatgcccctcgccaacaggttca

SEQ ID NO: 41615 - DNA, 415 bp, Zea mays
  Clone ID: LIB3062-022-Q1-K1-E1
tctattgtctcaatgacaacatgctcagaaacaactttaccatgcggtgctgaccttggtatctaggctaatgatgctcctactaacgctgcctttgattgatcactaattctaactatcaattatccatattattcatatcatataatcatgatttcaagtgagcaacatctgttatacatcatctatacatacattacactttaaaattaccatgatcttgaataaactcacttaacaatccaaccttatagacttaatgtgcccaaaatgttcaaatctctactatagtcaagttcacaaccattattgaacatatacgttacaaagtaccgtctttcaccccattgcttcttatgctacacaacatgtatcccataattggaaggctcttgacagatgactttataccata

SEQ ID NO: 41616 - DNA, 474 bp, Zea mays
  unsure at all n locations
  Clone ID: LIB3062-022-Q1-K1-C5
ggaggacgaggagttaatgctctttcttttccctgctctttatctaattactaatggagggagagagaaaagagcaaggcatgcttctattctacctggcaaggagagacttaaagagattcttgaagggcacgagaagaactgtcttgtcgcattccgtatggagcctcgtatattcaaagatatagcaacatttcttagagaagaacacatcctatgtgacacaaggggtgttaccgtggaagaaaaactaggttgtgtgtgtgtgtgtttttctttctttcctcctgaacttgcaaagggcgctatgccacctgtgttcaaatgatacacaacatccaaagagaaagcatgaggaggaaacatgatgcactcctgcctggcaacagatcctncacatgtctgcactctctacatcattggacacactntattnctggcagatagtagttaagtttaatttatgttttcttt

SEQ ID NO: 41617 - DNA, 422 bp, Zea mays
  Clone ID: LIB3062-022-Q1-K1-B10
ctggtgtgaatatatccttttccaacaacattggggcctatgagtttcaaggcgatgatggtggccccagttggaaacccaggcctctgatccacttaagtttagccaagaccttctctcagatggatcttaggggtcttttgctggaaaaaacgaaaactgagcttaaaaacaagctaacagtaataaaaagtaaaacatcccaagttgctagtgaaaaagcgagcaagaaaattgcggtcaaggaaaatggtggggataatgaagctcttggaccagaagatcctacagctattaaagattctcatgattcagaacagactggttctaatactagcacagatgctgaaaatgaagatgatgaccacttatcttataatgttcctgatccagatttccatgattttgacaagaatcgcact

SEQ ID NO: 41618 - DNA, 327 bp, Zea mays
  Clone ID: LIB3062-022-Q1-K1-B11
gggcctgctagtgttgctgagtctgctgtacctgctagccttggagtcgctgctgggcctgctgtacttgaaaagagccaaaagatggcacagcaaaatggatcctctgctgctgaaagcacaaactctggcagtactcaagatgcattgaataagcgattggagcagcttgtcaattcccatcctgggttttaatttatgaagggaaccccagaacaaccaaggtgtggtttcagccgtaaagtggtgaacattttgaagcaagaaggggtcaaatttgggagctttgacatccttacagataatgatgttcgtgaaggtatgaaa

SEQ ID NO: 41619 - DNA, 444 bp, Zea mays
  Clone ID: LIB3062-022-Q1-K1-B12
cttgatgctggcccttcacaagtttaaaacgtcagagaacctcaggagatattcaatcgatggcactgagcctcgcgtcctcttcgcgctctgctgtgggatgttctcttctcctgcggtaagtgaccgagtaaaaacaatgggaccctgttacagaaactaattataggggcgggtatgttcttgggatgctttcatgtatagttgctggagttagaaattttctcagcagatagcactgcatggcttgaagtaactaactgagcatggatctaaagaccgtttcttttcagaaaatttgcacacaataaattgtgtttccagtgtgctctgtcacaatacttagctcttcacttcttccctactcatattttggaaaaaaaatgacaacatcctatcaccccaggtaaggatcttctctgctgaaaacgttcgagctgagct

SEQ ID NO: 41620 - DNA, 463 bp, Zea mays
  unsure at all n locations
  Clone ID: LIB3062-022-Q1-K1-B2
agctagcatacagacgaataatctcttcttcacctcactaacaccagctagcaactctttctcgcctgcaggatggccgctcgctcctactcctcccagccgcagctggtcgcggcggcggcggtcctggcagcggcgctgctgctgctggcggcggtggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcagccccaccgtcgactgcaccaagatcaactgat

SEQ ID NO: 41621 - DNA, 484 bp, Zea mays
  unsure at all n locations
  Clone ID: LIB3062-022-Q1-K1-B3
gtttcttctagctctgtttcatactccagggccagagtcttgctgtatatttgttgagtaatagccatgtgtgtatgtggactattccctgaaggttatccactaaattgttcatttccagatttagataccatgcctaaatgtagtgccctgataccatgaattagctgagatccaacacctattttattgatcacaattgtacttttatgtatacaacggcacatgatgctcttgatctgctccataaaaagctaaaagtgcatgatctangaatagaaggagcgggtgcctttgttaaccatagcattttgcaaacttttaccatgaatgtatgattgccgaacttgttaactgaatttatcagttgaactactttgcttatagcatacacacttaacacaatatcagcctgtgaaattctgggaaggtggattttgctttttttcccttgtaattcgcaatttcacagatgatcttgaat

SEQ ID NO: 41622 - DNA, 330 bp, Zea mays
  Clone ID: LIB3062-022-Q1-K1-B4
ggccactaacactagttatcacatccaccataacgaccatggctaccacctcagctttgctagctgttgtctgggtagccagcctccttgcaggcacggtgttcagtgatgatatcgtacccatccatatacccttgttggatcggttccaagcctggcaggccgaatacaaccgcacatatgcgaccccagaggaattccagcaacgcttcatggtctatagcgagaatgtcaagttcatcgagaccatgaaccagcctgggagctcatatgagctcggtgagaaccaattcgctgacctcaccgaagaagagttcaaggacacgtatc

SEQ ID NO: 41623 - DNA, 480 bp, Zea mays
  Clone ID: LIB3062-022-Q1-K1-B5
atcccagcatccgagagagctccacaggccaggtccccatcgccgcggcgcttgcggccacctcgcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgagttgaagcatgtgattgctgctacaattggtcttaagggtcttggaagcctcctttttattttgagcagctctctcggtgcttatctcctgctgctgtaccttgctttgatcactcctatcatccatgacttctacaactacgatatggagaaggcagaatttgcaggcctctttgcgaagttcacccaggatttgg

SEQ ID NO: 41624 - DNA, 472 bp, Zea mays
  Clone ID: LIB3062-022-Q1-K1-B6
caaggataactgcccggtacggacattcagaggacacaaaaatgaaaagaactttgttggcttgtctgtgaacaatgaatatattgcttgtggaagtgagacaaatgaggtttttgtttatcacaaggctatctcgaaaccggcagcaagccatagatttgtatcttctgacccggatgatgccgatgatgatcctggttcttatttcattagtgctgtctgctggaagagtgatagccctacgatgttaactgctaacagtcaggggaccataaaagttcttgtacttgctccttgatgttatggagggcgttcaagaggttcacagtactgtccagttgtttcctttcgtgtcattatattcccccaaaattgggaacggtggcataattgatctccggttagggaatgaagttttgcagatggtcagctgacgtagggttttgaggtatcagaatgtgcatagtcatgt

SEQ ID NO: 41625 - DNA, 363 bp, Zea mays
  Clone ID: LIB3062-022-Q1-K1-B7
gtcacacacacacacacagacaagtggtttacaaagccaagtgtgtgtactagcagcgagctagctcgggcggcatcaggcagtcatcatgtcagaggagaagcaccaccacttcttcaaccaccacaagatggacgaggagcagcccgccggcgagtacgggtactccgagaccgatgtggtcaccgacaccggcgagggcgagtacgagaggtacaagaaggaggagaaggagcacaagcacaagcagcacctctgcgaggccggcgccatcgtcgacggcgccttcgcactttacgagaagcacgaagcgaataaagacccctagcacgctcacaggcacaagatcaccgaggaagtcgc

SEQ ID NO: 41626 - DNA, 445 bp, Zea mays
  Clone ID: LIB3062-022-Q1-K1-B9
catagacaggcgtcttcgtactcgcctatctccgcgacccaaagcgttcccccttctcccattcttctctcatttggcaccagcgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctaatcagtggcaaggaggatgcagccaacaacttcgctcgtggtcactacaccattggc

SEQ ID NO: 41627 - DNA, 318 bp, Zea mays
  Clone ID: LIB3062-022-Q1-K1-C1
atcgccatctcttctcttcttttgctcgctctatacatataccagagaggtaggtagctagctggctagtggtgaaaatacaatggcgcagcggcagggaagaggcagtggtgctgtggcccttgcggcggcggcggcggtgctcctctgcgtgctccttcatgcccacgtcgcggagtcggccgtgttcaccgtcggcgaccgtggcggctggagcttcagcaccggcacctggactaatggcaagcgcttcaaagctggggacgtcctagtgttcaagtacgactcgactgcgcacaacgtggtggcggtgaacgc

SEQ ID NO: 41628 - DNA, 439 bp, Zea mays
  Clone ID: LIB3062-022-Q1-K1-C11
ctcttgatagaaaaaccagagctgtcaggcaacactgatttcgacactgcttgaatctatctgattctcttatgcgtcagatgttgtgcaacttgatgttgacttgttggatttctgatgtaattaatgcagtataatagggggctagaactgatgaaaaactatggttacaaaaatttatacaaatctatcgaatctgataagcgtgtgcattgcccttgacaggttggacaactcatgtagcatgttattttggttgattgtctctctttttttttaaaaaaaactatctgtacagtgcatattgacacaaccattttctcaggtctttgatctttcagttgtgaagccttcagattttgttcaccatggtttgagttgtttggagaggttagctgaccaaggcgataaccgtgcgaaggctgttcgtgagaaaatg

SEQ ID NO: 41629 - DNA, 408 bp, Zea mays
  unsure at all n locations
  Clone ID: LIB3062-022-Q1-K1-C12
gattagttacttcaatgcaaaatttttcaggaacagtattaatgtgtggtaccagttcattccccagctgatcttcttgaacagcttatttggctacctgtccttgctcattattattaagtggtgcacggggtcgaaagcagacctataccacgttatgatctacatgttccttagcccaacagatgatcttagtgagaaccagttgtttagtggccagaagacagtgcagcttgttctacttctgcttgctttagtgtctgtaccttggatgttgattccaaaacctcttcttttgaagaaacaacatcagcaaaggcatcaaggtcaccagtacgctatgcttcanggcattgatgaatcagtgggagcagaattgggggaacatcatgaggacgcacatgacca

SEQ ID NO: 41630 - DNA, 302 bp, Zea mays
  Clone ID: LIB3062-022-Q1-K1-C3
gggttaggaaggcggcggccagcggcgagaggaggaggggtgggtcagccatgacggggaaggcgaagccgaagaagcacacggcgaaggagatcgccgcgaagatcgacgcggcgacgacgaaccggggcggcggcaaggccgggctggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcac

SEQ ID NO: 41631 - DNA, 456 bp, Zea mays
  unsure at all n locations
  Clone ID: LIB3062-022-Q1-K1-C4
ggcggctgtgctgaacagcaggaagacgcctcaggcggtggtggccgtgctggtggcggcggggctgctgggttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcccgccaacagcgtcaagagcgtcaacatgggcaccgtcggcaccatccccggcaagtgcggcgtctncgtcggattccccatcagcatgtccaccgactgcaacaagatcagctaagttacgacgaccaagctaataagcctaccgaacgtacacgtacgccccgcgcgctgcacgagtgatgaaaccagggaagaaaataaa

SEQ ID NO: 41632 - DNA, 472 bp, Zea mays
  Clone ID: LIB3062-022-Q1-K1-B1
atcacagtatcacaccatccccactctcttctctgcacccggcgagcggacactcccctgtggggttgacgggatcccgtccccgcccgcccgccccgccggcgcgcgcgctggtccggacgctcgggcgctggtgatccggttgatgcagcagcggggcctcggccacaactgccgctcccgcggcttctcccgctcccgacgcgcagtcgagggcgcctgaaacgcacccgtcccacgcacgcagggcaaccgaaaacccctcgatccggctctcctcgcgctgtaggctgtataacgccgtagacgacaacggaggagaacggggacgaataaaacccaacacaactaccggcgtccgtataggaacgaaggactcgagatggacaccgtcagcgttcccgtggtggcccgtgcgaatgggatccgggaggtggagcgcaaggtgcagaaagactactgggaggagcac

SEQ ID NO: 41633 - DNA, 326 bp, Zea mays
  Clone ID: LIB3062-021-Q1-K1-H5
aatggaaaagggcaattgcagacgtcctgatattctatcgggaactctctacatgatggatgggtgaatatgggcacctggaaggtaagggaaacacacgcccattctcacaattgatcacatgttcatgcttcctggaactccccattatgcattcacaaggggataatttggtgatacatggcaaaccggtgtgagtctatagtataactggctgtaatggaactatcacatcctaggaaataggccaattaaatttgggcctggatttaaaatcgggattcttgttcaatatgaaagatagcactatattccaaaataaaaag

SEQ ID NO: 41634 - DNA, 423 bp, Zea mays
  Clone ID: LIB3062-021-Q1-K1-H6
gcgtcccgggatagatccccgggctccacgccttcacaaccattccgcccgatcccgacccgctttggggacgggattgccgaccggcggtgctgcaccttcctggagatcctcttcgccatcatccttccggccctcggcgtcttcctccgattcggctgctgcagaatagagttctgcatctgcctgctgctcacaatccttggctacgttcccggaatcatctacgcgatctataggcctggtgcgtctcgactctgaccaccacgagagggaatactacacccttgcttagagcatctggttgtgccaagcgggcctgcacagatgagtcgaaatcagtattttttttctcatgtggattgtctgacatggcatatacggcaatgggtaaccaagtgttgtgggctatatctctgttac

SEQ ID NO: 41635 - DNA, 468 bp, Zea mays
  Clone ID: LIB3062-021-Q1-K1-H7
agcatagtcgactatatcttttctgcttccagacattgtccacacgagctagtgcactggtgtcggtcgcaaccaaatgaaggacgtactgagccatggcatccaagggcgtcctcttcttggctctcaacctcctgttcttcacagtggccaacgcctgcggcagctgcccgaccccaacgtcgccggtcgtgccaccgccgccgacgtctgcctctgcacggtcatcaagggcaacgtcctcggcgtcgtcttcgatgtccctatcaagttcaatgccctcgtcaactactgtggcaagtgcgtgcccaagggctacatgtgtgcgtaagctccgcgcggttacacgctcgtagccgttcgcgtgcgtaattaagcatgcacctgcatggcacacatgtattgtgcgcctgctgatctctcctgtctcatttgtgcaccttaagttctacagtcctagaaccatat

SEQ ID NO: 41636 - DNA, 406 bp, Zea mays
  Clone ID: LIB3062-021-Q1-K1-H8
gtcgagcacgcgtccggtgatagatccccgggctccacgcctccacaaccatgtcgtcccgatcccgaccagctttgagggcgcggaggcggacggacgctgctgcaccttcctggagatcctcttcgccatcatcctcccgcccctcggcgtctttctacgattcggctgctgcagaatagagttctgcatctgcctgctgctcacaatccttggctacgtccccggaatcatctacgcgatctatgtccttgctgctctcgactctgaccagcacgagagggaatactacacccttgcttagagcatctggctgtgccaggcgggcctgcacagatgagtccaaatcagtatattttctctcatggggattgcctgacatggcataagcggcaatgggtaacca

SEQ ID NO: 41637 - DNA, 451 bp, Zea mays
  unsure at all n locations
  Clone ID: LIB3062-021-Q1-K1-H9
cccgcgacgcccacccggcgcacgcgctgaggctggtggccaccgacgacggcgcgccgtggcggtgcgacgggtgcaaggagcccggcagcggccaggggcggcggtacaggtgcggccacggctgcgacttcgacctgcacgtggcctgcgcgctggcggggccgactctgaggcaccccctcttcggcgagggcctcgagttccagctcctcccggaggcgccgtcgcccgtcgacaagacgttctgcaacgcctgcggcctgcgggcgcccggcctcgtctaccactgtttcgacagggacctggaccttcacccgacctgcgccgcgctgaagccggagagcgccttcccgggcggtcacctggcccagctcggctgggaggccgccgagcaccgctgcgtcgcctgcgacgccgtcgtcgtcgncggcaagaggttctgggcgta

SEQ ID NO: 41638 - DNA, 410 bp, Zea mays
  Clone ID: LIB3062-022-Q1-K1-A1
tgcaatacttccatgagaatgctacttttgctactgttgttggccgaaggcgactcctgtgatggatctttctgggacagtaggtgctcaaggagttgcatttgatgcataagctgggtatgacactgctacaggaaaatttaccaagtacactgctgcaattggtgtaaccaagccagactaccatgctgcattcattctgtcggacaaatgttacaccattaaagtgtcaggtgtttatcaccttgatgagaaacagaatgcctcagctgtagctgagctaacccggaggctctcaacaaatcagaacacactcacagtccttggactgtacacagatgatccccatacagcttttataagctagactcaatatcactggaacgcttgccgcgcttctttagcatgag

SEQ ID NO: 41639 - DNA, 149 bp, Zea mays
  Clone ID: LIB3062-022-Q1-K1-A10
ttcccggtcgacgcatcgtactcccacacatacactcccataataaaaagcttctaatactccattcatcttactagccccagtttaacatcgagcggtgcttgagcccataatgttgcaatcgaaacccattcacttattcattcccc

SEQ ID NO: 41640 - DNA, 295 bp, Zea mays
  Clone ID: LIB3062-022-Q1-K1-A11
agaggaagcagcgcgtcctcgcctaaagccctcgccgccctctttcggctcctcgcctggggtccacgcgcgacgacgtgtcggcaaacactcagtccatcccaagactcgcgaggcgatggtggacgcgtggtggcctctgctgggcgcggcgatcccggcgctggtggcgggtcagtttgtccgcatcaagcgccggcgcgacgaggagcagcgcctcaaggcggcgcgcgggcgggagaagagctccgacgaggtattcgtctgcgagcgcgtgtgcaccttcaagcgtatg

SEQ ID NO: 41641 - DNA, 423 bp, Zea mays
  Clone ID: LIB3062-022-Q1-K1-A12
ctgtcacacacacacacacagacaagtggtttccaaagccaagtgtgtgtactagcaacgagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaag

SEQ ID NO: 41642 - DNA, 318 bp, Zea mays
  Clone ID: LIB3062-022-Q1-K1-A2
tcgcccctcccaaagctcgccccgctcccagctagggtttcctcttcccatccacagccgccggggcgccgtcggggaggacagcgccgtcacgatgttggagttgcgtctggtgcaggggagcctcctcaagaaggtcttggaggcgatccgcgagctggtcacggacgccaacttcgactgctccgggaccgggttctcgctgcaggccatggactcgagccacgtcgcgctcgtcgcgctgctccttcgcgccgagggcttcgagcactaccgctgcgaccgcaacctctccatgggcatgaacctcaacaacat

SEQ ID NO: 41643 - DNA, 354 bp, Zea mays
  Clone ID: LIB3062-022-Q1-K1-A3
acttttactctttctctgtaatactttcatgattatgcaactttcgctactgttgttggcactaaggctactcctgtaagggatctttgtgtgacagtatgttctcaaggagttgcattttgtgcaaaagctatgtatgacactgctacacgaaaatttaccaagtactctgcttcaattggtgtaaccaagtcagtctaccatgcttcattcattctagacgacaatggtgacaccattaaagtttcatgtgtttatcaccttgatgataaacataatgcctcagctgtatctgatctaactctgaagctctcaacaaatcagaacaaacttacattccttgtactttacaca

SEQ ID NO: 41644 - DNA, 445 bp, Zea mays
  Clone ID: LIB3062-022-Q1-K1-A4
cgccaagtcagcagcacaaattgataggaatcggcagggtaatcttcaagatgaagaacctagggggattagcatctaggattttctagagtagctgctcgatggaaaggtaatccacgagcaaacaaagtccgactttcaaaaatgtcggcccgcctgaatatcttgagctgaggagtgctggactcattattcagttccctcaaaattaaagaagaaagacatcccctacctatccacagcggttctctctaaattgtccctgctatatcatttttttgtgtcacatcaacattccatctgctactttttcaatctccgcaacagttccccctaaatacttttcctataccttaattccaccattaaatattaattcccataactattcattatccgttacattttttcgtcaactaacaaaccataacttacacagaaatcg

SEQ ID NO: 41645 - DNA, 467 bp, Zea mays
  Clone ID: LIB3062-022-Q1-K1-A5
cggacgcgtgggctgcaatacttccatgagaatgcaacttttgctactgttgttggcacgaaggcgactcctgtgattgatctttctgggacagtaggtgctcaaggagttgcatttggtgcagaagctgggtatgacactgctacaggaaaatttaccaagtacactgctgcaattggtgtaaccaagccagactaccatgctgcattcattctggcggacaaaggtgacaccattaaagtgtcaggtgtttatcaccttgatgagaaacagaaggcctcagctgtggctgagctaacccggaggctctcaacaaatcagaacacactcacagtcggtggactgtacacagttgatccccagacagctttgaaggcaagactcaataacactggaacgcttgccgcgcttcttcagcatgagcttaaacccaagtcgctcttgacaatctctggtgaattcgacac

SEQ ID NO: 41646 - DNA, 372 bp, Zea mays
  Clone ID: LIB3062-022-Q1-K1-A6
cggacgcgtggtctgcaatacttccatgagtatgcatcttttgctactgttgttggggctaatgcgactactgtgatggatctttgtgggacaataggttctcaaggagttgcctttcaaacagaagctgtgtatatacactgctacatgaaaatttaccaagaacactactgcttttgtcataactaatccagactaccattctacattaattacgtcggacaaatgtgacaccattaaagtgtctaagtgttatcaccatgatgataaacagagtgccttatctgtggctgatctaacccttacgctctcaacaaatgagaacacactcacaatcggtagactgtacacagttgatctcaagacagcttc

SEQ ID NO: 41647 - DNA, 477 bp, Zea mays
  Clone ID: LIB3062-022-Q1-K1-A7
gctctgctagctagctcttgtcttgtcactgagtgagcatgcagcagggagctgtgtagctagcctagtacaggtggagtggagtgtgtggtggagtgcaaaccaaatcaaacgaagaaaaagaagcagcagcagaagaagaagacacccaccaccagcagcaagcagcaatcagcaaccagcataacgaaatgtcgatcaagtactgcgaccagcacaaggactgcgagcggcagcgtctgtaccgtcgcttctgcgccgtcctggtgggcgtcatcgtgctcgtcctcctcatcgtgctcatcgtctggctcgtcctccgccccaccaagcctcgcttcttcctcaacgacgtgagcatcgtgtgcatcaacgtcagctacgtcttctacctcaccgtcaccatgcaggccacgctggcgtcgcgcaacaccaacgaccgcgtcggcatctactacgaccgcgccgacgtgtacg

SEQ ID NO: 41648 - DNA, 473 bp, Zea mays
  unsure at all n locations
  Clone ID: LIB3062-022-Q1-K1-A8
ctcatcagtcgagcctccgtgcacgacgcattcgccttgatctccgatccctaccttcattaggagagagagaggagaggagaggagaggaggggcacggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgtcgccgtcgcaactgcctcccgtgatcgtcaggctagccagatcaccttttcccaggacgggaccgttcctaccaggaaggcaacttcagtggctggngtggcaaggcagcgtga

SEQ ID NO: 41649 - DNA, 488 bp, Zea mays
  Clone ID: LIB3062-021-Q1-K1-H4
gcgtcccgtccggctgctcgcctgctcctcctcctagggaaaggacagcggcggcggcggcgagaagttgggcctgaagcccggacgctttctcccgagataccgcaatactgctagagcactgtcactaatgtttgcctatgacaatggagtcacctacaactgccgatggtggtgaactggagagctacttctccttgggtttgacagtatcccactcacagaaagataatgctgaatttccaaaggttctgttgcttctctcagcgtatcttgacaagacagttcagcagaatgaagagttactagactgcagtaaaataaaggagtcgaccactatctttcatggtcagagggtgcctgaacttagtataaagctgcatgcagagcgtattttcaagtatgcaaagtgcagcccatcttgctttgtgctagcacttatctacatggagagatatctacaacaaccaaacttttacctgacggca

SEQ ID NO: 41650 - DNA, 334 bp, Zea mays
  Clone ID: LIB3062-005-Q1-K1-D2
ccgggtcggccgacgcgtgcgagatagtggatgctaaaaattacaccttttttactggcaagtgggaggcatcacggcaggattgtataatacattggtccaagttgccatcatttatgcctcttctgagtcagattgagacagacggtggcaagtctctggactttagcaactatccttacatatttatgagatggaaagaacagtattttgtcaatgttggagttgactgtgggttaaccatcgctggtttctactacgtctgcttttcttgtagcgatggctccatcagtggatcttattatgatccaaatagcaatccatttcagaagct

SEQ ID NO: 41651 - DNA, 347 bp, Zea mays
  Clone ID: LIB3062-005-Q1-K1-D3
attcccgggcagcgtagctagcatacagacgagataatctcttcttcacctcactaacaccagctagcaactctttctctcctgcaataatgaccgctggctcctcctcctcccagccgcagctggtcgcggcggcggcggtcctggcagcggcgctgctgctgctggcggcgggggccgggacggcgtctgcggcggtgagctgcggcgaggtgacgtcgtctgtggcgccgtgcctcgggtacgcgatgggcagcgcggcgtcgccctccgtggcgtgctgcagcggggtgcgctcgctcaacagccgcgcgtcgtctgcggcggaccggcaggccacctgcaac

SEQ ID NO: 41652 - DNA, 199 bp, Zea mays
  Clone ID: LIB3062-005-Q1-K1-D4
ggcgaagcagcagcagcgagaggccaccacttacatggctaccacggcgtttctacccccggcgaagctgcggctgcatggacgtcggttcactagccccaaaacggcaggacgtatcactgtcacggtccctcctgctcgagcgcagcaagagcagcacgtgaaggacgatgaggccgaggctgcgagcgtgcacccg

SEQ ID NO: 41653 - DNA, 416 bp, Zea mays
  Clone ID: LIB3062-005-Q1-K1-D5
cacggacgcgcgcttcaaccgcgtgttcaacgagggcatgaagaaccactcggtgatcatcaccaagaagcggctggacgtctacacgggcttcgagggcgtgtcgacgctggtggacgtgggcggcggcgtgggcgccacgctgcacgccatcacgtgccgccacccgcacatctccggggtcaacttcgacctgccgcacgtcatctccgaggcgccgccgttccccggcgtgcgccacgtgggcggggacatgttcgcgttcgtgcccgtcggcgacgccatcctcatgaagtggatcctccacgactggagcgacgcgcactgcgccacgctgctcaagaactgctacgacgcgctgccggaaaatggcaaggtcatcgtcgtcgagtgcgtgctgccggtcaacacggagg

SEQ ID NO: 41654 - DNA, 337 bp, Zea mays
  unsure at all n locations
  Clone ID: LIB3062-005-Q1-K1-D6
gcgtgtatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgncccagccgtgctgcggcggcatccgcagcctgctgcagcaggccaacaacacccncgaccggcgcaccatctgcggctgcctcaagaacg

SEQ ID NO: 41655 - DNA, 449 bp, Zea mays
  unsure at all n locations
  Clone ID: LIB3062-005-Q1-K1-D8
ctggatttgtttggcatgagagtgatgaaaagcagagagccaaggcaaaagagaagcttgatgagtgtgtaaaagacactctgctggacctctgttggacccttggtattccaactccgaaagcaaacattagaaaggaagatattgtgtcaaagctgttggacttcattgctgaacctcactctgcagctgaatcttggggctctgatgatcagggatcaaattctaaaaaacgcaagagaggaggtgaaagtgcaagtaagacgcctgatggcacacctagtaggtcgaggaagaaatttgtcgatgacggtacttctagtaaaaggcagaataaagcgctccagtatgatactgangaagatgaatccatgaagtctgacagtgatgaaaacatagatgaagattcagatgaagctgctgacaaacaggaagttgactatggatct

SEQ ID NO: 41656 - DNA, 385 bp, Zea mays
  Clone ID: LIB3062-005-Q1-K1-E2
acctgtcatgctagtcatctgggaaagcattgcggaaggataaaccttcacaagatgtagaagggacctcggttaaagaatcaaaaccatcagctggtgaagatgattcgtcaaaaatatgttataaatgcaaaaaggctggacatctttctcgcgattgcccagaaagcacatctgaggtggaccgaaatgatggcagtattagtagaagcagagacgatacgggtaccaatactgctcctgctggtggcaacagtcctatggacgaagacgatgttcaagaaattggtgatgaaaagaaagaaaagttgattgacttggactacttaactggaaaccccactaccaaatgatattttgctatatgctgtacctgtgtgtgccc

SEQ ID NO: 41657 - DNA, 278 bp, Zea mays
  Clone ID: LIB3062-005-Q1-K1-E3
ctcgtgcgaatcagcccactctgataacccaccaacgccatgacaccttgacagacgaatcccatcaccaacgcccacgtgccttagcccgtaagcataactcaaaatcatccataaacaaaccataatcgattataccatgacccaacatgacatcctctcgcactcagactaagtcatggacatacgcgctcccatcattatcgtgaatgcagctcctgacaggcacatagttatagacttatcaatcaacactgtaggtaacatcatcaagcata

SEQ ID NO: 41658 - DNA, 242 bp, Zea mays
  Clone ID: LIB3062-005-Q1-K1-E4
cactcccatacggttttacgattttgccacgctgcaccaattccactgtcactttgaccactttttctgcgtctcttcgtcttataccaacttcaccaacaccaccaccaccactctttctgcttccccatctcttttccccattcctcatcctatatccgtgtacagctccatctttaactcttactactgttctactcattgcattctctttaagtaccacttttctcacgctccgttct

SEQ ID NO: 41659 - DNA, 265 bp, Zea mays
  Clone ID: LIB3062-005-Q1-K1-E5
aatctgataagccagcaacagtttcaagacttaagcaaacaaatgccatcatcaacgggatcagggatgagccaggaaatctatgtccaacttactccagacgacaaagaaattttagattatatcatcacagaagctgacagccacttgcactctgactaagtcctggatcaatccgttgccattattaccgagaatgaaggtcttgacaaggacacagctgcagaactcacaatctacactgtaggtaacgttttcaagaatc

SEQ ID NO: 41660 - DNA, 345 bp, Zea mays
  Clone ID: LIB3062-005-Q1-K1-E6
gtggaatcgaaatcattttgcttctgctttctttgtcttctttccatggcggagcggcagctggtattgtcctggtggaaatgtcagtgcagcctctttttgcttgtcttgttttgcaattgtttggctggcctccactttttgtccgatgtcgggggcgaacagggattcatcatcatatcgtgcgaatcttgctctggatgcacaagaaaattctctcttctactgctctttccccccccccacaaggcctattaacaaacacgatgcctaagctcatgatcaaaatctgatgggcatgcctgacctatctgcccggtcatgtcgtgatccaccttgcaaaat

SEQ ID NO: 41661 - DNA, 440 bp, Zea mays
  Clone ID: LIB3062-005-Q1-K1-E8
gtggacgacacgcccatccgggtgtacgagaacgccacgctgcaccaaggccacggccacggcgaccaccggcacggcggcgcggcggcggaggccaacggcaccaacaccaccaccaccacgctggctgctgccccggcgccgttccccgggccgcagccgatggccgtgtacagctccatctggaacgcggacgactgggcgacgcagggcgggcgcgtgaagacggactggtcgcacgcgccgttcgaggccacgttccgggaggtgcgcgtggacgggtgcgcctgggcgggcaacgccacggacggcgacgccgcggaggcgcgccggtgcagcgagtcctcgtggtgcaaggagggccgctactggtggaaggagaaggagatgtcggagctgagcgtgcaccagagccaccagctcgtgtgggcgcgcgcgca

SEQ ID NO: 41662 - DNA, 313 bp, Zea mays
  Clone ID: LIB3062-005-Q1-K1-F1
atagctggaagtgaatttatggagagcgttttcttccatgttaaatcatggttaccggcaagagctattggggtagagtgtttggtatcaaaaggaaacattgatccaagtggagaaatcatggttttggatagattctgcccgtggaaacttcatttatttgagcttgaagaggagctgaagactgatcctctgaccaagtatgtgctgtatcaggatgagaggatcaagagttgtcgagtccaagcagtcgcagttgctcctgacaggttcgagagcctaaaggctcttgcagataagtcgaggggcatga

SEQ ID NO: 41663 - DNA, 351 bp, Zea mays
  Clone ID: LIB3062-005-Q1-K1-F2
ctatgaagcaccgtgtatctatcatcacttttgcaaccaccacaagaaggacgaggagcagccggccggctagtacgggtactccgagaccgaggtggtcaccgccaccggcgagggcgagtacgagaggtacaagaaggaggagaaggagcacaagcacaagcagcacctcggcgaggccggcgccatcgccgacggcgccttcgcactctacgagaagcacgaggcgaagaaggaccccgagcacgcgcacaggcacaagatcacggaagaggtcgctgccgcagcggccgtcggcgccggcggctacgtattccacgagcaccacgagaagaagaaggaccacaagga

SEQ ID NO: 41664 - DNA, 290 bp, Zea mays
  Clone ID: LIB3062-005-Q1-K1-F4
caacatgcaccacgtacccgttcacggcgatcttcctcatcttctacaccacggtgccggcgctggcgttctgtacggggcacttcatcgtgcagcggcccaccaccatgttctacgtgtacctggccatcgtgctgggcacgctgctgatcctggccgtcctggaggtgaagtgggcgggcgtgaccgtgttcgagtggttccggaacgggcagttctggatgacggccagctgctccgcgtacctggccgccgtgtgccaagtgctggtgaaggtggtggtccggcgg

SEQ ID NO: 41665 - DNA, 407 bp, Zea mays
  unsure at all n locations
  Clone ID: LIB3062-005-Q1-K1-G1
ttattttcagggtttatgatactgactgcaacgggaaggttgcttttgatgacatcttgagcatcttgcgagatctgagaggttcaggtatgacagagcaacagagacagaaagtcttgattcatgtgttagaagaagctggatacacaaaagattcacattttacactcccagactttatgaagattattggcaattctgagctcaagatggaggttgaagttcctattgactaanaacctaacaagcatcatctagttgcttcaagcctgtatcttcatttgtgttaaattaagtagatggtatatttatatncttgcaactcaaatcatgatcagagatgtaattaaggaaacatatgtacctgctatttggagggttagttggctcgcacttatactcaacgc

SEQ ID NO: 41666 - DNA, 292 bp, Zea mays
  Clone ID: LIB3062-005-Q1-K1-C8
agatagtggatgctaaaaattacacctttttcactggcaagtgggaggcatcaccggaggatgggataagacattggtccaagttcccatcatttatgcctcttctgagtcagattgagacagacggtggcaagtctctggactttagcaactatccttacatatttatgagatggaaagaacagtattttgtcaatgttggagttgactgtgggttaaccatcgctggtttctactacgtctgcttttcttgtagcgatggctccatcaatggattttattatgatccaaa

SEQ ID NO: 41667 - DNA, 370 bp, Zea mays
  Clone ID: LIB3062-005-Q1-K1-G4
cctgggattaggcggctgaccctagggcctagcttcgttttggcggtggctgctctggtgcgcagtgcagtgcctggcggctgcgcttcagcggttgtgcgcactgcgcagtgcgctccatgccttagtgcctgccgcggtgccgccctcccacctccagcgaatggcgacggtccagggctctaggcgtccagccctccagctccatccgttggactcctgctcgtcatccactcgagctcagctactcggcttactggttccttctcggcggctgttctagtgctcctagcctcctgctcgtcggtcggtcctggcccctgctgctcggctgctcacttgctcgttgggccctgctgctcgggttcca

SEQ ID NO: 41668 - DNA, 339 bp, Zea mays
  Clone ID: LIB3062-005-Q1-K1-A4
gcgcttctctaggcgactaggcacaattgccctctggcaaaatgccatcagtttatctttacatccgtaacattgtccggtattttaggatcatcataaatttcattgcatttgcggtttgctattccaacaaggctctctttgctatcctgtacttcatcagctttgtccttgatggtgtggatggttggtttgcaaggaagttcaatcaagcatcaacctttggagctgtgttagacatggttacagatagggttagcactgcttgtttgttggcccttctctcccagttttacagacctggtttagtcttcttgatattgcttgaattggatatta

SEQ ID NO: 41669 - DNA, 298 bp, Zea mays
  Clone ID: LIB3062-005-Q1-K1-A5
aatctatagatctttgttgatcacagaataatgatcatgaagtttctaacgtggcggagttgtgggatgaatcgtctgaacactcttcataccaacatggtgttcacattggaaactggatcaagtcttactttggatcataactatgaagcttacaatgacatcaacttcatcttcgctaatgttcattaacactatcaaaacttcgatccacgttgatgatgagagctctagcgacatgtacactgcacagtcacaagacagccgctccatagtgacgaaggctgtggatattgaa

SEQ ID NO: 41670 - DNA, 169 bp, Zea mays
  Clone ID: LIB3062-005-Q1-K1-A6
cagttgtgagagagaggggaagttatcgagatcgcatcggagtctatctctagcgggatccaagaactcatctctacgtgtcaagcctaatcctcagaaaaacccctcaactaatccttgtatgcctacttatccgaagaatccttcaagaccttgcatttcatttacc

SEQ ID NO: 41671 - DNA, 357 bp, Zea mays
  Clone ID: LIB3062-005-Q1-K1-A8
cagtaagccatcgctcacacagtcagaccgacgcactcactaacacacacacacagacggacaggcaacttctccatacacgccgtagccatggcttccgctgcgcagaagaagatggcaattgtttgcttgatgctgctggccgtcgtcggccaaatcgtcgctgatgctgatgttaccgtagaacatcccagccgcatctgcaccgaaacggtgattgatcctcgtgttcccaacaacgagtgcatctgctccaagaactgcgcctgtgccggtaagtgcatccttgagtcggctgatgctgtccagacctgctttgtcgactgcgtcctcaagaacgactgcatctgcagcagc

SEQ ID NO: 41672 - DNA, 393 bp, Zea mays
  unsure at all n locations
  Clone ID: LIB3062-005-Q1-K1-B1
agcacgtcgacttctcagaagactactcacctaagctcaacgccgacgacgcctatgccacttggtaaatctggggacctgacgggaattctattggtcctcctatgggaaatccatggatctacatgtaccctaaaggcctaaaggatctccttatgatcatgaagaacaaatacggaaacccgcctatctatatcaccgagaacggaatcggggacgttgacacaaaggataatcctctatccatgcaagatgcgttggacgactacaagaagctagattacctncagcgccacatctcagttatcaaagaatcaatagacttgggggcggacgtgcgcggtcacttcacatggtctctgttggacaactttcagtggtctagtggctaca

SEQ ID NO: 41673 - DNA, 338 bp, Zea mays
  Clone ID: LIB3062-005-Q1-K1-B2
catacgtcaaacaagttgtgctttcttccgtttgtctacaaaatttactctccagggagagtagagaatttatgcaaattgcagctaacgacaaattacagtagctgaaaatattttctcaacagattcttaattccataaaccgatgtaaagatccccaatggtataacctacatcgctactttgcagaagctagaatcagaaagcgcgccccataagcaattcaaagatacggcaatagcatagattcaaaagcaaatgagtcttgttcaacgtacaactgtgagcactcatttgttctctaaatatatcttttaaaccacaaatgcccgtcattt

SEQ ID NO: 41674 - DNA, 399 bp, Zea mays
  Clone ID: LIB3062-005-Q1-K1-B3
cccacgcgtccggtcggtggccttcctccatttgccaactaacagacagtggcaatttactttgatcaagtggtggcttctattgggggaaacactgctggtccaggtgatgctgttctcaatgtatacataaatcatgacaagaaatttgcttttgtggagatgagatctgtttaggaaacaagcaatgcaatggccctggatggcattatgttcgaaggttcaccggtgaaagttagaaagccaacagactacaaccctttccttgcagccgccctgggcccaagccagccaagccccaatctgaatcttgctgcaattggcctaacatcaagatctaatggaggactagaaggtccagaccgtatttttgtgggtggccttccttattactttact

SEQ ID NO: 41675 - DNA, 285 bp, Zea mays
  Clone ID: LIB3062-005-Q1-K1-B4
cagcattgcgattctgcatacaactctgacttctttacgtatgggaaacaatcttacttccagtgctaatgcgtaattcatgcaaattgcatctaactacccatgataaagacctaaacttatatgctcatgcaactaattggttaaacaaccactgtttatatcacaagattcataaccaagatcactactttatgaagaatgaatcacaaagcagcgctccaaaaccacgtatgataaacggaactttcactgatccagaagttcatactgcacgtataaaat

SEQ ID NO: 41676 - DNA, 380 bp, Zea mays
  Clone ID: LIB3062-005-Q1-K1-B5
gagctcttgtcaaggagcggagtcactgttaaaggtaagcgggcagttgtggttggtcgcagcgacatcgtcgggctacctgtatccctgctccttctgaaggcagatgcgaccgtatctgttgtgcactcgcggacccctgatcctgaaagcattgtacgcgaagctgacatagtcatcgcggcagctgggcaggctatgatggtatgtatgcagctatgccgacagatcctcacagtaaggtgcagcatcctgcaacccgttcaacgctgctcactgagtccgtcgatgtgctcttttcttgctcgtcagatcaaaggtgactggatcaagccaggtgctgcggtcatcgatgtcgggacgaactccgtcgacgaccc

SEQ ID NO: 41677 - DNA, 442 bp, Zea mays
  Clone ID: LIB3062-005-Q1-K1-B6
catacttcaaacaagttgtgcttccttccgaaggtgtacaaaatttggtgtccagtgagaggagtgaattgatgcgaattgcagctaacgacaaaagagaggagctgaaaatattttctcaagagattgttaggttcgggaaccgctgtaaagatccccagtggcataacctggatcgctactttgtgaagttagaatcagaaagtgcgccccagaagcagttgaaagaaacggcaatagcagagatgcaaaagttaatgagtcttgttcaacgtacaactgtgagcactctgttgttctctaaagatatcttctaagccacaaatgcccgtcatttcgtttttttttttggctttcttttttcaagatttgtatcatgagctgcatgcattagacagatttgagcaagagtactgctctaagataaacggaaagggtcaca

SEQ ID NO: 41678 - DNA, 345 bp, Zea mays
  Clone ID: LIB3062-005-Q1-K1-B7
tcgtacccacacatgcacccagagcacgcgcacaggcactacatcacttaggaggtcactgccgccactagggtgcccggcgacagctacctattccacgagcaccacaagaagaagaaggaccacacggacaccgaggaggccagcggctagaagaagcaccaccacctcttcggctgaccgtagtaccatccggcgctttaccgagctaactagctccggcgcacacatttacacacactgtaaattctgtactgcatgcgtgtgtaatttgatggatcacaataatgagtccatctccggaccttggtagctgcatgcttgtgacgagtgagagtgtgagac

SEQ ID NO: 41679 - DNA, 447 bp, Zea mays
  Clone ID: LIB3062-005-Q1-K1-B8
ctcccgcgcacctccctccgatcccccaaatcccgaattgaccaacccaaagccggggcccctgatggagtggacggccccgaagcgcgccgcctcgccgccctcgcctccgctcctctgggactggggaggagaccacgccggcgccacgggctcgggctcgggctcctccggcgacgccccggcgcggcgcggctggagggagcgggaggcgaagcgcgccagggccgacgacggcgaggtgaggtgccaggtggaggggtgcgggctggacctcagcagggtcaaggagtaccaccggaagcaccgcgtctgcgaggcccacaccaagtcctcccgcgtcgtcgtcgccggtcaggagcggcgcttctgccagcagtgcagccgatttcatgccctgtcagagtttgatcagaagaagaggagctgcaggaggcgtctgtctga

SEQ ID NO: 41680 - DNA, 337 bp, Zea mays
  Clone ID: LIB3062-005-Q1-K1-C1
gaagaaggaccccgagcacgcgcacaggcactagatcactgaggaggtcgctgccgcggcggcggtctgcgcgggcggctacgtattccacgagcaccacgagaagaagaaggaccacaaggacgccgaggaggccagcggcgagaagaagcaccaccacctcttcggctgaccgtagtaccggccggcgcgcgaccgagctagctagcttcggcgcacacaaccacacacctgtttaattctgtactgcatgcgtgtgtaatttgatggttcacaataatgagtccctctccggaccttggtagctgcttgcttgtggtgagtgagagtgtgagac

SEQ ID NO: 41681 - DNA, 310 bp, Zea mays
  Clone ID: LIB3062-005-Q1-K1-C2
ccttgacagtcaaggacaatttactggtagctggtgggtttcaaggagagctgatctgtaaacgccttgatgaggaaggtattagtttttgctgtcgaacaacttatgatgataatgctattacaaatgcggttgaaatatttaatacctctagtggcgccgttcacttcatggcatcaaataacgactctggtgtgagatactatgacatggagagattccagctattcaagcattttcagtttgaatggccagtgaatcatgcttagttgagtcctgacagaaaggtggttgatattgtgggtgatga

SEQ ID NO: 41682 - DNA, 408 bp, Zea mays
  Clone ID: LIB3062-005-Q1-K1-C3
cacagagatagctagcaagaaaccacagatggcggcgatagcggcggccacccaggcggcgggggcggtgcgactgctcgcggcgctggtgctggcggcgggaccgggcggggcgcgggcgcagtcggcgtcgccgtcgagccagtgcacgtcggcgctggcgagcctgtcgccgtgcctcagctacatctccgggaacgtgtcggcggcgccgacgttgtgctgcgcgcagctggtcaaggtggtgcagtcggacccgcagtgcctgtgcgtggcgctcagcgcggacccggcgtcgctgggcctcaccgtcaaccgcacccgcgcgctgggccttcccgacgcgtgcaaaggcacgacgcccgacgtcagcaactgcaaaggcgccgtcgtcggcggccgcggggg

SEQ ID NO: 41683 - DNA, 310 bp, Zea mays
  Clone ID: LIB3062-005-Q1-K1-C4
gctagatagtgtattctaaaaattattccttttttactgtcacgtctgatgcatcagcgcatgatcgtgttctacataaggccaagccgccatcattaacgcttcttctgactcaaacttagaaagtcggtcacaagtctcttgactttatcatctatacttacatatttatcatatcaactacaacattctactctcaatgttgacagctgactgtgtgttaaccataacttacttctactacgtatgattatctagtaaccatagctccatcaatgaattttattatgatccaaatacaccttcattt

SEQ ID NO: 41684 - DNA, 414 bp, Zea mays
  Clone ID: LIB3062-005-Q1-K1-C6
ccggattgttctctccgccggcactgctccccacaatgctgctgctgcagcctcacgacggctccccctgcgagttggccgggctcgccccaaggcgaagccgtcgcctacaccgctgctccagccacgaacgtcgcaggtggtccagccctccactttgccactgctcgccacgatgtcactgctccttgcaacggcgccccctaccctatgccccgaccgcggccccgctgcttctccagctctactgcccctgtcagacacgaccaatgcctctcaggcggagacagcatccgaccccgcgaacataggcaccgagggcttcacaccatgcttcaccagagcgcaaaactccctcatcagtccatgggagggactctagcaaacgacggatctgccaatgggaaagaaatg

SEQ ID NO: 41685 - DNA, 370 bp, Zea mays
  unsure at all n locations
  Clone ID: LIB3062-005-Q1-K1-C7
ccaacacacacagcaacgctcgctcgacactgtcactagctagttgctctactagagggcggggatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgctgcaaggtagtggacggcgggcgcgggctggacctgacgctggaccgcacgtncggctcccggttccagtccaagagcgagtacctgttcggcaagatcgacatgcagatcaagctggtgccaggcaactncgtggcacg

SEQ ID NO: 41686 - DNA, 354 bp, Zea mays
  Clone ID: LIB3062-005-Q1-K1-A3
cggacgcgtgggcgaagggacgaccgagcggagtctagactcgagagcaacctcgacctcccggatctctggcgcacccacgcctggtcgccgccgtcgtctgctgcagcgatggcctcccccgacctgctcttcaatctgcggaacctcttctacctgggcgcctaccaggcagccatcaacaacagcgacgtcccgggcctcgacgccgacgccgccgctgaacgcgacgccatcgtcttccgctcctacatcgccctcggctcctaccagctggtgatcagcgagatcgactcgtcagccgctacctcgctgcaagccgtgaagctgctcgcgctgtacctcactggagac

SEQ ID NO: 41687 - DNA, 367 bp, Zea mays
  Clone ID: LIB3062-004-Q1-K1-G12
ctctcctgttcctctggtctctggacaaccaagccagagaggagcagccagcgacaacgtcggctcctctcctcccctcttattccgcgcccagcagcgaggcatggtggagaaggcgaggaccatggcgcgcaggctggagatcccccagtggaaggccgacggcctgccgtcgccgacgagcccgctggaccgcgcgtcggcgtcgccccgtgggtggcgccaccgcgacgccgtaagaggaagcgtggggctcgggatcctggcggcgctcgaggccgaaggcccgccgcaacccgcgccgagggtgtccatcccgcggcgcgcggcgcggctggaagtgtcggagctcgggtgcaacgggcgc

SEQ ID NO: 41688 - DNA, 184 bp, Zea mays
  Clone ID: LIB3062-004-Q1-K1-G2
agcaggggtgcttactcactagtcactactgcttggctctagcctctagctagtcaactcctgcgtgggccgacatggtgagggcgcctagcggtgcgtggaacatggggcttctggggctgtccgtcgcggtggttcttgctgtggccgtcgaggcgcggtccttggagaagctgaacctatg

SEQ ID NO: 41689 - DNA, 435 bp, Zea mays
  Clone ID: LIB3062-004-Q1-K1-G3
ctcgtcgtcgtttccgacggtgaagccacgcggaggatagccatggccgccttactccaccaagcggctaccccgaccgcaaaaccaccctaccggccatgggctctcaactccacacccagccgcctctcaccggtctctaaacgacggcgcgccccagccatccgctcggcggccacggacagcagcttcagctccggcgagacgcccgtccaaaagaaccacccggaaggagaaccaccaggaccggcggcggcagcagaccgtgcaggaccggaagcaccagttccggggaatggaaaaaccgtccttggcaaaccagaacggcggcggaagcggaagcacaagcaccggcaaggttgacaacaacaacgagcttccgaagcccgggttgaaccgcatgctgcgccggatcgcgttcacggtgggccttcc

SEQ ID NO: 41690 - DNA, 245 bp, Zea mays
  Clone ID: LIB3062-004-Q1-K1-G6
cgctgccagcaccaaggcggcctcttcggctgctcccgccgttacgacgacgaagccggctgcgtccgtgctgccagctgcccggccgcgggaccccaacaagcgggagttccgttcctacggcagcgcggcggctctgttcgttcagatgggcgcgtaccggggcggcccgcgtacgttcgccgtcattgggttggcctccaagccagcacacgtctatgacaccctctacttcaagtgcgagt

SEQ ID NO: 41691 - DNA, 323 bp, Zea mays
  Clone ID: LIB3062-004-Q1-K1-G7
tgcatttaaggactacttcaagaggttgttcaacttcaagaaggatagggatggctattggaagtggtttgctggcaacctggcctctggtggtgctgctggtgcttcctctatgatttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcattgtttatcgtggtctgtactttgggctctatg

SEQ ID NO: 41692 - DNA, 433 bp, Zea mays
  Clone ID: LIB3062-004-Q1-K1-G8
cttcagcccattcatccagcaacagtatcatgacaaatatggtgataaagagatgattcctgttgctgcaaatgatgttgctttttcactgcatgctgtagcattgacagcctttaccgtttttcaagtattcatatatgagcgaggaacacagaaagtctccaaagtttgcatatcaatttctgctattgtctggatcgccgctcttgtttgcctcattattgcttggccaaaaagtgactggcttttggcttattgatgaattcaattcaatacaagttggcatgacagcaatcaagtacttccttcaggccatcatgaacttcaggcggaagagcacaattggttggagcgttggcaatatattacttgatctcacaggaggggtgctgaatttttgccaaatggttgtgcagtctatagatcaacatac

SEQ ID NO: 41693 - DNA, 394 bp, Zea mays
  unsure at all n locations
  Clone ID: LIB3062-004-Q1-K1-G9
gtcgaccagcgtcgccagtcgtcgtccactgacagtcgacacctatagcacctgctcgacagaggtanaggcggaggtgtctgctctcttggggtggacctacctgcacacggatgcgctgggcagcgcagtcatgatctacaactactgaccgaccccaagcgctaccagcaggcctcccgccgagtgctccatgcagagcgcccggttatcctcgccgtccaacaatggncgcgcgcgcgtgtgtgtgcatgggccgctctactgtaccgtcgacgatcgggtcgatcaccggacaaggcaagacaaggcatcgaaacatggtagataaataaggacttgcgatttgaacgcatagctggtgcgtgcgtggtgtggtggaagaaattcttct

SEQ ID NO: 41694 - DNA, 454 bp, Zea mays
  unsure at all n locations
  Clone ID: LIB3062-004-Q1-K1-H11
ctcaacattgcaacatcagtggtggtggtcgtggtcgtacttatgacgatgtgcatggcttggaggatgcatcgatgggagtttctgatacagtcttgggaggtgcctatagtagccgtggtggtcatggtggtcgacgtgcacgtggtcatcatccagccccccttcaacaatgccatatcgtgcacctcgcacaattggagatcgtggtgctgctgtctagtctgtggacgacgacactganggtgatgaattcaatgaccaagatgctttggggcatgctgaatggaggaagttaaaatatggaccaccagaaaaccttgataagcttgagataatgtttgagcatatagctatgaatggatcaacttcctgcacaccaggacaaaatattgatatagaaggacctgatgttgaaggagtagaagctgcaatagaagacagtccccgtagt

SEQ ID NO: 41695 - DNA, 286 bp, Zea mays
  Clone ID: LIB3062-004-Q1-K1-H12
gaccgacgcgtccggccggcgcaaactctcgcccgagcccgacagatcttcaattccccattccgcccaccgatcgggcttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgc

SEQ ID NO: 41696 - DNA, 254 bp, Zea mays
  Clone ID: LIB3062-004-Q1-K1-H2
gtcacacacacacacacagacaagtggtttccaaagccaagtgtgtgtactagcaaccagctagctcgggcggcagcaggcaggcatcatgtcggaggagaagcaccaccacttcttcaaccaccacaagaaggactatgagcagcccgccggcgagtacgggtactccgagaccgaggtggtcaccggcaccggcgagggcgagtacgagaggtacaagaaggaggagaaggagcacaagcacaagcagcacc

SEQ ID NO: 41697 - DNA, 262 bp, Zea mays
  Clone ID: LIB3062-004-Q1-K1-H3
gtcatccacactaacgaacgaactcttgctccgatcacgagctagctgaggtcgacgatggcggctgtgctgaacagcatgaagacgccgcatgcggtggtggccgtgctggtggcggcggcgctgctggcttcgtccgcttcggcggcgatcacctgcgggcaggtggggtcgtcgctggcgccgtgcattccgtaccccaaggggagggcccgcgcgcttcccagggtgtgcctgaacggggtcaagagccttaacagcg

SEQ ID NO: 41698 - DNA, 399 bp, Zea mays
  Clone ID: LIB3062-004-Q1-K1-H4
aattccgggcggaactggactagaactagtagatccaatccaacactcgggacgaaattaaaggagacgacgcatcatccggccggcaggcatcgcacggtcaccaccatggcggcgcaggagggcggcatgaggctggtgtcgcacccgatcgcggcgcacgacgggcggctgccgcggcagtacacggcggaggggcagggcgccaagaaggacatgtcgccgccgctggagtggtacggcgtgcccgagggcgcgcggtcgctggcgctgctggtgcaggacatcgacgccgaccccgtcgtgccgtggacgcactgggtggtggccaacatcccgcccggcacaggggcctccccgagggttctcccgcgccgaggggcaggggccggggccggg

SEQ ID NO: 41699 - DNA, 455 bp, Zea mays
  Clone ID: LIB3062-004-Q1-K1-H5
acgcggagccggaggacgccgccgccgacctccccctcccggccctcttcgatagggcgtcgcggctccacgccctggcctccagctccgccctcgaccaggatgggatccgcacgggggttgacctgctgcggcgctgcgacgacatggtcagcaagctcggcctcttctcccccaacgagaccaaggaggacgtctccacagcaaacctcaagtacctactgggcccatattaccttgcagaaatgaccgaagagatagcacaggaggatcggatcccggttcttaagacgtcacaggaccatctgaaggagttcattgctctatgggaagtactagagcttatgccagaggatgagctagaattgtctaagcagaagcaggcagatactatgacgagcagaagagcgcagaaggtgcccggttcaaacgtccaagggctgcagaaacgaagc

SEQ ID NO: 41700 - DNA, 275 bp, Zea mays
  Clone ID: LIB3062-004-Q1-K1-H7
tcgccagcaatggattatgatagccacatgcagactactgtgaaggtggaagatgaaaaagcagaggatgacttgccagatgctgacaatgatgtacagaaggtagagaaagagaagctaaagaatgcaaaggatgggtcagataaacgaaggaaagatgccttattgaggaagttatcggcgccaatgaccccactgaatgatgcacaaaaacctgcacagaacctgcgtgcatataagggagaactttagaaactggagaaagaacagggaga

SEQ ID NO: 41701 - DNA, 300 bp, Zea mays
  Clone ID: LIB3062-004-Q1-K1-H8
cggacgcgtgggcggacgcgtgggcttgagaatatgtcttgaaggtggatatcatgtcttggatgagtcaacacattacagtagtgatttaaggccaactgcaaagcccctgtggaaacctatcattggcattcttgaactgggtatattgacagcacagggcctgttgccaatgaagaccaaggatgggcgtggcacaactgatgcatattgtgttgcaaagtacggacaaaaatgggtgcgtaccagaactataatcgacagtttcactcccaaatggaatgaacagtacacctggga

SEQ ID NO: 41702 - DNA, 245 bp, Zea mays
  Clone ID: LIB3062-005-Q1-K1-A2
attcgagggctgtgatcaagtgtatcgaggagtacaagcttcataaggagtattcacttgtacgtgttcaagagcctgtttctgagctaaagcctaacggtgagaaaaggccatcaactgatgctggtgagcgtacttatgcaaagaagcctcgacgccctggcatttcatttaccaggagacctgacagttccattggttcagctgctcgcacgcctacatttccggactataactggcaccgt

SEQ ID NO: 41703 - DNA, 390 bp, Zea mays
  unsure at all n locations
  Clone ID: LIB3062-004-Q1-K1-G11
atgatcctgagaaaatgctttcacgtggaacagaaattactctttatttgagagatgaggacggatatgagtttgctgaccctaccaggattcaaggcttagttaagaactactcgcagtttgtctcattccccatatatacatggcaggaaaaatcaagaacagttgaggttgaagaggaggaagaatcaaaaggtgaagaagctactgaagaatcaaaaagtgaagaggctactgagggtgaaaagcagaaaaagaagaaaaccataactgagaagtactgggactgggaattggctaatgaaacgaagcccatatggatgaggaatccaaaagaagttgagaanactgagtacaatgaattctacaagaagacatttaatgagtttc

SEQ ID NO: 41704 - DNA, 412 bp, Zea mays
  Clone ID: LIB3062-021-Q1-K1-G1
gtgcaggggcaggggcagggctctagcgtcaccaagattggactatggggtggaccgggagggtcggcacaggacatcacggcagagcggccaccgcagcgtcttcacagcgtcaccgttcgtgctggcgttgccgtcgactccatcgagttcacctatactgacagcgctgggcagaggcgcgccgctgggcgttggggtggacttggcggcaatgttcgaacgatcgaccttggcaacgccgaggatgtcagggaagtctcgggaacatacggcgcatttgaaggtgccactacgctgacctcgctcaggctcgtcaccagcagcagaacctggggccccttgggggtcgagaacggtacgcgtttctccgtcacggcgcccatcggcagcagcatcgtgggattctatg

SEQ ID NO: 41705 - DNA, 258 bp, Zea mays
  Clone ID: LIB3062-021-Q1-K1-G10
gtcaggacgcaactagacctagtctgattcttctcctcaaccatagctgcctcatggtgaggatcacctcctattcaaagacctatttcactcacacctccataccgcgcattcattattcgacctgaaaactctgttacgactactcacttgcataatactagatactaaatacttgagttctacatacgatacactaactcattcacttgcctatacatatacatgcataactattacactataatatccttctca

SEQ ID NO: 41706 - DNA, 457 bp, Zea mays
  unsure at all n locations
  Clone ID: LIB3062-021-Q1-K1-G11
tcgtctcgtggagaagtctacgtttagaagtctactcatctgtcatcgatggtcatggtgacattggcttgaataattggtgtgcgaggagtagaagtgcgtccggttataatcttataagagcagagcattgccgtgttgatacctgagtttctttgttgggcttgactctatatgacagagaagggatcggtgttaaacatgagatttgcgtagggggaacctaatttctgtttttaagcaatactgtactgtcgttttgctatcaagtatatttgaccctcgattatatagattacattgaagtttttgggcaacaatgtgaaatcttgtgataaatctctgtgcttattggttatctgattgtaactcgtcctttgtaaactttgtttgaatgagcaagtgaactgattgtcgataaanaaaaaattccacattatacttacactatagcttt

SEQ ID NO: 41707 - DNA, 422 bp, Zea mays
  Clone ID: LIB3062-021-Q1-K1-G2
gcgtccggtgcaggggcaggggcagggctctagcgtctccaagattggactatggggtggacccgctagatcttcacaggacatcacgggagagcacacaccgcatcgtcttcacagcgtcaccgttcgtgctggcgttgccgtcaactccatctagtacacctatactgacagcgctgggcataggcgctccgctgggcgttggggtggacttggtggcaatgttcgaacgatcgaccttggcaacgcccatgatgtcatggaagtctttcgaacatacggcgcatttgtacgtgccactactctaacctggatcatgctcgttacctgcagcttactctgtggtcccttctgcgactataacctgacgcgcatattcataaccgggcccatagacatcatcatcttgggattctatgctc

SEQ ID NO: 41708 - DNA, 468 bp, Zea mays
  Clone ID: LIB3062-021-Q1-K1-G3
gcacagtcatccacactaacgaacgaactcttgctccgatcacgagctagctgaggtcgacgatggcggctgtgctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacg

SEQ ID NO: 41709 - DNA, 412 bp, Zea mays
  unsure at all n locations
  Clone ID: LIB3062-021-Q1-K1-G5
acctcattgccatcatctctccacacaactaagaagccagcggcagtaacaggagtgaagcaaaaaaggcatcatggacgggatagaaatgagcgaagaaatccatgtccagcttaatcccgaagaaaaagaaagtttagataaaatctcagggagctgagagcgacttggagtctgaagaagtcctggatcaatcccttgccattggtgccgagaatgaaggtctggacaaggacgcagctgcaaaactcacaatttacactgtaggtggtgttttgaagaatctgacagagggccccttgagtgttatggataagcacatatatgcaggacacactgtcaaaccatttnccagcctgattgggagctggaagtctgggtgtttcgtcatctcanatatatttgcttaaag

SEQ ID NO: 41710 - DNA, 321 bp, Zea mays
  unsure at all n locations
  Clone ID: LIB3062-021-Q1-K1-G8
ttggtccggaagtctcgagccacgcgtccgcgacctgctcgccaagaccggggtctccccgcgggacatcgacatcctggtggtgaactgcggcctgttcgcgccgacgccgtccttcgcggacatggtcacgcaccggtacaggctccgcggggacgtgcgcaacgtgcacctcgccgggatggggtgcagcgcggggctcgtctccgtggagctggcccggaacctgctgcangtggcgccgcggggcacgcgcgctctggtggtgtccacggagaccatcacccccaattactacatgggcgaggagcgcgcgatgct

SEQ ID NO: 41711 - DNA, 440 bp, Zea mays
  Clone ID: LIB3062-021-Q1-K1-G9
ggcatcaggcgtgttgaccgattctgtttcgactcctaaaccagagcagcagcatcaaaagcagcacggcctcttcaaggacctatggaaggcacaggacagtaacgcggatgctggtggtgaggtgcagccactgctccggcaaaaccttgtgtaatactcctacaaaatacggagtacttcctgggatggactcacgccctcgctggcctatacatatacgtgtttatttatttgtctatgttgttgttaacatggtatcgtggtgaacaaaagaaactgaacatgccattgttactgtggtgtggcgttttttgtacacttttgatacctaaatggaactcctatgatttgggtctggaaagggtgtgtgaagatgttttgttccaggttttggagttccgctcccagaatggcttgacaagcatgttaattccatg

SEQ ID NO: 41712 - DNA, 244 bp, Zea mays
  Clone ID: LIB3062-021-Q1-K1-H1
caataccaaacatcatactattttatctgaaactatctacatcatcaatggctgaatatcttcaactgtaagctaacttaaacaaacacccattctcaccattactcaatatatcattacttcttcaactacccattatgcattcacaaactccttatttattaatacattccaaacctatgtcagtctattgtaaaactcactctaattaaactatcacattctaacaaatatattcaattta

SEQ ID NO: 41713 - DNA, 456 bp, Zea mays
  Clone ID: LIB3062-021-Q1-K1-H10
aagagatccaaagggcctctataagcttgctcgtgcaggaaaaataaagggttttacaggagtagatgacccttatgaagcaccactgaattgtgagattgagatcaaagaggtagatggtgtatgccctccgcctgctgagatggcagggcaagttgttacttaccttgaggagaaaggcttcctgcacgagtaggctgaatccaagcaacatctggggaagatttcagtaagactagcgcagaataagtcaaaggcgctggcagttacggtatagcagttgcatagattggcctcaatgccttagtattttctttccgtacttgctcttccacaggctccatgcaatttcattcagatgagcctggatggttcctaatttctttgacctctagagtagattacttgtaatgcaactctgataactacttggggcagtatcgatgtggcaatcgc

SEQ ID NO: 41714 - DNA, 400 bp, Zea mays
  Clone ID: LIB3062-021-Q1-K1-H11
gctggtacactgatcctgctcatacgctgatgacagtggccacggacgacagaacgggggggggaagccacgactgtatgtagcgagataccggactactgctagagcactgtcactaatgctaggctatctcaatggagtgacctacatgtgcggttgtaggtgcaatggtgagctactgcttcttgggtatgacagtatagcactaacagatagatgatgctgaattgccaaaggtcctgaagctctgtctagcgtatctggacatgacagttaatcttaatgaagagtgactagactgcagtaagatcatggagtcgaccagtatctttcatggtcagatgatgcctgaacttagtatataagctggatgcacagcgtatgttggagtatgcaaagt

SEQ ID NO: 41715 - DNA, 467 bp, Zea mays
  unsure at all n locations
  Clone ID: LIB3062-021-Q1-K1-H2
aaagtgcaaaacaatgttttggagtgactatatgggtgaaatgttgaacacgggccaacatggtctttcacctacagtgggaagcgactacaaaccagaccagctgtctccaaaaaagattacttaaactgcggcacaaaagtagcgcatctatattcacatgggagaaatggaacttcatggaccggtttctcgttttccactaggaaggattcactcgatcttcagttccacatacgctgcctttctgcactgttcattttgcccagattttcgatatagcaacaacaaatgccctaagcacaagccagaatagattgtcatctttcttctgctgagctttcaaagttctcctaatatactgctgccctttgtgacgtgtgaaggaaattataaacagtaagcatgcaacgcanagttaggaggcanagtgcatgcctgctgatcactgttgcagtgctaattcc

SEQ ID NO: 41716 - DNA, 373 bp, Zea mays
  Clone ID: LIB3062-021-Q1-K1-H3
tttttggtaaagtgcaaaacaatgttttggattgactatatgggttaaatgttgaacagcgggccaacatgcacttgcaccgacagtgagaagcgactacaaaccagaccagctgtctccaaaaaagattacttaaactgcggcacaaaagtagcgcatctatattcacatgggagaattggaacttcatggaccgctatctcattatccactatgaaggatccactccatcttcagatccacatacgctgactttctgcactgatcattttgcccagattctcgatatatcaacaacaaatgccctaagcacaagccacaatagattgccatctacattatgatgagctatcaaagttctcctaatatactg

SEQ ID NO: 41717 - DNA, 436 bp, Zea mays
  Clone ID: LIB3062-021-Q1-K1-F9
cacgaattcaccaaccaaactccactgtctccaactctccatcgcgtctgctacgcctctggtgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaagtgccctgggtcattttgggacattctgagcgcagagctctgttgggtgaatccagtgattttgttgctgataaagttgcatatgcactcactc

SEQ ID NO: 41718 - DNA, 443 bp, Zea mays
  Clone ID: LIB3062-021-Q1-K1-E4
agtctcggaccccaaccctcgaggaaggcgaccggagatggcggcgtcgtcggcggtggagaagctcagggtggtctgggactcgcaggtcaacgacgaggagcagtgggcgctcaattataagctgctgaaggctgctggtctgtttgcgggatccatcttcctgatgcggaacttcggtgatctgatggccatttagtaggcttatcagcgttgtttacttggatcctatgagtgttgttttgatgttccaataattcctgctatgaatatgaaagttattttgctctgaagaggactagatctgtgccgatagtgcttgatcttagactttgtagccatagagattagaccctttaatattcggcgtgtaccgtggatattttggaacgatggtatcagtctgcacccataataaattttgatttgatgggttattaata

SEQ ID NO: 41719 - DNA, 358 bp, Zea mays
  Clone ID: LIB3062-021-Q1-K1-E5
tcagcatcaccgctagaggacacgtgcggctagccgatcgatacgatggccggcttctccgagcgtgcaaccggcgacggctcaagtcccttcaggctcacctcgccggcaaaacctatgtgtctggggactccattactaaggatgacattaaggtcttcgccgcggtgccgtcgaaacctggcgctgagtttcctaatggccgccgctggtacgagaccgtctctgcggctgtagcctcaagattccctggtaaggctgttggtgtaaatctgcctgcgggatcagctcctgcggcagctgctcctgcggatgaagctgaagatgatgatgaccttgatctttttggtgatgaaac

SEQ ID NO: 41720 - DNA, 360 bp, Zea mays
  Clone ID: LIB3062-021-Q1-K1-E6
caactatggactatcatcgtggtgctggtgttgaggtgcgtattgcccgcattttcaatacatatggtcctcgtatgtgtctcgatgatggccgtgtggtcagcaattttgttgcacaggcactacgaagacaaccaatgacggtttatggtgatggaaaacaaactcgaagtttccaatatgtttctgatctggttgctggattgatggctctaatggagagtgatcacattggtcctttcaacttgggaaacccaggagagtttaccatgttggagctagcacaggttgtgaaggaaacaattgacccaatggcaaccattgaattcaaacccaacacagctgatgatccccatatga

SEQ ID NO: 41721 - DNA, 391 bp, Zea mays
  Clone ID: LIB3062-021-Q1-K1-E7
gttaattactcgtacttgagaaacaatgctcctgcaagagcagttggtgcacaaaggaaatgggagttggattatcagctcccagagactaataaccataataaggtgacaaaggcagaagcgatgaaccagtcttggtccagaccagcagcagtaaggagcaatgcaggaaatcatcttgccaacgacctgaacccccgtgtacctgaccttgccgagaagctgtctcagttgtcaatgggccccaacagggtgtcgggtttgggttccgagaggtttgttagaacccatgagaacgctgccaagcgccccttgcccgtgggatccagggcgtggcatggtccagctgaccccttccggcgcccatacgagatgccaggtgatagaactc

SEQ ID NO: 41722 - DNA, 422 bp, Zea mays
  Clone ID: LIB3062-021-Q1-K1-E8
atgctcgtagggacaaagcttgatcttcgagacgacaagcagttctttgtggaccatcctggtgctgtccctatagtactgctcagggagaggagctaagaaagcaaataggcgctccatactacatcgaatgcagctcgaagacccaactaaacgtgaagggcgtcttcgatgcggcgataaaggttgtgctgcagccgcctaaggcgaagaagaagaaaaaggtgcagaggggggcgtgctccattttgtgatctaatcatcggtagatgaagaaacaagggcgaaggtgccatggctttatcatcgtcgcgtcttgcttcagtggaacggcatgaatggtccccaccccctctaggtttactggcggctcggctgcagcgagttctcatctctttgtcgaggcattgagcgatatgttt

SEQ ID NO: 41723 - DNA, 420 bp, Zea mays
  unsure at all n locations
  Clone ID: LIB3062-021-Q1-K1-E9
gactctcccatgcggtatgtcgatatcggcatcccagcgaacaacatggggaggaacagcattggatgcctgttctggcttttggccaggatggttctgcagatgaggggcactatcctccctgggcacaagtgggaggtcatggtggatttgttcttctacagggacccagaggaagcaaaggagcaggaggaggaagctgctgttgcccctgagtttgccgcaatcactgattaccaaggagctgatcagtggggtggtgaccagtggacctctgatgtgactgcgccgcctgttgctcctactggtgctgattggggtgctgctccagctccggttcctaccggtgatggctgggatcaagctggggcccctgcacctgtggtggacggcactgtacctnctctggttgctcctact

SEQ ID NO: 41724 - DNA, 421 bp, Zea mays
  Clone ID: LIB3062-021-Q1-K1-F1
caactttgcaccgagctacgttgatccagaggaagtcattgcaatcctcatttgatgagaaggttaaaggactcgttgaggagcttttgcatgtcgatgaatcagcaagctcaattgaagttttgtttgaggacttcctttgggcaaactcaatcttctggactcgagcactgaacataccattgcctcattcttatgtttttctgggctcatgtggcgatcaacaggccaaggctgacaatgatgcccaccaggaaattgatattacagctaaagattgtagtgctgatgagaattctaaaccaagtaacacagagtcaatttgggttgagggccttgtcccaggaattgatttctgcaatcataatgtaaaggcacttgcaacatgggaaagtgattctgtgggaaatgctaccggaat

SEQ ID NO: 41725 - DNA, 428 bp, Zea mays
  Clone ID: LIB3062-021-Q1-K1-F11
cattgctgctactttgcactgaaaatgcgatccgtttgttttccttgggccacgcaattcagggcacaaagaagataatcaataagaagaaattgagcagctgttgttgtttcgcctctcttattcatagttcttctaatgacattggacttatactcgtcttctccaatgggaaacttgaaataagatccctgccagacttgtccttgttgaaggatgcctttttacgaggttttgtgtactcaagaaacttgaattcaagtagttccataacatgttcatctgatggagaagccatcttgattaatggagaagagacctattttttctctacgctctgccaggatgagatatacaggcacgtagacagcattagtacagtgtacagaaaagagaactcaaccagggaagactcttcttttgtagtg

SEQ ID NO: 41726 - DNA, 308 bp, Zea mays
  Clone ID: LIB3062-021-Q1-K1-F12
cttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgactcatgcctcgcgcaggaccccgacagcaaggtggcctgcgagacctgcaccaagaccaacatggtgatggtgttcggcgagatcacgaccaatgcgaccgtggactacgagaagatcgtgcgcgacacctgccgcgagatcgggttc

SEQ ID NO: 41727 - DNA, 440 bp, Zea mays
  Clone ID: LIB3062-021-Q1-K1-F2
cggacgcgtgggataccgtgccctccttcccgaaggcacgcctcttgagtttcagcggatacttgacctcaagggcttgaagaaagcagaccaacaagctatcctggaggacttcaacaaacacgcccctgcaccagcccccgccatcaaacaccctgccgttgctccgacggtggcgacaccagttgccacagcatctgtccagattgtgccatcggtggcaactccagctgtttcgattacaccaagcatggcctccttgaagggagcactggcgaaccaagaggacgtcctcgcccgagctgccgtccttgggcgcggagcagccaccacgggcttcaagaggttccttgcattgacagaggccgtcaaagatcgcaaggatgggccgatccgcaagctcttcaacgcctaaaatgtcgctcaccgttgagttcata

SEQ ID NO: 41728 - DNA, 447 bp, Zea mays
  Clone ID: LIB3062-021-Q1-K1-F3
gttattgtcattaaaagtggctgggatgaatataacatcaccgccatttcttacatagcaatgattgatacacacatgcgtggaagaaatggcggtgatgttattgtcattaaaagtggctgggatgaatatggcatttcatttgctcaaccaagctccaatatcagcataagcgacatcacaggggagacaagaggtggttcagggattgcctttggaagtgagatgtcaggtggcatatcggaagtacgggctgtgggcctgcgcattgtcaactcccttcacgggatcagaatcaagacggccccggggcgcggagggtacgtggagaatgtgtacatagcagatgtgagcatggacaatgtttcgatggccatcaggatcactggaaactacggtgaacatcctgatgacaaatatgacagcactgctctccctgtgataagc

SEQ ID NO: 41729 - DNA, 446 bp, Zea mays
  Clone ID: LIB3062-021-Q1-K1-F4
attctgcaggaagagttgctcctggagcagttcagtagtttgatcagattcgtcaaatctggtccaggtaagttgagatctcatggcaactgtatgccctttttctttcttacttttgaatcacatttcatacttgacctttatcagcggatgagacggctgcaaattccgagaaagccagcattgccgaagttgagccactggtaaaggatttcgcgagccggtataaggccgcgatcgagctgatgcactatgatgtgatcacatctttcagcaactttctttgcgggatggagatcttgagagcgacgctcgcacagctcctgctatactacaccaggctctccgagtgtgtcaagagaatcaacggcggctctgctcttaacaaggaccttgtctccatatcctccatcctgttcgaaatcaagaagtattctaagacgttt

SEQ ID NO: 41730 - DNA, 329 bp, Zea mays
  Clone ID: LIB3062-021-Q1-K1-F5
aaacagcaaacagacaggtgcccgcttacataccggtccatactgtcaggcactactctcctgtcttgggcctcgacacgactaatactgtgctagtccagaacagatgagccatagccattacctgtgtgcctcccaggttcagttcatatgttgtatgtattaatgtatatcagaagagtcgtgcttagtagtagcaagaacctagtcctgatccagaccgtgaatctggatcatcttgtcctgtggttgtaccgtgcagaacagacagatgtcggctagtcgtttggttctgaagtaagaaactataagcatgcgtgattttggcc

SEQ ID NO: 41731 - DNA, 410 bp, Zea mays
  Clone ID: LIB3062-021-Q1-K1-F7
gcaaaacacagccatggaggggtacgaccgcgagttctggcagttcagcgaccagctgcgcgtgcagacgaccgccttctccggcctctccctcggtgactccatctggtctccggtcaccggcgccggcgggcggcgcaacaacaacaccgacctactcgcggcctccgcgtcggcagccgacgccggcaagcacaacggcgtgggcctcagcctgaatgatggagggcccggactcattggctccgggaagctcgtcttcggcggcagcaaggccggccgctacaacaacctcccatccgagaaggccgcgcccgtctacaaccacagcggcagccacgatcaacggcggctacgccaggagcgacaacgccggcctggcggcgttcaacacgatggtgagctacttc

SEQ ID NO: 41732 - DNA, 444 bp, Zea mays
  Clone ID: LIB3062-021-Q1-K1-F8
ctttggcagagtttacccatccttcaaagttgagaaaattggaggatggaacctcggtgccgggaatggtgaacagcagccatgcttgttatacagttccactggaagcagtgggccctagcggaccatcagggagctatagtgctggttctgttagcttacagcaaccaaggaatgaagagcagcttacgcctgatgtggagtcagctcttctgcagcaaagtcttgcagctgacacccgagcagctgagttcgttgccaccagagcaacagcagcaggtgattgagctccagaagatgctttcagttagtaaatagaagcaactgagagctaacgcagcaaaaatgctggttgagaatctggcacatcacataatggcgagttggtaactagtggaaactggaaatgatcctcagatttgttatgaagtcaccacgccggct

SEQ ID NO: 41733 - DNA, 466 bp, Zea mays
  unsure at all n locations
  Clone ID: LIB3062-021-Q1-K1-E3
gggtcggccgacgcgtccgtacaatgataaagaagaagcaaggtcatcagaagaaaccgatgctctggaggaggcaaggctggcaatcgagcaagtagtgattccgaaaggcgagagcgcgcagctactgccgaggccatcaagcatcatctcgtcccaagtgggtctcgtcgaaagcttcagcctcaagtgggaggtcgtaggccaggagcctaaggcatgcgtgaggatccttccgcactttgcgccaaaacaagtcgaagctgtcgcgcgagaaaccccagcggagcccgtcgactcggactgggagagccacgatgactcggatcatacccagagtggcatcaccaagctacctttcctaccggattagcgncgcgtctggcgtatcctntcagttcttcgtggccctgccgnctgctgngtatgtattccatntaattaatctggtaataacttgcaccca

SEQ ID NO: 41734 - DNA, 417 bp, Zea mays
  Clone ID: LIB3062-021-Q1-K1-C8
tccagaacatgctgagccaccactgcgacttcgtttaccagagcgccttctacacctaccgctcgtgtatcaaggccggcaggaagttccccggcttccgcaccaccgtcgactagcagacacgcacgcgaaagctcgccgacttcttcggccagacgtaccacgaaaccaccactagatgggccactgctccgcatggaccgtttgcctgcggatactgccggatgaacgaacagaaacacacggacccaccctactatggactaggacccatacagctaactcataagtacaactacaggctcgccgagcaagcgctgaacctgaacctggtgggccacccagacctgatgacgatagaccccatggtagccttcaaaaccgccatctggttctggatgacgccgcaaacaccca

SEQ ID NO: 41735 - DNA, 440 bp, Zea mays
  Clone ID: LIB3062-021-Q1-K1-C9
ggcagcacagcgcaccatggaatggctgagctggagaacggtgtgttgtttatcagtgctgtgcaccgtgctgttcttgcgcccggtcgagggcattcgctttgtgatcgatagagaagagtgcttctcgcataacgtggagtatgagggggatactgtccatgtatccttcgtcgtcatcaaggctgacaccccgtggcattacagcgaagaaggcgttgatcttgtggttaaggatcctaatggcgctcaagtccgtgattctcgagataagactagtgataagtttgagttcatagttcagaagagaggcgtccatcgcttctgcttcacgaataaatccccgtaccacgaaactatagacttcgacgtgcatgttggccatttttcatacttcgagcagcatgccaaagatgagcattttgcaccacttttcgagc

SEQ ID NO: 41736 - DNA, 410 bp, Zea mays
  Clone ID: LIB3062-021-Q1-K1-D1
ttccagagcatgctgagccaccgcggcgacagcgggtgccagggcgccttctacacctacggggcggtcatcgaggccggcagcaagttccccggcttcggcaccaccggcgacgagcagacgcgcaggcgggagctcgccgccttcttcggccagacgtcccacgaaaccaccggtggatgggcgactgctccgaatggaccgtttgcctggggatactgccgggtgacggaacagcaacagacggacccaccttactatggactaggacccatacagctaactcatacagtacaactacaggctcggcggaccagcactgcacctgcacctgcctgacgaccctgacctggtggctagagaccccctggtagccttcaagacggccatctggttctggatgacgccgc

SEQ ID NO: 41737 - DNA, 463 bp, Zea mays
  unsure at all n locations
  Clone ID: LIB3062-021-Q1-K1-D10
gctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcaccggctctggccttggttctctcctccttgagcgcctgtctgtggagtacggcaagaaatccaagctgggcttcactgtgtacccatctncccaagtgtcaacctctgttgtggagccttacaacagcgtcctctncactcactcactcctggagcacactgatgtctctatcctgctcgacaacgaggccatctatgaca

SEQ ID NO: 41738 - DNA, 338 bp, Zea mays
  Clone ID: LIB3062-021-Q1-K1-D11
gaattcccggatcctccgaagcgctcaacccgtgcatacttcgttcatctagattcctctggcaacgctgacacgctcactcgtgcgtggcactctacacatgattacccacacaatccaccaactgttctatatgtctctaacatgattcatccaaatatatatacttttggaagcatcttcttagatatactacacaaccagtggagtcctatatatgacgtcgctgcaattttaactagtatccagtacctgctgagcgatccaaacccaaactcctctgcaaactcataaacagcacgactgttcatctagaacaagcacgagtacaaccgcaa

SEQ ID NO: 41739 - DNA, 378 bp, Zea mays
  Clone ID: LIB3062-021-Q1-K1-D12
tcgcttcaatgccgaacagacggcgcggtctttgctgcacaagcatcaaattcaacagctgggcgatgcctctctccttcgagtcgcacatgtgccgtttaacgggaatggcagaaactaccgtgcggcctttgagatgctggaggacattttgaactctgcacaccctctccatcgtgctgtgcaagaggactcctacaagctcgtgtgcatcgatgactcggctgccagggagattggggagatggtgcacagtgaggctttctggatagaggtggatgctgcgcattcgctcgtgaagctgatatatgatatggtgaatgagatggaagctgatctacctattgtagggcattgcctgccgctattgggaagaat

SEQ ID NO: 41740 - DNA, 432 bp, Zea mays
  Clone ID: LIB3062-021-Q1-K1-D2
gccaaatgcaacgacatactccttgcttgtcgacgcccatcttgcaaacaaagatccaaaagctgctcttgccataattgatgagatggttgatgctggcttcactccttccaaggataccctcaggaaggttcgaagacggtgctctcgtgaatcagacttcgacagtgacgagaaagtccaatccctggcaaagcagttcaactaccgaatgggtggtgagaaccgtagagagatgctttatagcatagaatacaatcctgtgtactgaaacagcagttgctactgagtttgctagccattgggagagcacagacattgtagcttgtaaattacttggatgtaccaggattcttaagcaaattttcagtttctcgatcatcatttgtgctcgcagggttcgttttaggatttgctaataagatgacacta

SEQ ID NO: 41741 - DNA, 79 bp, Zea mays
  Clone ID: LIB3062-021-Q1-K1-D3
ctctggacttccagtcaagactctgtgacttcacgccgccacatgaagaaacccaggactctgactgagccgccagctg

SEQ ID NO: 41742 - DNA, 365 bp, Zea mays
  Clone ID: LIB3062-021-Q1-K1-D4
caacatcatattccccactgtttaacccacatctttcaaacaacgcatcggtcgcatatcttacaatatacgatcacataactcatactccctccactccttccacatcttccccaatcataactcctacactctactctcctgcatcacactcatacatattaccatacactccaacaatcaccaaattcatcactactaccccataacccacttcgaacatctacatacatcatcaacaatataacaaacacctcttataacactaccacaattatacaatatctttgatacccattcatataactaaaacattagatcagtactaccactcctacaatacaaaagtttatcacacactccat

SEQ ID NO: 41743 - DNA, 332 bp, Zea mays
  Clone ID: LIB3062-021-Q1-K1-D7
ctggacggttcgacgcacgcactatacatttctccatcaacgcatggatacttgtggttgctggtctgggaatgctggctattttgccaaaacaccttgccgacagagcttgcaaactttcacttctgggaacaatattgtcatcagggtattctctatacagtacttatgggaaaccaagagcatggaacatgccagcaattcaagcttggttgcagtctatacttgcaacaaaggattttatccatttaatgttctcttctatgctcttcacatcccaattgcacttgaagattgctgcactacctgtgttttgctgggcgcttgaccat

SEQ ID NO: 41744 - DNA, 403 bp, Zea mays
  Clone ID: LIB3062-021-Q1-K1-D8
aagggaagggaaaaggctatcgttctcgtcagtcgtcacgagagccgcgacggcgcgcatggcggcgacggcagcggcgctccggtgctgcttccccggatcctccggtgtcggtagtggcttcgtcaagcccaactcctccaggcgaggctggtgcgcagcggccgtggcggcgccgtcgcgggaggcggaaccggtttcgtcgctggggcaccgcacccgcgtcgacttccccatccttcaccaggaatttgatgatgccaaattagtttacttcgacaatggtgcaacatcgcagaaaccatgtagtgtgatgaaaacattagatgagtactaccgatcgtacaattcgaatgttcatcgtggtatccatgcactcagtgcgaaggctactcatgcatat

SEQ ID NO: 41745 - DNA, 410 bp, Zea mays
  unsure at all n locations
  Clone ID: LIB3062-021-Q1-K1-D9
gcgacgcacaaggagaaaccatccattgtcacaagtcatcatgaaacacggtacagggaaggagggagggaacaacgtctcagctggatctatttttttttatgagatagtacagagtagacatgggctagcggaacgcagcacgagaacgaatccacaggagggtaaaaaaaaccgccgctgctcctttgagaggaggtcggtccatcagaagagtgacgaggcgatcgcggagaccacggcgagcgcgacgccgccgctgaccccagcccggaacttgacgccgctgcccgcggcgctgtcgctcgcagggttgccgccggctgacggcgtgatcttggaggcgttggcgaagagggcgtagtccgcagagcctggcttcaggttcagcagggtgatgcanagcgaga

SEQ ID NO: 41746 - DNA, 297 bp, Zea mays
  Clone ID: LIB3062-021-Q1-K1-E1
tatacatttatgaatcaacgcatgtatacttctagacgctggtctggtaatgctagctaggttgccaaaacaccttgcgcgacacatcttgctaactttcacttctggcaacaatattgtcatcactgcattacttatgcagaccttatggtaaaccaagagcatgcaacataccatcaatctaagcttgctatgcacctatacttgcaccagaccattttatccattgaatgctctctactatgctctatacatcccaattgcactctaacatcgctgcactacctgtgtttagct

SEQ ID NO: 41747 - DNA, 368 bp, Zea mays
  Clone ID: LIB3062-021-Q1-K1-E10
gccggtcagcaggaggagcagcggcggcggcggagagaaggctgctaactggtggccggccgttcgccgcgagctccggcaccccgcagccggccggcacgccttcggtccggcggacggcagcagcagcatgtcttcggccgccccgctgctaggcggcgaggccggcggtggcgagcccgcgccgcggacgccgtcgccgtcgtcgtcgtgggtggggcgcgtggtggacgcggcggatgcgcgcgcgcagctggggttcgcggtgccgatggtgctgaccagcatggcctactacggcatcccgctggtgtcggtgatgttctcgggccagctcggcgacgtccacctcgccggcgccacgctcg

SEQ ID NO: 41748 - DNA, 264 bp, Zea mays
  Clone ID: LIB3062-021-Q1-K1-E11
ctcctccttcacatccagtacgggtcttctttcgtaaggtcctcctaagttctgtggggtgggttatcacatccagatggacgccaaatacgttcagtacccctcctttgtctgcggcatctactatcccactatcgaccacttacatatactctcacttaactcctaccatacagatcatatacccaagaccctattcaatcggtcgactcacatcatcctctgcttcaacatcatcttctagctcacccaggaggagtatct

SEQ ID NO: 41749 - DNA, 249 bp, Zea mays
  Clone ID: LIB3062-021-Q1-K1-E12
ggagtacgcgatgtgtttgctcaggcgagacgcctccgaagaggttgtgagggcgttcttgagctccatggtcagaccctgccaccacagcgtcggtggctcggtgccaccgatgggactcgggcgccaaccagccatctgtgtatagctagctatatgattagctccatgatgtacaatattattaggtgtgtatgtatgtagccggatgggaatcacagggaaatcgtacagaaggttatttcgttt

SEQ ID NO: 41750 - DNA, 394 bp, Zea mays
  Clone ID: LIB3062-021-Q1-K1-E2
cagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagat

SEQ ID NO: 41751 - DNA, 399 bp, Zea mays
  Clone ID: LIB3062-021-Q1-K1-C7
agcatacagacgaataatctcttcttcacctcactaacaccagctagcaactctttctctggtgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgaacggccggctcggcggcggcgtcagcatggccaacgccgccaacatccccggcaag

SEQ ID NO: 41752 - DNA, 180 bp, Zea mays
  Clone ID: LIB3062-004-Q1-K1-E3
caggatattattactagagagcctcacttgtatgcattctcattcaagaacgggagactggaggttactgagatcttcaacttttctcaagatgatttgttaactggagacatgatgatacttgacacacaatgtggaattttcatttggaatggtcagtatgtggaatcaaaagagaaa

SEQ ID NO: 41753 - DNA, 110 bp, Zea mays
  Clone ID: LIB3062-004-Q1-K1-E4
gggagagattgtagtgttttaggctgagtagtgaagagcttgtagttctgcacggaacatgcatgatggttattagttgatgcaacaacattgctgatataaaaaaaaga

SEQ ID NO: 41754 - DNA, 201 bp, Zea mays
  Clone ID: LIB3062-004-Q1-K1-E5
cagtcctgcgccgattccgctcccaactcttccgagcatcagatcattgatccactgggactgtgatgagagtgtgaatgtagatgtcagggcctcacatgagagtgaaaatggatctatctctactgagaattcactagaatcagagagggcagcatatgaatatctggctcacactccgtgcatgtcaactgatgcaca

SEQ ID NO: 41755 - DNA, 238 bp, Zea mays
  Clone ID: LIB3062-004-Q1-K1-E6
gccttactggacaagcatttggcaacaggcactttcgatgaggagattagacctatgggccaggcagtgaaatcattgctggtgaccctgttctggtcgtgcctcctgctgtttggcgccatcgagttcttcaagtggacacagcttctgtcgacgtggaggggtgtggcgttcactgccgcaggtatggcgcttgtgacgggtgtcatgcatgtcttcatcatgttctcccaggctg

SEQ ID NO: 41756 - DNA, 425 bp, Zea mays
  Clone ID: LIB3062-004-Q1-K1-E7
cggacgcgtgggtggtgacaatgttggagattgtgctgcccgaggcgctgatctttgtgagagcatagcagcagaaattatcagtgcaatgatacttggaggaacaatggcacagcgctgtaaaattgaggatccgtctggctttattttgtttcctcttgttgtgcattcatttgatttggtggtgtcatcagtcggaattctctcaatcagaagaacacgtgactctgggctcatttcccctatcgaagatcccatggcaattatgcaaaaaggctactctgttactattatgcttgctgttcttacatttggagtgtctactcggtggctcctgtacacggaacaagcaccttctgcatggctaaattttgcattggggggcttggtggggatcattacaggatatgcctttggttggaatt

SEQ ID NO: 41757 - DNA, 439 bp, Zea mays
  Clone ID: LIB3062-004-Q1-K1-E8
gggacgaatggcgagctctcagtgctgcgataacccgccggccctgaacccggcctgcggggagggcaaggtcgtcgacagcttcggcgggttcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacatactccggaaaaagggtttgaagagacaaaacaagttattggggctctaaaggagaagggagtgtctgctgttggaactgcagggtattgctggggtgcaaaggttgttgtggagttggcaaaagctcatgagatccag

SEQ ID NO: 41758 - DNA, 402 bp, Zea mays
  unsure at all n locations
  Clone ID: LIB3062-004-Q1-K1-E9
caccncggcgagtacaacgggagcccctgtccgtgcaggggcccctgctcgggttcacgggcaccatcgagcgcgccgtggtcggcggcaccggcaagttcaagctggcgcgcgggtacatgcttttcaagatgataagcaagccgacgccggagacggacgtcaacgagatcaacctgttcgtgctcatgcaccccgctggcaagtactagcgcacacaccttgagactcgagtgagtggctactaccgcattgttgttgggcaggttgggtgaagtgtctatggccaatccaactctttcagatttgtttctcttggtgaaacccaataaacatgcaacttctttgacctctgagaaaaaaatgtaggccctgtttgttgccgaatggcttgtttgggtt

SEQ ID NO: 41759 - DNA, 264 bp, Zea mays
  Clone ID: LIB3062-004-Q1-K1-F1
gcgtcgacaagggcgccaccgatgacgacctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccagtacggcgaagagggtctcaaggggcaagtgccgccgtcgggcgccggcggagcgggccccggcggcgcaacctttttctccaccggcg

SEQ ID NO: 41760 - DNA, 261 bp, Zea mays
  Clone ID: LIB3062-004-Q1-K1-F11
cacacccacaggcctgccgccacagcaccgcggatagcagagcagagcggcagccaggtcgggcgtcgtcgtcgtcgtcagccatgagcaaggacaagcaccacaagcacgagcaccacctgcggcgttgctgcgggtgcatggcgtcgtgcctcctggcgctggtcctaatcgtggccttcgtctcgctggtggtgtacctggcgctgcgcccttcgaagccgtccttctacctgcaggacctgcagctgcgcaggccca

SEQ ID NO: 41761 - DNA, 446 bp, Zea mays
  unsure at all n locations
  Clone ID: LIB3062-004-Q1-K1-F12
ctgaccccggggaggttattaaaccaggtcaacacaaggccattaacgatgaaggtatgcctgancatggccgtcctttcatgaagggccgtctgtttgttgaattcaacgtcgagtttcccgagcctggtgcgctctcccctgcccagtgccgatcgttggagaagatccttccgccgaaaccagggagccaactgtcggacatggagctggaccagtgcgaggagaccacccttcacgatgtcaacattgaagaggagatgaggcgcaggcagcagcagaagaagcaggaagcctacgatgaagacgaggaggaggatgctcaaccaagggtgcaatgtgcccagcagtaaaatccgtgttcgttggaactgttctccaaaagtttcagcaggattttttatccatctgatcatctcgattcttttttgcaaaaatataatcgt

SEQ ID NO: 41762 - DNA, 350 bp, Zea mays
  unsure at all n locations
  Clone ID: LIB3062-004-Q1-K1-F2
ggactaacttaatcaaagagagcatcagaatgggctacaatgacattggtgatttcttctatgcccatggccaactttcagatgctttcaaaagctacatcaggactcgggactattgcaccacttccaaacatatagttcagatgtgcatgaatgtgattctggttagcattgagctggggcaatatgcacatgtttcaaactatgtcagcaaagcagagcaaacccccgactctctggatcctaccattgttgcaaagctgaaggcagctgcaggattagccaacttggaaacanagaaatacanatttgctgctcgtaagtttgttgagacaggaattgaactagga

SEQ ID NO: 41763 - DNA, 314 bp, Zea mays
  Clone ID: LIB3062-004-Q1-K1-F4
ccaagcacaccaccactccacagtgcacttcactctacagcaacgacagaaaagtgagcagcagacagcagcagctgctgccatggaggcgtggagatctctcctcgcgagcttcgtgctcgccgtgctggccgcgcaggccttggtggctgtggtcgagtccaggaccggccccgtggagcaggcgagccaaggtgacgacgtgaagaagccggactgcgtgccggggatagacccgcgctcgttcccggtgaccggcggcggtcacggcatcacgcccgtgacgccatcgcacggaggctccagctccccga

SEQ ID NO: 41764 - DNA, 325 bp, Zea mays
  Clone ID: LIB3062-004-Q1-K1-F5
caccactacaccacaagtccacaagtccacaacaccaccagcctcgtcacagccgcttcagcataccacaccggacgcagacccaccgcgcgctacgaccaccaccgtcaccatggccgccgcgcgctacgacgtggagaagggcgggaggaataacggtgatgggaagccttcgccgacgacgccgccgccgccgccgccgggccacctggacccgcagcgcgacggcgagagggagtgggtgccctgggtggtgcccgctcgtcgtggccctcaacaatcgtgctcttcggcgtggcgatgtaccgcaacaactggccgggcc

SEQ ID NO: 41765 - DNA, 431 bp, Zea mays
  Clone ID: LIB3062-004-Q1-K1-F6
ctaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaggagcatgacgggccggctcggcggcggcgtcagcatggccaacgccgccaacatccccggcaagtccggcgtctccgtcggcgggcccatcagccccaccgtcgactgcaccaagatcaactgatcgat

SEQ ID NO: 41766 - DNA, 365 bp, Zea mays
  Clone ID: LIB3062-004-Q1-K1-F7
gcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctggactctttatcattcgaagtttggcagtggtgtgtaattgcact

SEQ ID NO: 41767 - DNA, 439 bp, Zea mays
  Clone ID: LIB3062-004-Q1-K1-F8
aaaatgactcaaacgagaagagtgtacttgaggaacgtgctatggagctagagcaagttcgtaggcagttagaggattcaagagctgaggctagggagctacaaactacaattaagaacctgaatcaagttcttgaagagaaagcagaacttgagaatcgtatgaaggatgcggagcaggcaaccagcgacctaaactccctggtcggttccctcgacggcaagctgaaagccacagaggcgcagctcgaacagcttaacgcggagaaagcagaagcgatcctcgaaagcgagaaacaggtatccgagctgaaccaagccatcgcccgtctcaagacgcggctggagctgctgtcttcggaaaaggccgcagtcaagaccaaggagtccgctctgctgaccaacgtcgccgtccgcgacgagaagctgaaggagacgga

SEQ ID NO: 41768 - DNA, 333 bp, Zea mays
  unsure at all n locations
  Clone ID: LIB3062-004-Q1-K1-F9
tccggattcggtcgacccagcgtcggcagcacgacgagtatcttaatacgtatatacgaagcgcatgatgtggtgcatatctgggctgtactgtgtctatggcgggaacccgatggcaacggacatccccaaacagacagacgcgaatgcttcctgtcgattgaaaagaatacaggatccagagttctacatctgaacactattatacagacgccggccgcgatactgcngtggaatgggtacatgcacaaagcacccaggcggtcattgaactcaactcacagcaaagttgcaagctaatcttcatcttggaacctaccttcttaaatactg

SEQ ID NO: 41769 - DNA, 179 bp, Zea mays
  Clone ID: LIB3062-004-Q1-K1-G1
agcagcgttacttactcactagtcactactgcttggctctagcctctagctagtcaactcctgcgtggcccggcatggggagggcgccgagcggtgcgtggaacatggcgcttctggggctggccgtcgcggtggttcttgcggtggccgtcgaggcgcggtccttggagaaaccaaaa

SEQ ID NO: 41770 - DNA, 442 bp, Zea mays
  Clone ID: LIB3062-004-Q1-K1-G10
ccgacctgcgccacctccgcgccgtctcgcccgaggacgcggcggccttcgccgagcggcacggcaccttctccatggagacgtcggcgctggacgccaccaacgtggagcgcgccttcgccgaggtgctccgccagatctaccacgtcgtcagccggaacgcgctcgacatcggggacgaccccgccgcgccgcccaggggcaagaccatcgacgtcagcgccgccaaggacgaggtctcccctgtgaacgcgggcgggtgctgctcgtcggcttagccctggtcaaacatacgctttgctgattaaggaagacataacgtgatgacaatctttgttgacttcgtcaagcggttgggggtggttggcgctcgtgatgtgtttgcagactagcaatcgctgtcctcgattgtatttttcgggctattttttgattgatgcac

SEQ ID NO: 41771 - DNA, 330 bp, Zea mays
  Clone ID: LIB3062-004-Q1-K1-E2
ccagtgcgtgcctggcaagtggcaaactcgagctgtctagtcctcggttcgcgaatcttccacagagaggcagacggcaggactcgcttcaagctcctcatctcgcgcagggggggtcgcctgagatcacagagacaatggtgaaggcagttgctgtcctcgccggcactgatgtcaagggcaccatcttcttttcacaggaaggggatggtccgaccaccgtgactggaagtatctctggcctcaagccaggcctccatgggttccatgtgcacgcgcttggcgacaccaccaacggctgcatgtcgactgggccacacttcaatcctg

SEQ ID NO: 41772 - DNA, 368 bp, Zea mays
  unsure at all n locations
  Clone ID: LIB3062-004-Q1-K1-C12
agtatcccatctttagccatgttcatgcagttctgatggttttttctgccacatctcggttgtntngagaggacgtaggtagggtggagatatgataggataacttaaatttgnattaaatttagaatttaagttatgttagtaataatggggttgaaaagacatattaacaaagaaagatcatattaaaagttgatgttacatttgcagatataggacgtaggaggttttctataaattagaaaatgtgtaagagcattttgaagtcaattgttttgttactagtgatgtaatggagaaacagagttttgtgtgtgtgtacaatcaagtaaaatgtggacacaaaatttttttagatgagaagataa

SEQ ID NO: 41773 - DNA, 211 bp, Zea mays
  Clone ID: LIB3062-004-Q1-K1-C2
atcctctgtctcggcgtcggcgagcaacagaacagacagaggaggggaggcgaggcggaaatggggctccgcgtccgcgcctcctcgcttctgctatccctggccatcgagctcgcggccgtgctcgtctcagtgtcggcgcagcagaaattcgggatcaactacgggcagatcgcgaacaatctcccggacccgacgcacgtggcgaccc

SEQ ID NO: 41774 - DNA, 363 bp, Zea mays
  Clone ID: LIB3062-004-Q1-K1-C3
aaggactggagaaaattattggtgtttagagaggagtggcaaaggtatagagggcatttctacagagcgttgtcaagtgcgcatacatatggaggctgatccctcattgaaacaaaagttggttgtacttgctagaaaagttaaaaagatagatgatgaaatagagaagtacatggaactcttcactgagctcagagagaaccctgctgatattaatgccattgttgcaagacgacggaaggatttcactggggacttcttccgccatcttaatttccttgtgaatgcttataatggccttgatgagcgagatggaatagtcaggcttggggccaaatgcctgtccgcaattcatgcatatga

SEQ ID NO: 41775 - DNA, 213 bp, Zea mays
  Clone ID: LIB3062-004-Q1-K1-C6
gcctccctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagag

SEQ ID NO: 41776 - DNA, 302 bp, Zea mays
  Clone ID: LIB3062-004-Q1-K1-C7
acgctccatatattttttttccttttaaagtttccagtgcagagaaggttctcgtgaattgtgcacctgaagaagagactgaaatgtcaataagtgcaaaatttcgtgctatacagccaagttcttcaatcctttcatatgtggaagataatttactaggtcgtaggcgcttaattgagataaaaaatgctggctacaatgtcaagatttctgctcctctggataacgttcccttctcaaccagcacagagcgtgaacgcatagaggacattgcgttcagaaataagctggaattctttgct

SEQ ID NO: 41777 - DNA, 189 bp, Zea mays
  Clone ID: LIB3062-004-Q1-K1-C9
ctaatatacaagataatggtaaattagcctgagttcgtgatctgctttagttcagtttaccattagcttgtatattatgagcctcagtttgtatcacttagggcctgttcgtttctgctggaacagaccaggattaattccaaatctctaaaacttatagtaattattgaaagaatccgagtcatattt

SEQ ID NO: 41778 - DNA, 223 bp, Zea mays
  Clone ID: LIB3062-004-Q1-K1-D1
gctctcgtcgccgtcctctcccgttcgcaacgccacgctacccaccgccgaaatggccccgaagggaggtggcagggcaccggtgcctgccaagaagaacacggataaagtgacgaaccctctgttcgagaaaaggtcgaagcaggtcggcatcggcggcgcgttgcctgccaagaaggacctgcaccgattcgtcaagtggcccaaggtcgtgcgcatccag

SEQ ID NO: 41779 - DNA, 442 bp, Zea mays
  unsure at all n locations
  Clone ID: LIB3062-004-Q1-K1-D10
ccatgacggagctcatacggaagccacacctgatgaagaagctgcaggaagaagtgcggcggaacgtgccggcggngcaggagatggtcaccgaggacaatctccccggcatgacctacctcaaggccgtcatcaaggagacgctccgcctgcacccgccggtgccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtcgccggcggcgtcgacctcaagcccaacgagttccagttcctggcgttcgggtccgggcggaggatgtgccccggggtccactcggcgtccgcgaccatcgaggcgatgctctc

SEQ ID NO: 41780 - DNA, 429 bp, Zea mays
  Clone ID: LIB3062-004-Q1-K1-D12
cttggctcctgaatacgcgatccgaggccaagtgacgaagaagtccgatatctatagctatggggttcttcttttagagattgtaagtgggagatgcaacaccaacacgagattacctagcgaggaccagttcctccttgagaggacatgggcactctacgagcaaggacgtctagaggacatcgtggacatggacatcggcggcgaccgggacgtcgaggaggcgtgccggttcctgaagatcggcctgctgtgcacgcaagacgcgatggcgcgccgtcccaacatgaccaacgtcgtccggatgctctcgggggaaaagaagatcagcgtagagaagatcactaagcccgccatgatctccgatttcgcggagctcaaggtcagtaacaaggagcgaaggccgggcgaggcacggtcgcccacgac

SEQ ID NO: 41781 - DNA, 288 bp, Zea mays
  Clone ID: LIB3062-004-Q1-K1-D4
gtttcgcaggtgatgctgaagatgaagagccggcatgtggcggggacgatcacgaagaagaagaaaagtaagcggcgcgcatgatatggcctgagcagcgtgcgccacccgttgccagtacactgacactggctctcgctacgtgcaggcgtggtgatcgacgtgtgcagggacgtgccggcgtgggccgggcggcacctgctggaggacggcgagcaccggcggtacttcggcctgcggaccgcggagcaccgggtgatcgagttcgagtgcggcagccagcgggag

SEQ ID NO: 41782 - DNA, 215 bp, Zea mays
  Clone ID: LIB3062-004-Q1-K1-D5
cgctgctgcacctgtcgtgagccccctcctgactgaccgactgactgacggggactactcgccttttgcagcaagagatacagggactcgagcgcattcagcccgtctcgcgatgtggcaatgagtgaataataaaaaccctctcttgcccctgccgctctacgctttctctcgtctggaactggaactggaactcagacatcgtcactggacca

SEQ ID NO: 41783 - DNA, 415 bp, Zea mays
  unsure at all n locations
  Clone ID: LIB3062-004-Q1-K1-D6
gccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccaaaagcaccacgccacctacgtcgccaactacaacaaggcgctggagcagcttgacactgccgtctccaagggcgacgcctncgctgtcgtccagctgcagggcgccatcaagttcaacggcggcggtcatgtgaaccattcaatcttctggaagaacctcaagcccattagcgaaagtggcggggagccgcctcatgggaaacttggctgggccatcgatgaagattttg

SEQ ID NO: 41784 - DNA, 451 bp, Zea mays
  unsure at all n locations
  Clone ID: LIB3062-004-Q1-K1-D8
gcaaggtgttgttcaggatagaaatggtcgaactgttgctacactatttggaaaatgggatgaaagcatgcactatgtaatgggtgattgctttgggaaaggcatgggaactgaacagttttcagaggcccatttgttgtggaaaagaagcaaaccacctaattttcccactagatacaatctcactcgctttgcaattacactgaacgaacttacccctggattgaaggaaaaattgccaccaacagactcaagattacgaccagaccagagatgtctggagaacggtgaatatgaaagggcaaatgctgaaaagttgaggcttgaacaganacagcggcaggcacgaaagatgcaggatagcggatggaagcctcggtggtttgcaaaggataaagctactgacacataccgttacttcggtgggtactgggaatccagagaaaagagc

SEQ ID NO: 41785 - DNA, 421 bp, Zea mays
  unsure at all n locations
  Clone ID: LIB3062-004-Q1-K1-D9
ctcttctgcggcgaaaaaacccccatcgtccatcagatcacttgttaaactttgttgaggggtgatggccgtttctttcgcagacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacaggccccagctgctgangaggaggacgatgatgatgttgacctttttggtgaggagaccgaagatgagaag

SEQ ID NO: 41786 - DNA, 426 bp, Zea mays
  Clone ID: LIB3062-004-Q1-K1-E10
cgtccctgcacacggcggttttcagactgcgatccattccgagcttcgaggaatcgatggtgaagcttcggtgactaagagatcaaactcttcaagttctacgaggctgaagatcctgagcatctgtttggtgaagattcttatgccatggaaattcatcgattgatacgtccttttcatagtcgatcatggttcaaggagattgcatttgtggatgctctaatggagtcgaaaggtggtaagaagtctagtagtagtagtagtaatttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttt

SEQ ID NO: 41787 - DNA, 378 bp, Zea mays
  Clone ID: LIB3062-004-Q1-K1-E11
ccctgggccacgcgacgagcctgccgccctacgccacacgaccggggcaggttgcgcaagacgctcatgctgctcttccagctcgacgactccaccggcagaggcgtcgcgcgtccgtccgaggggccccaatcggcggagttccagtccgtttccgaaggaggaggccgagggggcaagcggatctattttcccccctggcacgtctctctgtccaccgatctccgccgcctcactgctcgcatcgtcggcctcacccgccgcaggcagctcgcccagatcatggcggaggtggaagcagcgcggtgtcgtgtgcgtgggggcgggttgctcaacaccatcgtcatgaacgtggttctcgagccatgcgtgtgcggc

SEQ ID NO: 41788 - DNA, 443 bp, Zea mays
  Clone ID: LIB3062-004-Q1-K1-E12
cacctgacatcaagagggagatgcagatggagatgcagcccgcaccaccaccatctgctgcggcgtcggcatcgcagacggcgtggccgctggattggccggtggacgggcgctcgctcaatcctccatcgctgcccactatatcagtccagtatgtgagtcatattgatttttataatcgattttatgcgccagttcttgcctcgactaatgggtcctcttccattttgtaatcacctctgcatgtttactgtatcactttggtaaattactattgttccatgttgtcttccacaacatactggactggttcagtggttagtttcctattcaaccatttcataatgaaggatgtattggtatttaggtaaataattatttatgattgtgctggtattatctcaatagactggaaaattttaaataacctcatatgacataaa

SEQ ID NO: 41789 - DNA, 430 bp, Zea mays
  Clone ID: LIB3062-004-Q1-K1-C11
ctgggtttgagctgtttagaattaaggagagggatatcccaattgaggtccttgaactcgagaacaagaacgacaagagcattgcatttgcatgggaacctaaaggacatcgctttgctatcatccatggtgatggccctaagcctgatgttagcttctacaccatgcgaacagccaataacactagccgtgtatccaagctcacaaccctcaaggccaagcaagctaatactctgtactggtctcctgctgggcgcttcatagttcttgctggactgaagggtttcaacgggcagctggaattctacaatgttgatgaactagagacaatggcaacaggagagcattttatggcaacagatatcatgtgggatccaactgggagatatctcgcgactgcagttacctcagttcatgaaatggagaatgg

SEQ ID NO: 41790 - DNA, 451 bp, Zea mays
  Clone ID: LIB3062-004-Q1-K1-A2
aggcaaaggatgtcaagaaggaggctccaaaggaggcccccaagccaaaggtggttgaggcaccagcagaagaggaagcaccagagccaaagccaaagaatcctcttgacttgctgacaccaagcaagatggtccttgatgactggaagaggctatactcaaacacaaagaccaactttcgagaggttgccatcaaaggtttctgggacatgtacgacccagagggctactctttgtggttctgtgactacaagtacattgatgagaacaccgtctactttgtgaccctgaacaaggttgggggattcctgcagcggatggacctgtgccgcaagtactcctttggaaaaatgctcgtgataggctctaaaccacccttcaagctgaagggcctttggctcttccgtggccagaatgttcccaagtttggaatggatgaggtctatgacat

SEQ ID NO: 41791 - DNA, 294 bp, Zea mays
  Clone ID: LIB3062-004-Q1-K1-A3
atcaataaagcttgccgccgcctcgacgacatctcgtgccgatcccaacagtcatgttccaattgctctcttggctgctgcttcctcttcttccctcttggtcttggcggcggcttctttttcccttcttcggcgaagaaaatggccaggcacccaggcgtcgactggtcgacgacggctctgttccaacaagtccgcgtcgtcggcgtccggccgggcgcgctgcaaagtcatgacagaagaaaaaaaacatgcgcgagcgtgacgggcaagaaaactccagcagatcgagct

SEQ ID NO: 41792 - DNA, 313 bp, Zea mays
  Clone ID: LIB3062-004-Q1-K1-A4
attaaaatggaattctgttatcacaggattattgacgattggtccccgtttcggtggagcaattgatgatgcagcccgatacttcaaagatgcatgtgataggagcctcacgccatacgagtttgttgaaggcatgaaaaagaagggaatccgtgtgcctgggattggtcacaggattaagagcagagacaacagggataaccgtgtgcagcttttacagaaatatgctaacacacatttcctttaattcaagtaccatggaatccgctgttaaggtggaaacctacaccttgtcaaaggccaccatttgggt

SEQ ID NO: 41793 - DNA, 322 bp, Zea mays
  Clone ID: LIB3062-004-Q1-K1-A5
acgcgttggcttttgaggcgacgtgagagcaggcacatcttcaattcatgaaccctggcatggaggatgatccaacttgtggtcctatcctagacaacgttgccgtcaagaagctcttcaccccagacaaaccaaaggataacgtggtgctgaatggagactttgaggagggtccatggatgttccccaacacgagcttcggcgtgctgctcccaactaaccttgacgagcaaacgtctgccatacctggttggatgatcgagtcaaaccgtgccgtccggtacatagactctgatgagtacaaggtttcccagggaaagcg

SEQ ID NO: 41794 - DNA, 403 bp, Zea mays
  unsure at all n locations
  Clone ID: LIB3062-004-Q1-K1-A8
gctcggtggggtgatcggtcgatcggccgccgctcgagacacgtacgtacgtacgtacccgatcgagggtcgctccaagatgatgatgagcgggaaccggaagcagagggtggcattgtcgccggtgaaggaggccgccgcggtgcccaaggaggaggtgtgggaggtccggcccggcgggatgctggtgcagaagcggagccncgacgcggaacccgcggctgtgcccaccatccgcgtcaagggtcaagttcaacggcgtctaccacgagatctacatcaattcccaagcatccttcggcgagctgaagaaactggtgtcggagaagacgggccttgacccggacgaccagaaggtggtgtacaaggacaaggagagggacttcaaggcgttcctggacat

SEQ ID NO: 41795 - DNA, 441 bp, Zea mays
  Clone ID: LIB3062-004-Q1-K1-A9
gaagtgaaggttgcaccggtagaaaccgacattcggattctaaaactgcaggaagaaattggtcaacatgatcgaaaatattccccagtcaaatttaccaaccccttggttgggccctcaaaactgattgagatgtgcttgaagagagaccgagagctctcccttaaagcctttgaagtatttgctttgacaagctcatcgttccgaagttctaacagaggccttctagaggcatgctggatgaatgcaactgaccaagatgattgggtaaagctttcagaggcatccatgtcagaaggttggagtgacgaggtcatcgaagaatctcttcaagcaactgtcctcttcaaagcttccaggttgtgttacagcccggatgctgtggtgtatgacggcacctttgaggatgttctgcctgtgaagaaagaggatgtacatctg

SEQ ID NO: 41796 - DNA, 388 bp, Zea mays
  unsure at all n locations
  Clone ID: LIB3062-004-Q1-K1-B1
ccattttgtcgtcgtcgttccagctgcagtccagagttggaacccaagcgcacgcagcaccgtcgtcgaactcttccctttacggcggcattggagatggcggcgaatctagaggacgtgccgtctctggatctgatgcacgaattgctccgtcggatgaagtgcagctccaagcccgacaagcacctcatcctcatcggcccacctggctctggaaagggtactcagtctccccttattaaagatgaatattgcctgtgccatttagccactggtgatatgttgagggctgctgtggcagccaagacaactctagggatcaaagctaaagaagctatgggtaaaggagagcttggttcagataacttggntgtggggattattgatg

SEQ ID NO: 41797 - DNA, 284 bp, Zea mays
  unsure at all n locations
  Clone ID: LIB3062-004-Q1-K1-B10
gggaggtcatncactcccgctgggccatgctgggcgcgttgggctgcgtgttccgagctggtcgccgcaacggcgtcaagttcggcgaggccgtgtggttcaaggccgggtgcagatcttcagcgagggtgggctggactacctggaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagc

SEQ ID NO: 41798 - DNA, 442 bp, Zea mays
  Clone ID: LIB3062-004-Q1-K1-B11
caccaaactactcacctgtgctcaacactgacgacgcctacgccagtcaagaagttaacggggctgacgggaagcccattggtcctcctatgggaaatccatggatctacatgtaccctgagggcttgaaggatctccttatgatcatgaagaacaaatacggaaacccacctatctacatcacggagaacggaatcggggatgttgataccaaggagacacctctacccatggaggatgccttaaatgactacaaaaggctagattacatccagcgccacatcgctactcttaaggaatcaatagacttgggatcaaatgtgcaaggctacttcgcttggtctctgctggacaactttgaatggttcgccggcttcaccgaacgttatggcattgtctacgtcgaccgcaacaataactgcacgcgctacatgaaggagtc

SEQ ID NO: 41799 - DNA, 441 bp, Zea mays
  Clone ID: LIB3062-004-Q1-K1-B12
cttcacaagtgcaacatggctggaaagcctgctgttgttactcgtgtcgtggacagcatgagtgacaacctcagacctactcgcgcagaggcaactgatgtggcaaatgcagttcttgatgggagtgacgccattctccttggtgctgagactctccgtggtttatatccggtggagactatttcaacagtgggcagaatttgtgctgaggcagagaaggtatttaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaagtacaggcccagcatgcctgttctatctgttgtcattcctcgtctaaagacaaac

SEQ ID NO: 41800 - DNA, 227 bp, Zea mays
  Clone ID: LIB3062-004-Q1-K1-B2
caagcagatgaaaataatgcaagaattccaaaagcagtcagcacaaatggatatgacaaatgagatgatgtctgattcaattgacgatgtcttagacgatgaccaggccgaggaagaaactgaagaacttgctaatgaggttctggatgagattggtgtagacattgcatcacagttgtcctcggctaccaaaggaaaaattgctgggaagaaggttcagggtgatg

SEQ ID NO: 41801 - DNA, 365 bp, Zea mays
  Clone ID: LIB3062-004-Q1-K1-B3
cgcttgtcattttgaatcctaattctggattccgcagctctcgggatgttttctaccagaaagtgcaatcaacattgaaggcttcaagatggaagtcattgaaacagcatatgccgggcatgcaaaggttctttcttctactggtgacctcaaaaaattccctgatggtattatatgtgttggtggcgatgggatcgtcaatgaagttttgaatggattacttaatagagacgattttgacgtggcaattcgatttcccattgggataatacctgctggttctgaatattcaatggtgtggactgttcttggcatcaaggatcctgtttcttcggcaatagctttagctaaaggggatttcacac

SEQ ID NO: 41802 - DNA, 318 bp, Zea mays
  Clone ID: LIB3062-004-Q1-K1-B5
tcgccagcgacgacggcggctggtgcaacccgccgcgcccgcacttcgacatggccgagccggccttgctccgcatcgcgcagtaccgcgccggcatcgtgcccgtcgcgttcaggagagtgccgtgcgtgaagaagggcggcatccggttcaccatcaacgggcactcctacttcaacctggtgctggtgaccaacgtggcgggcgccggcgacgtgcgctccgtctccatccggggctcccgcacggagtggcagcccatgtcccggaactggggccagaactggcagagcgactcgtacctggacaggcaggcgc

SEQ ID NO: 41803 - DNA, 364 bp, Zea mays
  unsure at all n locations
  Clone ID: LIB3062-004-Q1-K1-B7
gaacatagatcctgaggagatgaagcaagctcaagagcaaatgaggaacaaccccgtatcattgtctggcttgctagccagagcgcagggctagaagtagcacatgaggatgctgcaagggtctagattctattatgtgtttaagggcagtactgaagtgcttgacatgccatgtcactcggagtaatttcctggggacaaggtggaaactctntcccctgtttttactgtatttaaacttgcagtttttctgttatgtagaaccttctgaaacctctagctgagctagtcatttggcacgtcatataccacacattgagatattcttgttcaatttgtattgtatgaatcagctgaatctaac

SEQ ID NO: 41804 - DNA, 417 bp, Zea mays
  unsure at all n locations
  Clone ID: LIB3062-004-Q1-K1-B9
attctgtaattntagtctccatggtcaccggaataaatggcttttggtggtggtgatggttaatcttttcctttgcctgttaccctatggttgggggtttcctgtgaagttgtacgagtttccttgcctnaccctttcttcttaatatattgatacgcagctctcctgcgttttcgaaaaaatctagccggtaattacctattcgtcatcctaggagaagcttcacctaagttgatatttactgaacgatctctagtcattatgtatacatatgtgtgtgtgtgtgtgtgtattacattaactcttttccatgtatgcagcttcactgcttggaaaaaaatggcagacagacaacaaagaagatttcttactgtgctcaacatcggagccctaaccctgataatgntttgataattc

SEQ ID NO: 41805 - DNA, 247 bp, Zea mays
  Clone ID: LIB3062-004-Q1-K1-C1
ggaactcaagtggtctgattacaagaaagttccaatattgacagtagatggtgaacaacttgtggattcatcagatataatcaatatactacagagcaggatcaaccccaatgacgaactcactaatgacgaggaagcaaaatggcgaaggtgggttgatgagcaccttgtgcatgtcttatctcctaacatatatcggacaacttcagaagctctagaatcttttgactacattgcaaaacatggt

SEQ ID NO: 41806 - DNA, 439 bp, Zea mays
  Clone ID: LIB3062-004-Q1-K1-C10
cacacccaaatacagatttgttgtgcgatttaccaacaaggacatcactgcccaaatcatatgtgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgct

SEQ ID NO: 41807 - DNA, 308 bp, Zea mays
  unsure at all n locations
  Clone ID: LIB3062-004-Q1-K1-A12
gctttagcgatggtcctgttcatggctggcgccgcgctgctcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgncttcttcggncagacgtcccacgaaaccaccggtggatgggcgactgctccggatggaccgtt

SEQ ID NO: 41808 - DNA, 407 bp, Zea mays
  unsure at all n locations
  Clone ID: LIB3062-021-Q1-K1-B3
gcgtacggcgatggcgacggcgacagcacggagcggaaggccatgaaggagctgggcctccggcgggcgcggcacttcgggtggtccaacacgtacgtgttcaccaaggccatgggggaggccgtgctgggccagcagctccggggcggcgacgtccccgtggcggtgatgcggcccagcatcatcaccagcgtccggcgcgacccgctgcccgggtggatgcagggcacccgcaccatcgacagcatcatcatcggctacgccaagcagaacctgtcctgcttcctcgccgacctccgcctcgtcatggacgtcatccccggggacatggtggtcaacgccatgatggcggccgtggtggcgcactcggaggcgttcgcgccgccgctgccgcangtggtggtgta

SEQ ID NO: 41809 - DNA, 464 bp, Zea mays
  unsure at all n locations
  Clone ID: LIB3062-021-Q1-K1-B4
gcaattgggtaccaagacctgtacatgatgcttaccatacaaaaacaaacggacctaaaggggaaccaagattggaactgaacctgtgggatttcagcacagaacctgatgattgtgtccttgatttaactctcagtctgaagccaagtttttctggaacagaccttggtaagcatgttccacgacgtacagaagaggaaattctcctgtacccgggatttgagaatacccctgtgaagtccggtatgtcccttgcgttaatttgctgagtctttttttttttttggattgtttcgtcgctcttgcccaccacagctaaatgtcaagcatggtatcacatttgctaaccctgaaaagggggctaacaattattgacatattattgacgccatgtcaggtttttggcctctggtgccatctgatcgtnccgttggtgatgttcctgccataccatcctggcagca

SEQ ID NO: 41810 - DNA, 407 bp, Zea mays
  unsure at all n locations
  Clone ID: LIB3062-021-Q1-K1-B5
ggactagcaaggaggcacgggggagaaaacttgtctgtctattcaaggaatcccaatcacaggagtgccctgaggagtcggaatcatcgagcgctgatgtgttcgaaggcaacccgactgaggtagcaccagctcttgagtaggactagcaaggaggcacgggggagaaaacttgtctgtctattcaagctttagcaccagctcttcgcgtttgcagtatagatgtaaaaaggtttggttaaaatctgatgctacgaaaattggctggtaattattttgtactggatttccccttagaatcaaatatagatggatggctagtgcctggtggtgatgggattcaactgtgttattccaaaaaaaaaaaaacgtgtggtgatggtgggggtcaaaaaaaanaaananna

SEQ ID NO: 41811 - DNA, 476 bp, Zea mays
  Clone ID: LIB3062-021-Q1-K1-B6
cactaacgaacgaactcttgctccgatcacgagctagctgaggtcgacgatggcggctgtgctgaagagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtacacgtacgccccgcgcgct

SEQ ID NO: 41812 - DNA, 299 bp, Zea mays
  Clone ID: LIB3062-021-Q1-K1-B7
ttcccgggtcagaccgacccatccggcgctggttgctcctagatagaggacacgaagtactctgaagccatggagcacttggactcggctaaaagactgggcagagacgagcttatcgcggaagactacggcgaggcggatatcgcatatgaattagctcctgtgactgctcagctcgcttacgcgcaccagctacacggacaatctcacgaagctatgccaacatatgctcatatgataaatggtcagtcagctgatttatcatcactcgctgtggcaacaacatatctgatttcaat

SEQ ID NO: 41813 - DNA, 378 bp, Zea mays
  unsure at all n locations
  Clone ID: LIB3062-021-Q1-K1-B8
agaacatcccaatcccagcaacatctgcaccgaaacggtgattgatcctcgtgttcccaacgacgagtgcatctgctccaagaactgcgcctgtgccggtaagtgcatccttgagtcggctgatgctgtccagacctgctttgtcgactgcgtcctcaagaacgactgcatctgcagcagcaagatcatccccggcgctgacgacccaaaggctaatgccaagtgaagtagtactatcatcccaaataatgtcctacgtatagtacctgctgaataaacctnccatgcaccaacagggagagagtctgtacgtcttctttgtaatcatgaaccgcttgtacgtgtaatatataataaaccactcttcaccttacacat

SEQ ID NO: 41814 - DNA, 290 bp, Zea mays
  Clone ID: LIB3062-021-Q1-K1-B9
gaaggtgcaaaagggtactggagttttgcggagctaaaaatcctatttgtactatttgggtgaactgtgcatttgtacatgactacatgtcacccagataaatagctgggttatttaggactgtactgtttgatgttctgggttatttaggattgtgatagtttgatgccttgatctcttctgaagggtttcgtttccttgaaggatgtagaaacaacacgcaacaacccctttcatgtatgctatttaccatttcttgcacagatgatcaataaagatgtttcgtcttc

SEQ ID NO: 41815 - DNA, 482 bp, Zea mays
  Clone ID: LIB3062-021-Q1-K1-C1
aaagcaagcaccgtgagagagagggaaatcaacgtccaccatcgacgaccttgcgcgtgcaccggtgacgagccacagtagtgagctaggggtcttcgtcggtgagcgccgcgcgcgaagaaggtcttcctaggcgaaaacggtggtcgaagtgctgggaaatgctcgccggagccaatccctcgaggcggaaccgtgctgcgatgccaacatggctcgccgtcaactctaccgacgacgaacaagtgaccgaggaccctggtactcagcaggtggaaaactccgagcaggagctcattgaaggtgaagagcaggtagcccaggaggacgactgctacgaggagtttgacgaggtctaggagtcgtctcccagttgacttaatggcgccaaggaaataatattagttcggtttattgttatgatttatctttataagacactttcactttgtaaaaatgtttgcgatatttatctctaaaaa

SEQ ID NO: 41816 - DNA, 449 bp, Zea mays
  unsure at all n locations
  Clone ID: LIB3062-021-Q1-K1-C10
ctgccattcacaaggtattatgcaccgagatgtgaagccccacaatgttatgatagatcatgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcangaaaccctggacaaagtttattaatgcagacaaccaacacctagtgtctcatg

SEQ ID NO: 41817 - DNA, 459 bp, Zea mays
  Clone ID: LIB3062-021-Q1-K1-C11
catgtgcctgccatacttgtcgcgaccaaccaaccaaccaaaacacactcaactcagtgtgggcgttagtgtacccataaacataggatctgtgcttcacagccgtccccctcaccctgccaaatatggattcacgcgctctccgccgggaaaccccccatgggggtcccctcaccatgcgcccgcttcgggcgccactccgtgtgcgccttcacaatatcggctcctgtttccagctggagcaggtggtcgcactggatggtggagtctgtgtcgccgtctacgcattcacccgcgacggtggtgagcgactgcagcacgctgtcgcgtccgcactccttcctgtaatccagcgtcatgcttgcgagctcgtgcttctccaggatcgcgatcggagcactctcaagaatccaaccgatgtacttgacgttattcacgtgctggttgacatcaaggtca

SEQ ID NO: 41818 - DNA, 445 bp, Zea mays
  Clone ID: LIB3062-021-Q1-K1-C12
ccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgccttaacgcggagcgggagggggtcttccctctcaaggacctcttcctcatctggctcgtcaccatcacctgcaccctgccgatccagtctctgttccccttcttgtatttcatgataagggatctgcatatggctaaacaaacacaagacattggattttatgctgggttttgt

SEQ ID NO: 41819 - DNA, 319 bp, Zea mays
  Clone ID: LIB3062-021-Q1-K1-C2
accatgccgacttgatcatcaccagtaccttccaagagatcgccggaaacaagtacaccgtcaggcggtggtatttacacatggggttgacgatgcctggcctgtaccgacttgcccactgcattgatgtcttccaccacaagctcaacatcgtgtctcctctcgcgcacctatccatctacttaccgtacacctactcgcacaatacactgacctgccttcacccggagattgaggagctcctgtacacacaatccgctaacactgagcacaacttcatacttaacgactggatcaaccccatcatattctacatggc

SEQ ID NO: 41820 - DNA, 442 bp, Zea mays
  unsure at all n locations
  Clone ID: LIB3062-021-Q1-K1-C3
aaaaactttagccagctatcaagacatggctccacttgttgctgctgccacgaatcacactggccatagaagccacatagtaggacccaacaatgagaattttccaaggcaccaaccttgttcatcacaaaacagaaacaagagactcatgcttaggtcacgagcacaaaggataagcagtcagctgcttgcaagccgaaagcttatgccatggcaaatccctaaaagggactggtttcctcctagcttcatctttggtgccgncaccgcagcataccaaattgagggcgcctggaatgaagatgggaaggggccaagcaattgggatcacttctgccacaattatccggattggatactggacggaagcaatggggacactggagccaattcctatcatatgtaccctgcggatgtcaaattgcttaaggaaatangcatg

SEQ ID NO: 41821 - DNA, 255 bp, Zea mays
  Clone ID: LIB3062-021-Q1-K1-C4
caccaactaccccctcttccgctacgtttattacatacgttccataactcctctcctatacacacttatccactatattaatatcttctaccacaaccacaacatcttctatcctctctcatacctatccatttactatccatcaacttactcacacaatcctctaacctccctccacccctctattaatcaactctcatccacacaatccactaacactcatcacagatcactacacaaccactaaaacaaaca

SEQ ID NO: 41822 - DNA, 431 bp, Zea mays
  Clone ID: LIB3062-021-Q1-K1-C6
cggacgcgtgggtgcagttgcaagataccgtacgaaatatcaggctgctcagaagggtaaggtcggaatagtcctggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacattcagctacatgaaggggcagaagctggtccagctggcgcccagtagctactctgccgattggcaggttcaatatgtttttgcacgcaatggcaaaccgattggaccacaggcgaattctaagtggctctaca

SEQ ID NO: 41823 - DNA, 471 bp, Zea mays
  Clone ID: LIB3062-021-Q1-K1-B2
actcgagctcgagccctagcactgtgctgaaacacatgcctgagatctgagtcacgtgcgcggacgattcgttcgggtggagcggagacgagaggaactggggcataccgaaggccttcttctgcggatgggtaaacctctgctacacatctgcggcgtcgatgatgacgcctttctgacacagcatgacatgcaactgaacaatgctattctcgctgaggagaagcacttgcctatgtatgactagttggttagcaagagcaatgctgaatatattgccggacgagctacgcataactctatcagggatgcccaatgacatgcttgaaactcctgatgcaacaagttacatgggatgcatcggaaaggacaagtctggcgatgaaatgagtattaacgctcaacctgcacgagtcactgctcattcctacgaggatgagactgctcttactggcacatgtgctgtatgtg

SEQ ID NO: 41824 - DNA, 459 bp, Zea mays
  Clone ID: LIB3062-021-Q1-K1-A10
ccattctcagccgccgccaatcccttcccgtgctccgcaaccgctgagtgagaagaagagagggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagctgtggcccttcaaggtcatttctgggcctggtgagaagccaatgattgttgtccagcacatgggtgaggagaagcagtttgcagctgaagagatctcctctatggttcttatcaagatgcgtgag

SEQ ID NO: 41825 - DNA, 372 bp, Zea mays
  Clone ID: LIB3062-021-Q1-K1-A11
atttccgggtcgttttttggcagtttgatgatctttgttggtgctgtataggtttggtgaggcgttgctcctttttcttaggtgggtcgttagttcgacatatccttcggtctggttgtccacgatgtaaaatgtactcactgaatagttgcttatggatggcctgataaagtaccttccaatttcaagcgccggaaaagaagagtactgataggctacatgaagatcactaaacaccactgtacggtctaagctatcttgaaaaaggcttcttggtgggctaaacgactaaagaaaatatacatgactgcgtggtcattcaaacatcaactgatctatacagtaaccatgttttaagtgagttgccatgct

SEQ ID NO: 41826 - DNA, 110 bp, Zea mays
  Clone ID: LIB3062-021-Q1-K1-A12
caagagagaggcagagatccgatccggaccgcgaagagacgatgactcacccgaggccggatcatgaaccgtgggtcgaggtgtcgctaactctggcgctgagcacggac

SEQ ID NO: 41827 - DNA, 467 bp, Zea mays
  Clone ID: LIB3062-021-Q1-K1-A2
gaaagaagttcttctttatagaaaatgatttctagattgacacctcacatgcatatggggctgacaggaaacaggcgagcttgagagctgtagacattcagcaaagataacgccacacaaactgtacaaggcataatgacagtccctcttcatggtcggagaaatttggggcaatgactacaacctttacctacctctcatctctagagtgccgattgaaaagatccgctcattcacaccaagtgtcattgccaaagtttcttcaacaatcaccgtgaacatctatgtcatttcatatgttgctgctgctgctgatctgacatattatatagatagtaatgtaactgattggtgtttgccggaattgattacgttaggagccaagactctggtagttcctgggaacctcccaactaggtgtgccaaaatatatgttgatattcaagagtgatgacagagaagattat

SEQ ID NO: 41828 - DNA, 443 bp, Zea mays
  Clone ID: LIB3062-021-Q1-K1-A3
tgaattcccggaagcggttgggagcattctggatgccgcgcctcgtcttacctcatcagtcattcctgccctcaccttctcaggcatctggggatacttggaggtatttgggctgataggattggtggtgctcttgcatggagttctttgctttcttctagaagccgtgataggagcatcctccaccatgatatccgtgctcaagaagattatgttagcaagcttaccgggcacaaatctgaggactatggcgcatcacagtgtatgtctgcaattgctggctcctatggctatattgctccaggaatgcatatacccctaaggtcaatgagaagagcatgtctacacctttggtgtcgtgcttcttgagctggtcaccggaaagaagccagtatgtgagttttgggacggcgtcaacattgtccatcgggtcaagtcgatga

SEQ ID NO: 41829 - DNA, 486 bp, Zea mays
  Clone ID: LIB3062-021-Q1-K1-A4
cgtcgactaattcaaaaaaataggtgccttgttgcagtagaagggttttatgagtggaaaaagaatggatcagagagagagccatactacatacatttccaagatcataggcctcttgtctttgcagccttgtatgatgcatggacaaattcagaaggagagatcacccatacattcactattttgactacacatgcctcaacttctctaaattggcttcatgatagaatgcctgttatcttaggcagtaaggactatgttgatgcttggttaaatgatgtttctgtaaaacttgaagaaattactgcaccttacgaaggagctgatctggtttggtatccagtgacatccgcattgggtaaagcatcatttgatggacctgagtgcatcaaagaggtacatatcggagctactgataagcctatttcaaaattcttcaccaagaaatcgactgcctacgatctatcagggaagtatgagaatatg

SEQ ID NO: 41830 - DNA, 461 bp, Zea mays
  unsure at all n locations
  Clone ID: LIB3062-021-Q1-K1-A5
agcagaccagacgagagacctctcgcgttccgtcctcctccctgcccctgctgccgttccccggcttcctcagttctcccgcccgctgctgccctccgtccgcgtccagatcccgccaccaaccgatccggcgccctccagcatggcgggggcgaaggcggcgggagccctggctcttgcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggcaatntgaaactgtctggtcatctggtgcctgagcttgngnactggagcatcttcagtatctggaactntataagaataccattcagggacaatccctctgagc

SEQ ID NO: 41831 - DNA, 403 bp, Zea mays
  Clone ID: LIB3062-021-Q1-K1-A6
gcggattgcccccaggcggccccactcactccgctgttgatatttcgtttggttctcctttgggtgttgtccgtcgccgaggccttcttcccctcgctccccagctccagcaggcagatcagatccatccaaccacgaacaggaaggaaggtaggaggcctgaagggctgggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccggctggttccgcgaccactggtcccgcgagcacgcccacctggatgagatagccgagcaggtcgagttggtcgccctccttgcctacgatgaggatgagga

SEQ ID NO: 41832 - DNA, 442 bp, Zea mays
  Clone ID: LIB3062-021-Q1-K1-A7
tcagcggggacaagcatccgggatgctgtggagcaagttgcttggatttaacttgttactgccgatcatgggcaatgctgaggatgtggtgaaaagggacaaatctggcaagccgttgctcgacaggaatggtggtatccagattctaacctcgcatacccttcaaccggtgccggttgccattggaggccctggtcttcaccccggagtgaaattccggaacgacattcaaatccctgggctcgccaatgtagccgcaactgtgatgaacctccatggatttgaagcccctgctgactacgagcaaaccctaattgaagtggctgacaactaaatactggccagctatgtccaattttggttctatagttttgagaaaggatatggccatgccattcaataatttctgtttgcaagcacggtgctcaaacttaccaaaaca

SEQ ID NO: 41833 - DNA, 475 bp, Zea mays
  Clone ID: LIB3062-021-Q1-K1-A8
tcgcagcgagcagaaaagtgagccttaccaaaggtttgagcatgagaccaacggcaacagttgggggtgctcccaaaattcttgatcgaagaacaattccagttcttgggacgactgggacgacccaggcaagaaagatgagcctgcgaaaccgcaccagagcagtgactcctgggctggctgggatgatgggaaggatgatggttttgatagccctagttacaacaatcacagcacctccaacaaggggagcaaccaaaacgggacatccggtggcacattttggacagaaggcggcttccgctgaaaccagtctcttttccatagagctatactttcagagttgttacatgccaggaaacgtgaaggtccagtggttggtattatttgggatacttaaacagtcgggtgaaagggtttgtgtggtttgtaccatgtctacaactggtattatatctagtgagatatatttctg

SEQ ID NO: 41834 - DNA, 454 bp, Zea mays
  Clone ID: LIB3062-021-Q1-K1-A9
ggaaatcaagtgaggaagccacaccaaaagttgtggcgttcagtccgctagaagcagctatggctaaacctagaagtagtcccctgacaagtgagagttctaaagtaaggcgatcagagatagcaacccaagtcaccttttacatgatcccagccctgcttcttgcctccaagaacagcataagtacctcccttctggtcggcgccgtgttccatcaagtatacatgttccacaaggagattcttctggactacgtgcaccatgatatcaccagaaagtgggctttgatttacttcaagctgcttttgctggtgatggcgaaggacaccatcatgtacttcaatctgttctaagctcaccttttcagtttctcaaatatccagcaatgcatccgtctctgcactcgtagaataatgatgatggatgaattatgcagccttcgttcttgtattct

SEQ ID NO: 41835 - DNA, 141 bp, Zea mays
  Clone ID: LIB3062-021-Q1-K1-B1
tactactctgtccctcgtctccccaaactccatctacagcacaatggactccatcctctcgtagggctccattaaccaaggtcccacacccgatctcgatcacacaccccgcatcccaacacctacactgcacactcacac

SEQ ID NO: 41836 - DNA, 474 bp, Zea mays
  Clone ID: LIB3062-021-Q1-K1-B10
atttcatgatcttgctgaactcttccgaatcggtggaaagtgtccagatacgaactacttgtttatgggagattatgttgaccgtggttactactctgtcgaaactgtcacacttttggtggctttaaaagttcgatatcctcagaggatcaccattctcagaggaaaccatgaaagccggcagattactcaagtgtatgggttctatgacgaatgcttaaggaagtatggaaacgcaaatgtctggaaaacctttacagatctatttgattacttccccttgactgcattggtcgagtcagaaatattttgcttgcatggtggattatcgccatccattgagaccctcgacaacatccgcaactttgaccgtgtccaagaagttcctcacgaaggtccaatgtgtgatcttctgtggtctgatccagatgatcggtgtggttggggtatttctcctcgtggtgctggttatac

SEQ ID NO: 41837 - DNA, 275 bp, Zea mays
  Clone ID: LIB3062-021-Q1-K1-B11
gccgcgacgctcgccggccggcgaggccgaggccaccgtgaccgcgctctaggtacgaccagtagtaaatcatcgacggaggctagctcctgcctctgctgtgtgtaattactgtatgtgagtgaccgatcccatcggattgcgttcgtcttgtggagacgctgcgtgatcgcgcgattggtttcgctttcgccgccttgtttttgcacgaggaggttctgctagtgcgtacggggagaataaaagcagcattcctgctgtccaaggcctgtcct

SEQ ID NO: 41838 - DNA, 440 bp, Zea mays
  unsure at all n locations
  Clone ID: LIB3062-021-Q1-K1-B12
agcgacactggttcggtttgaacctggttctggcttgggagttttgcggaggaggctgttgcatggccgacattccttacatgggcgtcgcttcgggaacagaactgncatgctggatatgctccgtatgatctctacttgcagaaataccccaggtgatntctgcgtttgcgactgcatgaactgcgatacgagctttgctatgtgccagtatttacagaaacttagacttgagttttggcttttgagcctttggatggttcttccggtccagatagtggtaccattagttgaacgaaatatttggaaatgttgttccacagtagatatcggatggacaataggatataagtactggatagagacacaagttgtcgttaacatcngttcttacttcgctattaatgtttttgatgacgtcagacattaatgtggatgga

SEQ ID NO: 41839 - DNA, 419 bp, Zea mays
  Clone ID: LIB3062-021-Q1-K1-A1
agcagaccagacgagagacctctcgcgttccgtcctcctccctgcccctgctgccgttcccggtcttcctcagttctcccgcccgctgctgccctccgtccgcgtccagatcccgccaccaaccgatccggcgccctccagcatggcggaggcgaaggcggcgggagccctggctcttgcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgttacccggctagatcttggcaatttgaacttgtctggtcatctggtgcctgagcttgggaaactggagcatcttcagtatc

SEQ ID NO: 41840 - DNA, 198 bp, Zea mays
  Clone ID: LIB3062-020-Q1-K1-G4
ctattctgatcgcgagcgccgcccttttttttttttttctttctttatcttttttttggtttttggtttttttttttttttttttttttttttttttttttttaaaaaaaccctcaatcaccaaagcattccctaaaaactcccccactccgccacatctacaccccacccatttaacctacacaaactaaccaaaaa

SEQ ID NO: 41841 - DNA, 425 bp, Zea mays
  Clone ID: LIB3062-020-Q1-K1-G5
tcgcgccagttgaggtcctctgtaaatcatatccatcagagtttactgcatacttgcattactgtagatcactacgattcgaagataaaccagattactcctatttgaagagactcttccgtgacttatttatccgcgaggggtaccaactagattatgtatttgactggaccattatgaaatatcctcagtttagagataaacgcaaaattcagtctagcggcaagatgagtgggttggcaggcccttctgcagaaaggactgatagaactgcagctgaagctttgtttagaaggactggatctggttctggtcacaatcgagagcacaccaagcacagaagtcttctggagtcactgatgccatccaaagcttgtgattcggataaagcaaggccacaatcatcgtcgcgcaacgggagcaca

SEQ ID NO: 41842 - DNA, 338 bp, Zea mays
  Clone ID: LIB3062-020-Q1-K1-G6
caccttcaaagatgagaacttcaaattggttcacactggacctggagtgctgagcatggctaatgctggcccgaacaccaatggcagccagttctttatttgcactgtcaagacaccttggttggacggaaggcatgtcgtgtttggccaggtcctggaagggatggatgtcgtaagtctgatcgagtcgcaggagaccgacagaggtgaccgcccgaagaagaaagtagtcatcagcgagtgtggggagcttccagtggtctaagtgttactcatctgttgtcggtcttacctaacctcggatggatggcgatatttcccccacctgaacttgtcgt

SEQ ID NO: 41843 - DNA, 447 bp, Zea mays
  Clone ID: LIB3062-020-Q1-K1-G7
cagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgctgggctcgtggcatatgtgaagactccccgtggcctccgcacactcaactctgtttgggcccaacatcttagcgaagaagtgaggagaaggttctacaagaactggtgcaagagcaagaagaacgctttcacaaagtatgctctcaaatatgaaaatgatg

SEQ ID NO: 41844 - DNA, 212 bp, Zea mays
  Clone ID: LIB3062-020-Q1-K1-G8
aaaaaaaaaaaaaaaacaaattaaaaatttaacaaaaaaaaaacaaaaaaacggaaaaaggtaaaaagaaggcggtgctcccggttcctcccttcctgtgatctccttccctagtcttcacccctatatcccttgacatctgactgcctaacttacctacgtggctcaccttactcacattgaaaaccacggtgacacttccctatccaaac

SEQ ID NO: 41845 - DNA, 459 bp, Zea mays
  Clone ID: LIB3062-020-Q1-K1-G9
caaccaatgatgttggtattgctaaggatggtaccaaaagggaaactttccaacctggtgtagaactaagagggcgaataacactgcttgctgagggttgccgcggttcgttatcagagaaaataataagaaatcacaagctcagagagagaaggcaagggcaacatcagacatatgctcttggaattaaggaggtttgggagattgaagaaggaaagcacaatccaggttctgttattcatactgttggatggcctttggatactaaaacatatggaggatcattcctgtaccaccttgatgatagacagttggcaattggtctggttgttgcgttgaattatcgaaatccgtttctgagtccctatgatgaattccagaaatttaagcagcaccctgctgttagaaaacttttggaaggtggaacagctattcagtatggtgcacgtactctcaatg

SEQ ID NO: 41846 - DNA, 295 bp, Zea mays
  Clone ID: LIB3062-020-Q1-K1-H10
gtagttgatccacacgagaggtctccggaagctgatcacgctgaggattccacttagcagcaacagggtcatcgaggtggccctccggaagcacattatcatctgcattgaggaccttgtgcacgagatcatgacggtgagcccacacttcaaggatgccaacaacttggctcggccgttcaagctgaatgcatcccgttgcgggctcaataagaagaggaaccactacgtatagggcggtgacgcctgataccgatagaactacatcaacgagctcatcaagaggatgaactag

SEQ ID NO: 41847 - DNA, 384 bp, Zea mays
  Clone ID: LIB3062-020-Q1-K1-H11
gtaggggatccacgcgataaatctccgtattctgatcacgctgaggattctactcagccggggcgggctcgacgagatggcgctccggaagctcattatcatccacattgacgaacgtgtgcacgcaactatgacggcgaccagacagtgcactgaggccaataactcggtgcggccgtccaacccgaatgctcctgtatgggcgctgaatacgaagcggacccaatacgtatagggctgtgacgcatgaaaccgatacacctacatcatcgagcgcatgacgaggatgaactaggcacggtcttggatcctgtgagaaagcgtctcagcgtcagcgtgatcatttttactgtaatcagctgacaggtcatgatcgacatgcaa

SEQ ID NO: 41848 - DNA, 352 bp, Zea mays
  Clone ID: LIB3062-020-Q1-K1-H12
agcgacatttgacctatgttgacccatctacctatcagacaatgggaaacttgaaaattgtcacgactgggattttgtttaggcttgtcctaaaaaggaagttgtccaatatacaatggatggcaattgttttattggctgttggtacaactacaagccaggttaaaggatgtggagattcaccatgtgattctcttttctcagcaccattggagggttacttgcttggaatactttctgcttgtctttcagctctagctggtgtgtacacagaatatttgatgaagaagaataatgatagtttgtactggcaaaatgtacaattatatacgtctggagttatctctaacat

SEQ ID NO: 41849 - DNA, 425 bp, Zea mays
  Clone ID: LIB3062-020-Q1-K1-H3
aggctccacacagacaactccgtagagctccctgctttgttcagacttcagagcccttgctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttgtgtgtgtg

SEQ ID NO: 41850 - DNA, 352 bp, Zea mays
  unsure at all n locations
  Clone ID: LIB3062-020-Q1-K1-H4
gacgcacgcgtccggctcctggcgcggcccaacgtgaagctgttcaacgccgtggcggtggaggacctgatggtgcggcggnggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatgaacgccggcgaggacgagatcgtgcgcctcacgcgcgaggtcgtgcccggcatgatcgtcaccggga

SEQ ID NO: 41851 - DNA, 425 bp, Zea mays
  Clone ID: LIB3062-020-Q1-K1-H5
aggctccacacagacaactccgtagagcttcctgctttggtcagacttcagagcccttggtcttgtgtccgtgcaaattggtgatacttgaacagggatctcctccatattagtgagcatgatgtataatcctcccagtgggcaggacatgtcctactacgatcatgtgcagaagcgccatgaggagaaaggctgcctatatgcatgcctgttcactgcatgctgctgcttctgctgcttcgagacctgtgagtgctgcctcgaggccatctgctgctgctgctagttctgcttggaaggcatgggcgtacatcatcgtggagatgtggccatgcgggacacccaccggcgaataaaatgctgtacttatatgcacgcacgttagaaatgcattagtgtctgttcgatgtgatcttgtgtgtgtg

SEQ ID NO: 41852 - DNA, 459 bp, Zea mays
  unsure at all n locations
  Clone ID: LIB3062-020-Q1-K1-H6
tgacggatggacccacgcgttcgctctgctctaccccacctcccggtccggcagcagagagcgggggtgcagagagatcgagatccggaggccgcgagtgggagcgccaccaccagcgactgcggcaatggcgggcacggtgacggtcccggggtcgtcgaccccctccacgccgctgctcaaggacgagctcgacatcgtgatcccgacgatccgcaacctcgacttcctggagatgtggcggtccttcttacagccctaccacctcatcatcgtgcaggacggcgacccgaccaagaccatcaaggtgcccgagggcttcgactacgagctctacaaccgcaacgacatcaaccgcatcctcgggcccaaggccttctgcatctcattcaaggactccgnctgccgctgcttcggctacatggtctccaagaagaagtacatctacaccatcgacga

SEQ ID NO: 41853 - DNA, 417 bp, Zea mays
  Clone ID: LIB3062-020-Q1-K1-H7
tcgcttttggcagatctgattctgaagccttctgaagaggatctaaagatctggccccacagggttcaatttagtttgagagttgctcttggaccttctggagatttgagtctcacatcacgaatcaggaacaacaacccagatcgaagacctctctgttatacatttgcatatcacacatacttctctgcttccgacatacgtgaagggcgtgtcgaacgactggaaactatggactaccttgacaacttagatgcataggaaccgtttacagatcacggcgatgctattgcttttgaatcacaagttgacaaagtttaccttgctgcacccttcaaaattgctatcattgatcatgacaagaatagatcatttctcgtgacaaaagaatgacttcctgatgcttgtgatcggaac

SEQ ID NO: 41854 - DNA, 294 bp, Zea mays
  unsure at all n locations
  Clone ID: LIB3062-020-Q1-K1-H8
tcggcagccatggcttcatcggtggccgacgcggcgagcacattcctgggcaccgcgctgggggaccccgtgccacagaacgggcgcatcgtggcccggttcgggttcgggttgggcggcaaggcgaagcctgctccgaagaaggtggcgaagacatcgacctnctctgaccggccgctgtggttccccggcgccgtggcgcccgactacctggacggctagctggtcggcgactacgggttcgacccgttcggtctccggaagcccgtggagtacctgcagttcgagttggac

SEQ ID NO: 41855 - DNA, 417 bp, Zea mays
  Clone ID: LIB3062-020-Q1-K1-H9
ctcgcagatccaagcggagaagctgcgtcgtggcctgaccctgtccgtcctctccggtcggcgagagcaagaagagatcccgcgccgtcctcttcttcaccttcaccttcacccatggcggcctgcaccttcagcggcgactagacggcgcccttcttcggcttcctcggcgccgccgccgcgctcgtattctcctgcatgggcgccgcctactggacggccaagagcggcgtcggcgtcgtctccatgggcgtcatgcgccccgagctcgtcatgaagtccatcgtacccgtcgtcatggcgggagtactccggatctacggactcatcatcgccgtcatcatcttcacgcggatcaaccgcaatgccaagcgctactttctcttagacggctacgcgcacctcttctccggactc

SEQ ID NO: 41856 - DNA, 450 bp, Zea mays
  Clone ID: LIB3062-020-Q1-K1-G3
tcccgctggcttcctcttttcaaaaccctcgctaatctcgtgccccgtcccacccacctctagcttcgaatcggagcgcctcgcctccgcattctagggtttccccgcctacggcgccggccatggaggcggtggtcgtcgacgcgggctctaagctgctcaaggccggcatcgcggcgcccgaccaggcacccccactggtaatgccgtcgaagatgaagctggatgttgaggaccaggagctggctgacggcgcggtggtagaggaggtggtgcaccctgtggtgcgcggcttcgtcaaggactgggacgccatggaggacctactcaactacgtcctgtacagggacattgggtgggagattggggacgagggccagattctcttcaccgaacccctcttcacgccaaagactcttcgggagcaattggtgcagcttatgtttgaaa

SEQ ID NO: 41857 - DNA, 400 bp, Zea mays
  unsure at all n locations
  Clone ID: LIB3062-003-Q1-K1-G8
ggcgactcggagctgcagcagctgctccacatcttcaagttgcttggcaccccaaacgaacaggtgtggccaggcgtcggcaagctgcccaactggcacgagtacccccagtggaagccgacgaagctgtctgctcttgtgcccggcctcgacgctgatggctacgatcttcttgagaaattgctggaatacgagccggcgaagcggatccccgcgaagaaggccctggagcacccctacttcaaagatgtgaggaagggagatgcgcactgactgaagcgatccaccaaagggcccgcctcacgagttgacatatatatacgtgtgtgtcgtcgtgtcgagcatgattgccctgaagcaattcttttgctaccagggcacagnctactttctggtctct

SEQ ID NO: 41858 - DNA, 186 bp, Zea mays
  unsure at all n locations
  Clone ID: LIB3062-003-Q1-K1-G9
ccacacaaacaaaacaggtgacaacaggaataccaaccatgatcatccaatacataaacatcacaacgcagggcagtaaaacattnatcaaccatggtcattacatacttataactgatacaaccattattaaccctatactatagatccatttaccctttaagtttgctaataatacaaaatatt

SEQ ID NO: 41859 - DNA, 417 bp, Zea mays
  Clone ID: LIB3062-003-Q1-K1-H1
catcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatggg

SEQ ID NO: 41860 - DNA, 448 bp, Zea mays
  Clone ID: LIB3062-003-Q1-K1-H10
cagtaccatcaatcatcattcatcttagtagtataggcaccaaatcaaatctgcaacatcaattatctaactccaaaaaccatgaagctggtgcttgtggttcttgctttcattgctttagtatcaagtgtttcttgtacacagacaggcggctgcagctgtggtcaacaacaaagccatgagcagcaacatcatccacaacaacatcatccacaaaaacaacaacatcaaccaccaccacaacatcaccagcagcagcaacaccaacaacaacaagttcacatgcaaccacaaagacatcagcaacaacaggaagttaatgttcaacaacaacaacaccaaccgcagaaccaccaccaacaacaacaacaacagcaccaacaacaacatcaatgtgaaggccaacagcaacatcaccaacaatcacaaggccatgtgcaacaacacg

SEQ ID NO: 41861 - DNA, 317 bp, Zea mays
  Clone ID: LIB3062-003-Q1-K1-H11
cactgaccgtacctatattcctgtcctaccggatgcacgtggtgttcctgatactcaagggggtgggcgtcgacatggaacggtggcagcttcatcttgtaggtgatgcctcggcaagtattgcagaagcagctgaagaaactggacttgaatcccatggaacaggggagctctacacaaggtgcgccaggtggtgatggtggcacattgggtaaccaccaccagcacacatccgatgagcatatccaggactgaggaaattgaagctggatgtaggattaaattttgatgtacactgacacaacctttggtgtcat

SEQ ID NO: 41862 - DNA, 322 bp, Zea mays
  Clone ID: LIB3062-003-Q1-K1-H12
gaattcccggggagaccaacaagcaacatagaaagtggaatacagtagcaacaatagagcaacaatggcggccaagatattttccatccttgtgctccttgctctttctgcatgtgttgctaacgcgaccatttttcctcaatactcacaagctcctatagctgcccttcttcccccataccttccatcaatgaccgcttcagtttgtgaaaacccagcccttcaaccctacaggctccaacaagcaatcgcaacaagcaacttacctttatcacccctgttctttcaacattcgccagccctatctttggtgcagtcattg

SEQ ID NO: 41863 - DNA, 393 bp, Zea mays
  Clone ID: LIB3062-003-Q1-K1-H2
cgcgcgactagcagcttcagcaaacattcacaatcttctagctgcgtgctaccccataacgggcaggggtaaacaggcgtagagcagctgcccaactgcaacgatcccacatggaaaccagcgaagctgtctgctctttgcccagctctacgctgatagctacgcatcttttcataaattggggaatcaacctccgaactgtccccatgaaaagccctggatcacccagtacttcaaagatctgacgacaggagatgcacactgactgaagcgatccaccaatggcccgacctcacaagtcgacatatatatacgtacgcgtcatcgtgtccatcacgattgccctgatacaattcttttgctaccaatgcacactctactttctcgtctcta

SEQ ID NO: 41864 - DNA, 426 bp, Zea mays
  Clone ID: LIB3062-003-Q1-K1-H3
acttttcacagcctgttgtggatgcatttgacccaagattattaatttctccaccaacgtatcatacacttgattttactagcatgaaggaagaggagctttacgagattaatattcctctgagctttgtagcttctgttggcactagagtacatggactagcttgttggtttgatgtattgtttaatgggagcactgtgcaaaggtggcttaccactgctccaggatcccctacaactcactggtaccaactacgatgtgtgctttcacagccattgtatgtcatggccggccaagaaataactggccatcttcgtctcgtagcccatagtgctcaaagctacacaatatacttgacaatgtcagctaaaatgtggggtgtgggtgccgagcaaggcggtatcctacagacatctactgggaaac

SEQ ID NO: 41865 - DNA, 410 bp, Zea mays
  Clone ID: LIB3062-003-Q1-K1-H4
attttgaagtagatatgaatgggaaaagattctcttggcaggggatagcaaaactgccctttatagaagaagatcggttgctggctgagattaaaaaagttgaggatactttgacgcctgaagaagcaaggagaaacagtaccatgtgcaatatgctttttgtgaatggcgcccattcactttctccctatatctactctctcaacagtaaattcgggcatctgccagacaaagaccgtggtgcaatcaaagaaaaacttgatccttcagctagtggaggaatgaatggttacattgcactctgtggtggggacccgtcccctcctgtcttcagatctcctgtagatgggcttgaggacatcatggataatcaagtgatatgctcaatctacaagctttcagatccacac

SEQ ID NO: 41866 - DNA, 296 bp, Zea mays
  Clone ID: LIB3062-003-Q1-K1-H5
gcaagactgctggcaagcccaagccagcagcagttcggtagcccctggtacagagcccaccgcgggctggatctgggcccactgtgcggacaacccccaagctacctgaccggcgagttaccctgctactacagctgggacaccggggggctgtccgctgacccggagactttcggcaagaaccgctagctggaggtgatccactgccgctgggccatgctgggcgcgctcgggtgcgtgttcccggaactggtcgcccgcaacggcggccagttccgcgaagccgtgtggttcaa

SEQ ID NO: 41867 - DNA, 433 bp, Zea mays
  unsure at all n locations
  Clone ID: LIB3062-003-Q1-K1-H7
agagaagagcacagcactagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccgggcggcgcgcgaacgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactganggagaag

SEQ ID NO: 41868 - DNA, 460 bp, Zea mays
  Clone ID: LIB3062-003-Q1-K1-H8
gaattaccggcatgttgaagtagatatgaaggggaaaagattctcttggcaggggtatagcaaaactgccctttatagaagaagaggggttgctggctgagattaaaaaagttgaggatactttgacgcctgaagaagcaaggagaaacagtaccatgtgcaatatgctttttgtgaatggcgcccattcactttctccctatatctactctctcaacagtaaattcgggcatctgccagacaaagaccgtggtgcaatcaaagaaaaacttgatccttcagctagtggaggaatgaatggttacattgcactctgtggtggggacccgtcccctcctgtcttcagatctcctgtagatgggcttgaggacatcatggataatcaagtgatatgctcaatctacaagctttcagatccacacaagcacatggttcgtccaccagctggtggtatcatacc

SEQ ID NO: 41869 - DNA, 440 bp, Zea mays
  unsure at all n locations
  Clone ID: LIB3062-003-Q1-K1-H9
acccgcccttcgacccctacgagaacagcctcaacttcctcgtcgcctcctacatcatccgctgcgtcggcctcaccggctacgtcggcgccaaccccaggctcctcacccctcaggccagaaagctgctggcggngctgctggcggtggagtcggcgcaggacgcggtgatcaggacgctgctgtacgagcgcgggatggcgcgtgtgccgagctacgccggcggtgtggcggagatcacggcgcgcatctcggacctccggaactcgctggggaggaggggcgtgaaggacgagggcctggtggtggcgcccgagctggggcccgaggggctgaccgtggggaacatcatcgccggcgaccacctgtcgctcgcctacgaccggacgccggaggagatcctcgggatcgtgtacggcaccggtaactccgcccagcac

SEQ ID NO: 41870 - DNA, 442 bp, Zea mays
  Clone ID: LIB3062-004-Q1-K1-A1
gcccggacatgtgcacaactggaggcactgaatgtttccgtgctaggtggcgtgtctcagacagtagacttgcagacggtgtacaacatagaaggctgggatgcgtacgcgttggcttttcaggcgacggaagagcaggcacatcttcaattcatgaaccctggcatggaggatgatccaacttgtggtcctatcctagacaacgttgccgtcaagaagctcttcaccccagacaaaccaaaggataacgtggtgctgaatggagactttgaggagggtccatggatgttccccaacacgagcttcggcgtgctgctcccaactaaccttgacgagcaaacgtctgccatacctggttggatgatcgagtcaaaccgcgccgtccggtacatagactctgatgagtacaaggtttcccagggaaagcgtgccattgagcttc

SEQ ID NO: 41871 - DNA, 411 bp, Zea mays
  unsure at all n locations
  Clone ID: LIB3062-004-Q1-K1-A10
cggcgacctcatgctcgccggagacgtgccctgngatatgttcatctcttcgtgcaagaggctcaggataatgaagggctctgcctctgaggccaggtgatcgctgatccatacataaacagaggctacagacacgccacctgggaacgcggatccaagagcacacacggatcgtacttgacgaggaaggagggaggagcagtgtggcttgagctctccagtgttgtacaaagacatgtttctttctgaacccaaaagggagaaagatgtatgaagcgtgtatataagatcttagctagcagtttgttttcatttgtatgagcgatcgaaggctgtaaaaaatgaaaaagaaaaaagaaaagggaatgagaaattgactaaagctggtcattnttcctctcanaaaanaaa

SEQ ID NO: 41872 - DNA, 432 bp, Zea mays
  unsure at all n locations
  Clone ID: LIB3062-003-Q1-K1-G7
ccgtttcttgttttttcctctttctccttcctcctccttcctctcgctcgctcccctgccttccccgctccctctcctcctcctcctcctcctccctttcattccatggtctcctggcggcgcagcgcgtcctggctgtcgtcggcgtcgcgctcctcgctcggcgccgccgtcggcggggaggccaaggtcacgccggaggcggatccggcggcgcagcaccacgagcccgacgaggagcgctggtcgcgcctgctgccggagctgctcacggagatcatgcgccgcgtggacgccggcgccgagcgctggccgncgcgccgggacgtcgtggtctgcgcctgcgtgtgccgccggtggcgcgacgccgctgtctcggtcgtgcgcccgccgctcgagtgcggcaggatcaccttcccgtcgtcgctcaag

SEQ ID NO: 41873 - DNA, 297 bp, Zea mays
  Clone ID: LIB3062-003-Q1-K1-E9
gaccaacaagcaacatagaaagtggaatacagtagcaacaatagagcaacaatggcggccaagagattttccatccttatgctccttgctctttctgcatgtgttgctaacgcgaccatttttcctcaatactcacaagctcctatagctgcccttcttcccccataccttccatcaatgaccgcttcagtttgtgaaaacccagcccttcaaccctacaggctccaacaagcaatcgcaacaagcaacttacctttatcacccctgttctttcaacaatcgccagccctatctttg

SEQ ID NO: 41874 - DNA, 432 bp, Zea mays
  Clone ID: LIB3062-003-Q1-K1-F1
gctctctgtctcctgctcagagtcgcagttcgctttgttgtactagagcgctgagcagatctttccttgtttcttcattccggtacgaaggggaggggtccaagtgaagagaagagaaggcctgcgagcgatgggcatcgtcgacgtcgtctccgagttctgctccttgccgaggactcgccggcatctcaagaagaggaagcagttccaggtatatataaaccatcttcttctatttctgttcggggtctcttatcccagccagcccaacaactgaactgaacgggactcgccgcagacggtggagatgaaggtgcgcatcgactgcgaagggtgcgagcgcaaggtgaagaaagcggtggagggcatgaaaggcgtgagctccgtggaggtggcgggcaagcagaacaaggtgacggtcacgggctacgt

SEQ ID NO: 41875 - DNA, 413 bp, Zea mays
  Clone ID: LIB3062-003-Q1-K1-F11
gtcgagccgccggccagcccatctcggcgcattcccggagaatccctccggaaaccggtcgatggtgggtcatccaacacacagcacttcgcttctcccgcgtccagacccgcgcgcaggccctaatgcggttagggctgtaacgatctcgtttggctaccggcggccggttgcggaacgggccacccaacgcgctcctttgagttcgttcgactaatctaccgttgactgaacttggggctgccgccaccagaaagccctaacaagtcctttgcctcctaactccgtcaggctcgtggccccagggtttggtccctaacttttaaccttcaattttggccttgattggcaccacctctggaggttccactggatgattggattaagaccaaacctggaaggggaccaggaag

SEQ ID NO: 41876 - DNA, 152 bp, Zea mays
  Clone ID: LIB3062-003-Q1-K1-F12
ccaactagcaacatagaaagcacaatagtgtaccaacaatggcagccaaaatattttgcctcctgatgctccttggtctttctgcaagtgctgctacggcgaccattttcccgcaatgctcgcaagctcctatagcttcccttcttcccccg

SEQ ID NO: 41877 - DNA, 428 bp, Zea mays
  Clone ID: LIB3062-003-Q1-K1-F2
ccttcaccgaggcgggggaaagcgccgcccagatcgccgtaggcaagcggcgatcactgcagctttgagcataagtttctgcagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgctttgtgatcgatagagaagagtgcttctcgcataacgtggagtatgagggggatactgtccatgtatacttcgtcgtcatcaaggctgacaccccgtggcattacagcgaagaaagcgttgatcttgtggttaaggatcctaatggcgctcaagtccgtgattctcgagataagactagtgataaagttgagttcatagttcagaagag

SEQ ID NO: 41878 - DNA, 437 bp, Zea mays
  Clone ID: LIB3062-003-Q1-K1-F3
cttaggaaaggactgtggcatgagtttcccaacggcacatgtagaggaaagctggcagatggctgagttctataataacaaggttcttgtggagtacagaaacaaagaccctgatcatgttgaatgggctaaagcattgaaggatctatatatgcctggtttgcgggattatgttaaaaagcactaccctcttggtcctgtctggggtcctgctggaggcgctgttgtttctcaaccaaaggctgctgctcctacacctaaagctccagcggttaaggctccccctccaccagctcctcctgcagcgcctctgtttagcacagagaagtctccaaaatcttcaaagcctaaagaaaggatgtctgctgtcttccaagagattagttcaaaacctgtgacttgcaggttgcgaaaggttaccgatgacatgaagtcta

SEQ ID NO: 41879 - DNA, 441 bp, Zea mays
  Clone ID: LIB3062-003-Q1-K1-F5
gtcacaatgacctcggttggctatggggatcttttcccaaacagtgacacaacaaagctgcttgcttgcgcttttgtattcacaggaatggcgatcattgctctcttcatcagtaaagcggcagattaccttgttgagaaacaggaggtgttgttcttcaaagcactgcacatgaatatgaagggcagcgaggccaaaatgctaggagcaatggaaacaaataggataaagtacaaattctacactgtcgctctgcttcttgcaatggttattgttgctgggactgtatttctgtggaaggttgagaagctcagccttgttgattccttctactgtgtctgtgccacgatcactaccctgggttatggggataaaagcttctcgtccaaacttgggcgtgtttttgcagtgttttggataaccacaagtactctcatcatg

SEQ ID NO: 41880 - DNA, 437 bp, Zea mays
  Clone ID: LIB3062-003-Q1-K1-F6
ctcggcagtcggcacgaggacgcgcgatcccgtcaccgctcacctccttctccaaacgctgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgaatcagaaactgacagcgaagaatcagatgtgagtggttctgatggggaagatacttcgtggatttcatgggtctgtagcttaaagggcaatgaatttttct

SEQ ID NO: 41881 - DNA, 412 bp, Zea mays
  unsure at all n locations
  Clone ID: LIB3062-003-Q1-K1-F7
cccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgccgtcgtcgccctccggcgccgccatcccggtggtggacctctcggtgacgcggcgcgaggacctagtcgagcaagtgaggcacgcggccgggacggtgggcttcttctggctggtgaaccacggcgtggcggaggaactgatgggcggcatgctccgcggngtgcgccagttcaacga

SEQ ID NO: 41882 - DNA, 224 bp, Zea mays
  Clone ID: LIB3062-003-Q1-K1-F9
cccaaggacaaccatatctccttccagtgcgagagcatggtggcggtggagcggcggctgaaggagatcggcatcccgtacgtgcagcgctgcgtggaggagggcggcatcaacgtggaccagatcttcttacacgaacccgacggcttcatgatcgagatctgcaactgcgacaaccttcccgtcgtcccgctcgccggcgaccagcaacgcgcgccggccgt

SEQ ID NO: 41883 - DNA, 425 bp, Zea mays
  unsure at all n locations
  Clone ID: LIB3062-003-Q1-K1-G1
cgcagagataggcgtcttcgtactcgcctacctccgcggctcaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgncagctcttccaccctgagcagctcatcagtgggaaggaggatgcagccaacaactttgcccgtggtcactacacc

SEQ ID NO: 41884 - DNA, 229 bp, Zea mays
  Clone ID: LIB3062-003-Q1-K1-G10
gagaccaactagcaacatagaaagcacaatagtgtaccaacaatggcagccaaaatattgtgctgccttatgctccttggtctttctgcaagtgctgctaccgcaaccattttcccacaatgctcacaagctcctatagcttcctttcttcccccatacctttaaccagcggggtcttcagtatgtgaaaacccaattcttcaaccctacaggatccaacaggcaatcg

SEQ ID NO: 41885 - DNA, 366 bp, Zea mays
  Clone ID: LIB3062-003-Q1-K1-G11
ctagcaccatagaatgcacactagtgtaccaacaatggcagcccagtagggcgcctacttatgctccttggtccttctgcaagtactgctacggcgaccattttcccgcactgcttgcatgctcctataccttcccttctttcaccgtacctgtcaccagcgtggtctaccgaatgtgaaaacccatttcttaacccctacaggatccaacaggcaatcacacctggcatattacctttattacccttgttcctacaccaatcataagccctattacatcagctacctttggcgcatatattgacacaaaacatcaggccacaacatctactacaactcgtgctagcaaaccttgatgactactct

SEQ ID NO: 41886 - DNA, 140 bp, Zea mays
  Clone ID: LIB3062-003-Q1-K1-G2
tccgagattcgttttgtggaacttatctcatttgagaggtaaatgtattgtttctcgcttgtctggcatttctttgcaagggaactgtaagatgaagaaatattgatttgaattactgtttatcaaaacccattatcagc

SEQ ID NO: 41887 - DNA, 371 bp, Zea mays
  unsure at all n locations
  Clone ID: LIB3062-003-Q1-K1-G3
ggccaaaccaaatcatgactgacaactgaccgggagtacgacatcggcgacgagatcgggcggggcgtttcggcgtggtccggcgctgtgtctccggccacgggtgacgccttcgccgtgaagtccgtggaccggtccctcctcggcgacgacctggaccgcgcgctggcggagctggagccgaagctggcgcggctcgcggggggcgagggcgacgggaacccgggcgtcttgcaggtgcgcgccgtctacgaggacgacgcctggacgcacacggtcatggacctctgcacggngcccgacctgctggactggatccgnctccggcgcggcgcgcccgtgcccgagcccgacgccgcgcgcgtcgtcgc

SEQ ID NO: 41888 - DNA, 348 bp, Zea mays
  Clone ID: LIB3062-003-Q1-K1-G4
cggacgcgtgggcgggagaagaggataagaggaagcgagtgggactgtgagtgagttggaaggaggggggtggcaatggcgttgcggaatggtggtggtggtggtggagcctgtcccgcggcggttgtgctggtggctgcggccgtcgcggcgctgctgggcgccggggtggcggcggcgaccaagttcgacgacgtggtgcagcccagctgggccaacgaccacgtggtgtacgacggcgacctcctcaagctccgcctcgactccagctccggcggagggttcgtgtcaaggaccaagttcctgtacggcaaggccagcgccgacctcaagctcgtgcccggggac

SEQ ID NO: 41889 - DNA, 444 bp, Zea mays
  Clone ID: LIB3062-003-Q1-K1-E7
gccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctac

SEQ ID NO: 41890 - DNA, 421 bp, Zea mays
  Clone ID: LIB3062-003-Q1-K1-G6
gtcacacacacacacacagacaagtggtttccaaagccaagtgtgtgtactagcaaccggctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaag

SEQ ID NO: 41891 - DNA, 447 bp, Zea mays
  Clone ID: LIB3062-003-Q1-K1-D12
caaatctgcaacatcaattatctaactccaataaccatgaagctggtgcttgtggttctggctggcattgctttagtatcaagtgtttcttgtacacagacaggcggctgcagctgtggtcaacaacaaagccatgagcagcaacatcatccacaacaacatcatccacaaaaacaacaacatcaaccaccaccacaacatcaccagcagcagcaacaccaacaacaacaagttcacatgcaaccacaaaaacatcagcagcaacaagaagttcatgttcaacaacgacaacaacaaccgcagcaccaccaccaacaaccacaactacagcaccaaccacaacatcaatgtgaaggccaacaacaacatcaccaaccatcacaaggccatgtgcaacaacaccaacagagcccttaaccacaccaaggacagagccctgagcaacaa

SEQ ID NO: 41892 - DNA, 440 bp, Zea mays
  Clone ID: LIB3062-003-Q1-K1-D2
ccctttcccgtttcccccgttcagttcagcttcggttggctcgccgtactcgggttgttcctcgcctcgcttcgcttccttcctccgcagtcctcgtctcgaattcgctcgcggtgggagaaatcggggcgcgaggatgaccgtgatcgacatcctcacccgggtggacgcgatctgccagaagtacgacaagtacgacgtcgacaagctcaacggcgccaacgtcgccggcgacgacccgttcgcccgcctctacgcgtccgtcgacgcggacatcaaccaatgcgtcgataaagcggaaacggcgaagcaagagaagaaccgggccgcggtggtggcgcttaacgccgagatccggcgcaccaaggccaagctcctcgaggaggaccttcccaagctgcagcgcctcgccgttaagaaggtgaaagggctgacaagag

SEQ ID NO: 41893 - DNA, 448 bp, Zea mays
  Clone ID: LIB3062-003-Q1-K1-D3
ggaccatactgtttctattccttggtgccctttaaggtctcatgaggttccactctctaacgggctctgcaagaaaaactcaactaatggcatggtttctgctgttacctcgatgctcttatcactcggagaggaccccctcaggaaagagcttttaggcactcctcagcgttatgtgcagtggctgatgaagttcaaagcatgtaatctactagacgtgaagctgaatggttttacacttagtaatgttagcttatatgagaggacaggtggaggcacaactgatcatggagcaatccgatcggagctgcacttgccattttgtgctcaatgtgaacaccatcttctgcccttctacggagtagttcacaatgggtactttggcaatgggagcggagaaggcattgatcggtcgcattttcaggccgtggttcatttctacgggtgc

SEQ ID NO: 41894 - DNA, 320 bp, Zea mays
  Clone ID: LIB3062-003-Q1-K1-D4
gaccgcgcgtacgccaagaaggggtacacaggttgcatttgtacatttaaactcttattatgcaagaaattgtcccgtgcccaaaaaggattcttcagcacgtggagcttcgaagttaccaaaagaatatgcagaaccatgggactatagccatgattatcctgttactctcccactaaggaagccctactctggaaatcctgaaattctggatgaggaagaatttggagaatcttctgccagcaagacccaagatgatgaattatcttcagcagaacaacttggaataatggattattgcctcgaatcacaagtccttt

SEQ ID NO: 41895 - DNA, 202 bp, Zea mays
  Clone ID: LIB3062-003-Q1-K1-D6
gcaagaagtggtacacaggttgcatttggacaaggaaactcttattatgcaagaaattttcccatgcccaaaaaggattcttcagcaggtggagcttcgaagttaccaaaagaatatgcagaaccatgggactatagccatgattatcctgttactctcccactaaagaagccctactctggaaatcctgaaattctggatg

SEQ ID NO: 41896 - DNA, 305 bp, Zea mays
  Clone ID: LIB3062-003-Q1-K1-D7
ctctaccgttcgtgaaccaagcggcggcggatggtcatctcacatccttcctgaataggcgtgcaccgttctggatcgctacaatatcgcgtgtgccgctgccgactcacaagatgacggactaaactgcttaagcggctcaccgaggccggcaaatacctatgctgcatggtgactcaagttactcatgatgcacattcaaggcttatccactggtgccgtcaggcgcctggctgctgggatgcataatgatgcctaatattgcgagaccgtctgtcaagatgacgactcactattttctggac

SEQ ID NO: 41897 - DNA, 165 bp, Zea mays
  Clone ID: LIB3062-003-Q1-K1-D9
gtgttcctgtaaagcctaaaaaggaaaataggcttttggttctgccttttgaattatctgttatgggtattttattgctcatcgtattaggtggtttctatgtggtccattgtgtatgggcggcagctgaagcgtactccgggccttcatttgtgttgacatctc

SEQ ID NO: 41898 - DNA, 392 bp, Zea mays
  Clone ID: LIB3062-003-Q1-K1-E1
acgcggacgcgtgggctgagaacagcagtgtctcaactgaagcagagaactcccgaggagaggcttccattgcagtgaatggttcttcataaacgtctaccaatggtgagcaggtggatcccaagactgaaactagcacatccaccactaacgtgcacactgaatctcaaggggctgatggcagttctggatcaaataactcaattggtaacggacctgaacaaaccggtgaaactgacaggcagtgataccactatctagacacgaacattgttttagtataaagattcgtgttctggagattgcagaggctagtactgcaccaagataaactgttgacattgtggcttatggtgattctaagcgatactgctgaagtacaattgtgcaca

SEQ ID NO: 41899 - DNA, 357 bp, Zea mays
  Clone ID: LIB3062-003-Q1-K1-E10
ctggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccaatgcgtccagttcctgaagcaccagtgcagcccggcggcgacgcccta

SEQ ID NO: 41900 - DNA, 440 bp, Zea mays
  Clone ID: LIB3062-003-Q1-K1-E11
gcaaccatactccttggtgctggtgcaactgtttgtcttcaggttgttgcagaacggagacgaggtactttggaagagttcctagagcagccttctatagatgctactactttactcctgagcatatttattccaaattggatttcagaattccggggcaaatttaagttggctatttgaaacttacagagcagcgcctggtcctcttggcaatgctgtttcttatgtaaatggtgttttcctgggacatgctcctttggatgaacattcagatactctggaattgagtaatctgcggttggcttttggtgcatatggaacagagcatgctattagagcaacgagggtggaggaattccttactggtaaatcactcactgcatcagtggtacttgtggcaattaaattactaagagaaacggttgtaccaatggagggaa

SEQ ID NO: 41901 - DNA, 381 bp, Zea mays
  Clone ID: LIB3062-003-Q1-K1-E12
cccacgcgtccgcttgccctttttgtgagcgcaacaaatgcgttcattattccacaatgctcactggctcctagtgccattattccacagttcctccctccagttacttcaatgggcttcgaacacccagctgtgcaagcctacaggctacaacaagcgcttgcggcgagcgtcttacaacaaccaattgcccaatttcaacaacaatccttggcacatctaaccatacaaaccatcgcaacgcaacagcaacaacaatttctaccagcactgagccaactagctgtggtgaaccctgtcgcctacttgcaacagcagtttcttgcattcaacccaatttggctctggcaaacattgttgcattccaacaaccaccaccat

SEQ ID NO: 41902 - DNA, 437 bp, Zea mays
  unsure at all n locations
  Clone ID: LIB3062-003-Q1-K1-E2
gcccaatttgcagataataggatgtctctatcttggaaccaggaagagaaagataaccgcaacttgcatcaaagaaacttggaaagggctcatagcctttcagatggtgatactaactatgaagatcacatctcttctgtgaatagtggatgccattcagacaatgaggtcaataatagaggacatacttcaaatgatgttgagcacatcgaaacatgctctagtttggataaacaagccagcgaccaaataggaaaacctgcaaaggaatattctgattcttcaaacatgtcatctctaaatgcattcgaggatccaacaggaattcctcctgagtggatgccaacaaatgttagtgtgcctttattgaacctggttgacaaagtattccagctaaagcgacggggttggatacggagacaggnttcttggatatc

SEQ ID NO: 41903 - DNA, 375 bp, Zea mays
  Clone ID: LIB3062-003-Q1-K1-E3
cggacgcgtgggtccacggccgcgcctgcgacacccatccgccgccacgccatggccaagtacaacgtggtgcagaagaacaagcgccagtgcaatcaggaccgcaagcgcgccgtgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatgatctcagttgaagggtcttcagaagctgcaaagggcaagtcccaagtgaagttcagtgtgaagaaaaactcaagaatacagataaagagattaaagggcaaa

SEQ ID NO: 41904 - DNA, 418 bp, Zea mays
  Clone ID: LIB3062-003-Q1-K1-E4
agcacaagtttcgtcttgaagagagccgccaccaccaatggcttgttacaacactgcgtctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcggtcggcgatcaccgacttcgtgtcgtcgctgacggcggcggcgcagccggagccgtccgtggccacgtggttcaagacggcgcgcaggtactacaccatctccaaggtgccgttcccggcgctgcgcctcggctcccacgccgtcgaccggaactgctccctcggcaggcgcctgacggag

SEQ ID NO: 41905 - DNA, 319 bp, Zea mays
  Clone ID: LIB3062-003-Q1-K1-E5
gcgacttctaccaggacacagagatgacctggggcaatggccgcggcagggtatgggccgggggcgccggcttgaacttacccttgaaccgaacttccggttccggtttcaatccaagagccagtacctggtcggcaagatcgacatgcagatcaagcttgtgccaggcaacttcgtggcacggtcaccaacttctacctgtcgttccaaggcgacacgcacgacgagatcgacttcgaggtcctgggcaacgtgagcggggagccctacacgctgtacaccaacgtgtttacacgcggacagaggcagcgggagcagc

SEQ ID NO: 41906 - DNA, 402 bp, Zea mays
  Clone ID: LIB3062-003-Q1-K1-E6
cagacgacatggagatataatccagaggacagtaggcgggtactatattgtacagggaagggcggatgacaccatgaacctcggtggaattaagaccagttcagtagagatagaacgggtgtgcaacagagctgacgagtgtctgctagaaacagcagcagttagcatcaaaccttccggtgggggaccagaacatctagccatcttggcggtgctaaaagatagatcggcccagtacgacgtgaatcttctcaagaggaagttccagactgccattcagaagaacctcaatcctctcttcaaggtgagctatgtcaaagtcgtcgctgagttcccgagaacggcttcgaacaagctgctgaaaagggttctggaggatcagctcgcgcaggaactcttaaa

SEQ ID NO: 41907 - DNA, 399 bp, Zea mays
  unsure at all n locations
  Clone ID: LIB3062-003-Q1-K1-D10
cccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaagagtcgtgcgtccgncggtgcgcggagaaattcctgaagcactccatgagggtcggcatgaagttcgccgagcttaaccagggtgtggccacgccggactaagaaacacgc

SEQ ID NO: 41908 - DNA, 427 bp, Zea mays
  Clone ID: LIB3062-020-Q1-K1-E8
gaacaagtgaatatcctggcttggttatggctagtgcggcctattctacacagacaatggtaagggtttcattgtggcacaagagagtcttaaatacatttcaacattttccattgtttcagcacccagttgttggtagggcaggttcatgtattaaacccaaaggcaccaggcttgagcgaggtattcgtgacctccagaagattgctgcagaatgcaaatcagggaaagatccaagaacatgagctaatgaatcgcctcatgagcatagttggacaccttgttcagcgcaggacactatagcttgcagagttatggcctaaaggttacatggatagtgttggaatcaaagatgccatttatagatgaagggagcgaagaatattatactacagccagcaaaatgttcgcagcgaagagagaatga

SEQ ID NO: 41909 - DNA, 426 bp, Zea mays
  Clone ID: LIB3062-020-Q1-K1-E9
ctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatgatgttgctgcaattttaacttctatccagtccctgctgagtgatccaaacccaaactcccctgcaaactcagaagcagcaagactgttcagcgagaacaagcggtagtacaaccgcaaagtccgtgagatcgtggagcatagctggacagccgactagtgcataaggatgctcgtcgtgcccgataggggcacaataagaaagcgtgaaaaaaaacacacgcactcctt

SEQ ID NO: 41910 - DNA, 55 bp, Zea mays
  Clone ID: LIB3062-020-Q1-K1-F1
aatagaatcttgatagagcatctattatccaccgttagctgctgcaactgtttcg

SEQ ID NO: 41911 - DNA, 301 bp, Zea mays
  Clone ID: LIB3062-020-Q1-K1-F10
gtcgggccttctgtcacatcaatagaagctcttctctagtcagtccctgaaacgagctacggggcgctgtcatacacgccccggggcgagatctgcttgatgggtcataccatgttctccgagtactacaagcgccctaccctaactgaagaagtgttttgagatatctggcttcatacaggtgatctccgggagtggcaatccaatggcacgatgaagatcatggactgatagactaacatcttcaagctgtcccagggagagtatgtcgcaggtgacgtactggcatgagcataccttc

SEQ ID NO: 41912 - DNA, 460 bp, Zea mays
  Clone ID: LIB3062-020-Q1-K1-F11
ggtaaatctgagggaggtccatctgggcgacattggatattagacccattagatggcactgagggtttcataaggggagatcagtatgcagttgcacttgaactacttgatgagggcaaggtgttctgggtgtgttgggatgtccaaatcttccattaaaatcaacatacaagaacaatagcagctcttttggggatcgaataggttccctcttttttgctacaattggttgtggagcgcaagttgaggccttagaaggatctgagccacaaaagattagtgtttgctccaccaataatccagttgacgcctcattctttgaatcctttgaagcatcacactccaagcgtgatttaactagctccattgcagagaaacttggtgtccgagctcctcctgttagaatggatagccaagcaaaatatggtgccctagcacgtggtgatggtgccatttttct

SEQ ID NO: 41913 - DNA, 313 bp, Zea mays
  Clone ID: LIB3062-020-Q1-K1-F12
gagagatcatactgctcgagaggaaaggctactataggtgtgatgccccttttatcagatcgtccaaaccggtggtcctgtgtgcgatcccagatggcaggcagcaggcctcgcttagctaggcatggtgaccaccttttgggcacatggaattcctgagttggcgatgagtattgttgcattgtacattttaatattgtactgtgattaggctttactcgcggtggatgtctttcaccgctagatggccagaggcatatcctgccaaccaagcagagcagccattttgattttggtctatgatacttttacc

SEQ ID NO: 41914 - DNA, 374 bp, Zea mays
  Clone ID: LIB3062-020-Q1-K1-F3
acccacgcgtccgagcggttgcaggatcgaccctccatcatctgcgtgttcttgcacctaatctgccacatgcacgtgtatgtgagcgagttgagggtgggcaagcacagcctgccactgtacgagctgcccacccacgccacccgttgctactacctgggcatgttcctcagaggcgcctaccacgatgccctcagccggctgcacaacctattcggactgcccagcatggtgcgcgtttcccagtgcgactgaccccactgcttttccgtgacgctcgccgacaaaatcccgtcctgcgccaacatgctccaagcgattcagtacgagcccctggtcatgtactacgttctaaaacactatacctactgaaa

SEQ ID NO: 41915 - DNA, 434 bp, Zea mays
  Clone ID: LIB3062-020-Q1-K1-F4
actcttcctccccttctctccggctcccccgaggcccccgacagcgaactcgggactggccaaccgagaaggaagaactagtcgcgaggtgaagaggagaacctgaggtggtcccgaatcagagacggaagaaggtgggttcaggagcaagccagcctgccgccgccatgaggcgcacctcgaagaaatcgtcgtcgtctacggcgaccgccagcgctggccctactaaagcagtttccaaggaagtagaacggattgatcaatttttctatacttacgctgataactcatctggcatgattgacccagaaggcattgaaacactctgttctcaccttgaagttccccacactgatgttaggattctaatgttagcatggaaaatgggctgtgataagcaaggttattttaccttggatgaatggagaactggc

SEQ ID NO: 41916 - DNA, 443 bp, Zea mays
  unsure at all n locations
  Clone ID: LIB3062-020-Q1-K1-F5
cgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgncgcgctgcccagcaagtgcggcgtcgccctgccgtacaagatcagcaccaacgttaact

SEQ ID NO: 41917 - DNA, 269 bp, Zea mays
  Clone ID: LIB3062-020-Q1-K1-F6
tcgcggacgcgtgggtttttttttttcatgaaggaagctagaagctcgcgctttgtgccgtgagcgcgtcgaactagactagatgtttacaagactatgtcacacggtggaacataacgcacggtcgatcgggccgtcaggagacgaggaccactgcatccgacttgatgctcaactagtggaaatagcagatgattacggtgaccagctgttctggacatacttgagctttgtgcaaggtggtattgccgcaagagaacttcctctat

SEQ ID NO: 41918 - DNA, 459 bp, Zea mays
  Clone ID: LIB3062-020-Q1-K1-F9
gtcggccctcctgtcacaacaatagaagcacggctggagtcggtccctgaaatgggctacgacgcactgtcagacacgccccggggcgagatctgcttgaggggccacaccatgttctccgggtactacaagcgccctagcctcactgaagaagtgttctcagatggctggttccatacaggtgatatcggggagtggcaatccaatggcacgatgaagatcatcgacagaaagaagaacatcttcaagctgtcccagggggagtatgtggcagttgaggtcctggaaagagcatacctgcagtcaccccttgtggcatcggtctgggtctacgggaacagcttcgagtcgttcctcgttgccgtggctgtccctgagaggcaggctctcgaggaatgggcagcagccaacagcaaggccggcgactttgcagagctgtgcgctgatcccaagcgagga

SEQ ID NO: 41919 - DNA, 402 bp, Zea mays
  unsure at all n locations
  Clone ID: LIB3062-020-Q1-K1-G1
tccctcggtcccttctcgtcgttctcccgtgtccgccgtgcactgtctgtctctggtggcggcgactgggcggccttcgccgctgccctacgccaggatcccaggctgcatcttccgtacgccaggagggcctcgccgcaggttgggtgggaggcagagatgagccgggggcggtcgccggagccgctggatttcttcatctggactgtgcaagatgtanggttatggttggaggaaataaatcttggaagctaccgccaggcttttgaagaaaatggtgtcaatggagagtatctagaaagcctgtcggtgttcaccactgagcagattctccgctttataagacgatgccatatgaaatggggagattttatcaccctctgtaaagagttgagacgcatc

SEQ ID NO: 41920 - DNA, 386 bp, Zea mays
  Clone ID: LIB3062-020-Q1-K1-G10
ccgtcttgtattttaaattttattatgtgaacagtataaaggagtggagacggtgtacatgctctgtgtcaggtgccatgcgagggtgaaatgggatatgcaagcctacatgggctctaattgttctttccttcttttttcaattacatcggttcgattcaatctgagtacctagaaatgaatttgcgaaactgatgagccatcatgtggtttttcctacctgtcgtgacatggtctctacagaatcagacattcctatttacagtacatgtacttactgatcgactctgattcagatgcttgatatttttaacgctgacaaaatttaccaggtctcgtgaatccttctaagctcctggctagcattgacgaacagatagcgaaag

SEQ ID NO: 41921 - DNA, 179 bp, Zea mays
  Clone ID: LIB3062-020-Q1-K1-G12
attctaaatttgatactgtgattagtttaagggaatgaaacactctcatggtggtttcaaatgccatgcgggggtgaaatgcaatatccaagcctacatggtctctaatagtcctatccttcatttctaaatcacatacaggcaagtcaatctgattacctagcaatgaatttccaaaa

SEQ ID NO: 41922 - DNA, 435 bp, Zea mays
  Clone ID: LIB3062-020-Q1-K1-G2
cagccagtcagcctccttttccaaccctatattccaaccctcctatatccacatcgtgtgtgtttgattggatttgatgcgatttgttgcgcttcgtcatctggtcgttgggaggattggttctgccaatcggttcccaacggactcgttcccttgaagctacataattccgttgtatcctgggccggctctttatcgtgtgccttcaattattccccatgaacaggggcaccgcgcggctcttacatacatggctctgttagaatgttgttttgtgctattgtttattcttgtctttcacatgatggctgtttagattttgaaatgatgcttgtgataacagtgacgaatccttacatagttacagatctgtgagattgttgcaagaagatcgcatcattcaaagcacatctaagctgacctgtcttcatttca

SEQ ID NO: 41923 - DNA, 430 bp, Zea mays
  Clone ID: LIB3062-020-Q1-K1-E7
caagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaggaggagcggtaccgcatcagcccccgtgtcctacctcctggtggacggcatccctcacgaggaccacatgaaccacaccgctctggtgctcacctgcacctcgacgcgctacatcgaggcggggatagggct

SEQ ID NO: 41924 - DNA, 424 bp, Zea mays
  Clone ID: LIB3062-020-Q1-K1-C6
gaaataaagtagctatcatagctatttcagtagtggttcctgtgttagtactaattgtgctacttcttacatatttcatctggtggcagaaaagaaagcctattgtgcaaccagtacccacacatggctcaacaagagatccagaacctgataatgcttcaggaataaaaaaaagttatggctacaacctgaatataactgagaatcggcagttcacatacaaagagctggagaagttcactaataatttcaagaagttcataggacaaggaggttttgggcccgtctactatggccgtttggaagatgacactgaggttgctgtcaagatgcgttctgaatcatcgtcacatgggcttgatgaatttttagctgaggttcagagcttgacaaaggtgcatcacaggaatctagtgtctatgat

SEQ ID NO: 41925 - DNA, 456 bp, Zea mays
  Clone ID: LIB3062-020-Q1-K1-C7
atttccggctagactttagcagcaatcgaaaatgtgtatgcggtgatagaaagataagatgagcctgacagatatgtgatcatgggcaggcatcgtgatgcttggacatttggagcacttgatcctaacagtggaacagcagccatgcttgagatcgcggcgaggctgtccaagctacaagcgaaagggtggaggcctagaagaacaataatcctatgcagttgggacgcagaagagtttgccctgatagggtctactgaatgggccgaggagaacatggacactctagcttcaagagctatagcttacctgaacgtggacatatcactgtttggtcctgggggtcttatgccccgtgcgacccctcaacttgatgaattgatcaaagaagcaagtaaaatggtaccagatcctgatgaaccatctcaaaccttgtatgacaccatgatgcgccat

SEQ ID NO: 41926 - DNA, 427 bp, Zea mays
  Clone ID: LIB3062-020-Q1-K1-C8
gccagtgagccagaaagaagaagaggccattcgaagctgccacgcacgccacgcggaagccattcgagtccacgaggacgaggagcagcagcagaagaaaagggcaaggaacatcctccgggggccgccgccatggccggttgctgcgtgttcctccggtggccgtcggcctggccgtcgcgcatgggttacggttccttcgtcaacccggcggccgacaacgccgcccggccgtcaacggtaacggccgtggccggaaaggaccgccggccgttcgcggtgaaccgcctggcgctgaactctaaccggttccggttgttcttggacacggcggcgcacagggaggaccgcagggccgggggcggcgccggcgccatcttcgtggacgtagacgccatccttttagagcacatcctgtggctcgcct

SEQ ID NO: 41927 - DNA, 126 bp, Zea mays
  Clone ID: LIB3062-020-Q1-K1-D1
acggcttctactggaaggaccccaagaacaacctgctgaagttcatcgggattggagcgtgaggcgatggactgacgactgtacacgagtacggatattgcttaggagtctatttggacagacata

SEQ ID NO: 41928 - DNA, 399 bp, Zea mays
  Clone ID: LIB3062-020-Q1-K1-D11
gaccacgcgtacgctaggacaccccatattctggccggacgattctccgcgagacggcggcacgctcaagctggccgttcaactaacacaggaggacccagacaagccaccaactgatcgacgaccatctaacacgcatgatacaattatctattcttatgcaagcaacaggctgcataacctacagaaccagtgcagctctataaataagaccgctggactttgaacacttatccatgcactaccatattcaccaaacccaaacctaccagcgaccacgaccgctacaagacagtcatacgtgcacatacaggatcaccagccaagcgctctacctatccctgatcagcgacccacacccgacgactacataccgcagctcagccttcaagacaggca

SEQ ID NO: 41929 - DNA, 406 bp, Zea mays
  Clone ID: LIB3062-020-Q1-K1-D12
ccagggtacgccttcgaggaactgaacccggttcagtggcggtgcagcggcacgcccaggggcctgataccagtggccaacggcagcgaggagatggaggtgctcgtgaccgtcgacgtgctgcgccgggccaaggcggacgtcgtggtggcgtcggccgaggaggtcgtcgtcgcgcgccacggcaccaggatcgtcgccgacgcgcggctgcaggacgccgtcggccagcagttcgacctcatcgtcgtaccgggtggcatgccgggcgtgaagacgacgctggcagacaaggtggagctcatggcgctgctgaaggagcaggcggcggcgggcaaggcgtacggcgccatctgcgccgtcacggcgcatgtgctggagccgcacggtctcatccggggcagca

SEQ ID NO: 41930 - DNA, 275 bp, Zea mays
  Clone ID: LIB3062-020-Q1-K1-D3
cttggttgtatccaagtactatgcaagggttaccctcaagaggcttgccgatcttctttgcctgactttgcaggaggcagagaagcatctctcagacatggttaactcgaaatctctagtggcaaagatcgacaggccgatgggagttgtcagcttccggacgacccataacagcaatggcacactgaactcatgggccacgagccttgagaagcttctggacctcgttgagaagagctgccacgagatacataaagagaccatgatccacaaga

SEQ ID NO: 41931 - DNA, 422 bp, Zea mays
  Clone ID: LIB3062-020-Q1-K1-D5
ccgggcttggtcggtcgaagtactatgcatgggttaccctcaagaggctttccaatcttctttgcctgactttgcaggaggcaggtaagcatctctcagacgtggttaactcgaaatctctagtggcaaagatcgacaggccgatgggacttgtcagcttacggacgacccaaaacagcaatggcacactgaactcatgggccacgagccttgagaagcttctggacctcgttgagaagagctgccacgagatacataaagagaccatgatccacaagacggcgttaaaagtttaactcttttggcttaggttttgaaacccgtgctgggcatgaattaccgtaacaggaaggtttttttgttgttgataggcacggccagtttccccgcaaatttgctttgactcgctgaatgtttttcgg

SEQ ID NO: 41932 - DNA, 209 bp, Zea mays
  Clone ID: LIB3062-020-Q1-K1-D6
acagtcatcaactaacgaacgaactcttgctcgatcacgagctagctgaggtcgcgatgcggtggctgaacagcagaagacgccgagcggggtggcggctggtggcggggcgctgctggcttgccgttcggcggatcacctgcgcaggtggggtcgcgctggcgccggctcctgacgcgacggaggggcgagcgctccctgtcgagctg

SEQ ID NO: 41933 - DNA, 439 bp, Zea mays
  Clone ID: LIB3062-020-Q1-K1-D7
cgggctcttctattactattgggggcttaccctcaatctctacccttggatttgcgcttgggctcgtctggccgcagactagtatccgcaccagagaggagacacctacgactccgacctgctcttgcatatagattgggcagagagtgacagagccccccccccctaaagggtcgccaaaaggaaatttttttttaaatccagctcttaagcctaacggtctttgatcccggagagcagccgccagcccaactaatccttgctgctggcgcgccggggctccgattgcgctccagatctgaggcacctgctcggtggattccaggaatccgagcaccaactagacaggagagttctcagggtaaaggaagaggctgagagcgcgttggagatttggactataagagcgagcgagcgagctgggtgccttgctgccttg

SEQ ID NO: 41934 - DNA, 428 bp, Zea mays
  Clone ID: LIB3062-020-Q1-K1-D8
gatgaatttgcctggagtttaccttcggtgggctcaggtttagatgaacctgagtggtgcaaactgaagtatattggtgggactgacatcagcttcttgaaggaagacccatccacagcatgtgccgcggtggtagtcctcaatgtcgatactttagaagttgtccatgaagagttcaatgttgtccgactgcaagtgccatatattcctggttttcttgcattcagagaggctccagttcttcttggactcttggaaaaggtgaagatcaatgcacctcatttctgccctcagttgctcatggttgatggaaatggattgctccatccgcgaggttttggtttagcttgtcatctcggcgttcttgcagacattcctactgttggagttggaaaaaatctacatcacgtagatggccttaaccaatc

SEQ ID NO: 41935 - DNA, 296 bp, Zea mays
  Clone ID: LIB3062-020-Q1-K1-D9
cgttctagattccctcctttttttttttattttttttttttaaccatttttttttttattttagtaggttttattttacattttaatattttattaacaacttattatctttatctattttctttcaaaaataattcacactctatatttcctaacacaactcatcacaataccattccatactaccattttaacaccactccttatactccttaacaatatcagctcatgaatacaactatatcatactctcacactaaatactaaaatctataacgccgtctactcattcaccc

SEQ ID NO: 41936 - DNA, 334 bp, Zea mays
  Clone ID: LIB3062-020-Q1-K1-E10
ctggggcgccgtcatattcgggccggatgatacgctttggaacggtggcacgtttaatctgagttggcagtttacacaagatgagccgcaacaagccatcaactgttctatttgtccctaggatgtttcatccaaatatatatgctgctggctgcatctgtctggatatcctacagaacgcaatgtagttctatatatgatgtcgctgcaattgtaacttatatccagtgcctgctaagcgatccaaacccactctccgctgcagactcagaatcagcaagagtgttcatcgataacatgctctagtatcaaccgtaaagtccgtgaaatcttt

SEQ ID NO: 41937 - DNA, 276 bp, Zea mays
  Clone ID: LIB3062-020-Q1-K1-E11
catattcctgccgaatgattctctttgaaactctgtcacgttcactcttgctgggttttatacacaatatgaccccaactctccatcacctgctctactagtcactacaatgtactatccacatatatatgctcatacatacatctatccgcatatcctacacatccagtggagtcctatatatgatgttgctacacttctaacttctatccacaccctgctaagcgatccaaacccaaactccacttcaaactcataatcagccagactgttcat

SEQ ID NO: 41938 - DNA, 298 bp, Zea mays
  Clone ID: LIB3062-020-Q1-K1-E2
tattcctaatagcttattctcattcaacccatgtgaaccagaaactgagtagggccaacctcactatagtagccgacactaacatcaaccttctacaacgtccaccctatccaaacatgaccacatccaaaacctcaacatcaatactatcatactctaccatgcagacctaaaactcaccaatatcaaaactcaacctatactaacttataacaataccagatgattaacttcttgattaaactctcacactggatcacaacaattctccaacagacctacctcatcattttatact

SEQ ID NO: 41939 - DNA, 215 bp, Zea mays
  Clone ID: LIB3062-020-Q1-K1-E3
aatgagctcggcatgctaccagcaaattaacaccatgcttacgatacctcagccgatggacttaatactgtactaacattggaactgaccctgcggcagttcatctcacaaccgcttgagcgactcctcgcttcaactgtgatgatcaatgacaatcatagtgcagcagaccatcggaaccatgatacacgacgtacagtacatgctagaagaca

SEQ ID NO: 41940 - DNA, 425 bp, Zea mays
  Clone ID: LIB3062-020-Q1-K1-C5
ggtcgatatcccagtagacagatatccaacatacaattttgttggccgcatgcttggggcaagaggaaattccttgaagcggatggaggcaaatacggattgccgcgtgctaataagaggtcgtggcagcataaaagatccagcacgggaggaaatgatgcgagggaagccaggatatgagcatatgaatgaacctctccatatattggttgaggcagagctacctgttgacatcattgatgctcggctgatgcaagcccgcgagatccttcaagatctgctaaagcctgtggatgaatcccaggacttcttcaagaagcagcagctgcgggagctcgcgatgcttaatggcaccctgcgtgaggaagggatgcagaggttcggttcagcgtaccctttccacaacagccttggaatgaagagag

SEQ ID NO: 41941 - DNA, 426 bp, Zea mays
  unsure at all n locations
  Clone ID: LIB3062-020-Q1-K1-E4
aggaaattntcttgggcgttcttcggcttcattgtcacaggttcgaattcgtcaaccggttatggcaattggccaaggaaggaaaagccaagaaaaaattccaatcttcgggaagacccttaccgggaagaccattacccttgaagtggaaagcaacgacaccgtcgacaacgttaagggccaaattcaagaccagggaaggattcccccagattaaccgaggctggatatcgcttgccaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggatcaaggagcgtgttgaagagaaag

SEQ ID NO: 41942 - DNA, 437 bp, Zea mays
  Clone ID: LIB3062-020-Q1-K1-B11
ccgtgcctcctgctgcagcagcagcagcataaccagagtgcagcaagccgtttcgagagacagctctaggctactgcgagtgctagcagtatggcttccgctgcgcgcttactggtggccgtggtcgtggtgtgcgcactcctggccagcaacaactgccacgcggcacgccgcttggccgacacggccgcggcttccgctgctgctgccgtcgtccctggcctacccgccgtgccgaccttgccaacggtgcagtcagtgccacaggtggcgctgccacccatgccggccgtgcccgcggtcaccgtgccccagatgacgctgccgaccatgccagcggctcccaaggtgaccgtgtcgctgccgccaatgcccgccatcccgtccgtgctgcccaagctgacgctgccaccgatgcccgctgtcgttccatccgt

SEQ ID NO: 41943 - DNA, 429 bp, Zea mays
  Clone ID: LIB3062-020-Q1-K1-B12
tcggatgatttggagcctcgactctcccgaacctgaatatcatctgcctaagacgggatttaagggtatcatgttcctggaattcttcacacgttatggtcggcagtgtttgattattgctcatgaagatcataaagcacacgtattggactttcggttgcgcaaatttgtttctgagaagcgaaaattattatctcgtgaagcttctgtcttcttacgtcctaatgtatcgttactacttacaccttcatctaaaagcacttgccgtttctgggacgctaaaaaattcagtttttatggagtcattgacaattctgctggaggagatgtgctgggtatcgcttgtttgatggggtctaaaacaaagtttgtgattggacaatattatgcattaacaatattgcatcttgataatgcattatatcaaaa

SEQ ID NO: 41944 - DNA, 234 bp, Zea mays
  Clone ID: LIB3062-020-Q1-K1-B2
tgataccaagagtgcctatccatatccactgaactatctataagtacacatatcacaaacaccagaaatgctaaagcatttgcactcttatcttacgaaggcattgccaaaagaattaagaggataacagccctgactgctggatgtgccacccaagctatggaattggcgtcatctatcgattctcatatcaataaaacatctcaattggagggaactttgattgaaaagaaa

SEQ ID NO: 41945 - DNA, 424 bp, Zea mays
  Clone ID: LIB3062-020-Q1-K1-B4
taataatcttctaatgcacatccttgctgatttattaaacagacctgttctcaagccaacgaacatataaaccacaggcctgcaatctgcatatgctgctgggttggctccaagagtttgcaccatagtgaaaggtattgcagatttgaacaaggataacacgaccgtcttaacgccgaaactggatgaaagcgcacatagagaaagatttgctaattcatactacaagcttctgtacaagatcattcaatatccatgaactttatctgtcaatttatactgtcaactctcctctatctggatatggaagctgcaaatgaataaactggtcttcgctgggactaatcttaactgcttgatatttatatataacatcacgatgtttataaaagtgagtacatgaatatcctcagattttcagcac

SEQ ID NO: 41946 - DNA, 418 bp, Zea mays
  Clone ID: LIB3062-020-Q1-K1-B5
ctgttaataatcttctaatgcagatccaggctgatttattaggcagccctgttgtcagaccaggtgacatagagaccacaggcctcggagctgcatatgctgctgggttggctgcaggagtttggaccaaggagaaggattttgcaggtttgcacaaggagaacacgacagtcttccgtccgaaactggatgaggcgcacaggaaaaagagggcggattcatggtacaaggcggattcaagatcattcgatctggctgatctttctctgtaaatttatcctgccagcgctactctatctggttttggaagctgcaaatgaataaatcggtcttcgctgggactaatcttaactgcttgttatgtatatataacatcacgatgtttataaaagtggtacatgaatatccttagattttc

SEQ ID NO: 41947 - DNA, 432 bp, Zea mays
  Clone ID: LIB3062-020-Q1-K1-B6
cgggaggcacccagatccacgctctctccgccgaccacgcaccaactctccatggaagggtgccaaccgcgccgagcccaacctcggctctccatggaagggcgcggtccacgccgaccccgacctcggctctccagggaagggtgcggtccacgccgaccccgacccggccaccacgtggctctacatggaaggcgctcagatccactctctcgatccaaccaccgagcgcgccccaacctagtcgctccatggaagggcgtgactcacgcacgacccagacccgactaccacatcaactgtccacggcgacatggataggcccacaccggttagaaagtcctacacatcaacgctggacctgctcatctacacggagggcgcatagcatgagtcgcaacagccgaccgcatcagacgccggaagctctca

SEQ ID NO: 41948 - DNA, 421 bp, Zea mays
  Clone ID: LIB3062-020-Q1-K1-B8
cgtcgaagcatgatgctgatgggaaagattatagaagtgatttcagacaaaaacagaggacatactcaggtccagtcctgcagtctggtccgaataatagttcgatgactgaaaggggccacattattgaaagggatgcaggagttcaatctgtatctgataaacaaaagaatggtacaagaagagccaataatcttagtggtcctttgtcacttccaactcgtgcttctgcaaatagtctttcaagagccaataatcttagtggccctctgtcacttccaactcgtgcttctgcaaatagtctttctgctcctattcgatcttctgcaggttatgtaggctctttgggtgataaacctaagcgcactatggtggaaattaaaggccgcttctcagtgacatctgagaatgtggaccttgc

SEQ ID NO: 41949 - DNA, 379 bp, Zea mays
  Clone ID: LIB3062-020-Q1-K1-B9
tcggtacctgagaattcatggacagtgcctgaggttccctctacaccaacagcctcggcgctcaggtggcacgggaatttgtgtttccctgcgtatgacagcaccatgttgttcctgagattacctcccttcagaactccgaaagtcacttcaccgtaccttccagtttcaagcgccggataagagagtactgagaggcgacaagaagatcactatacaccactgtccggtctaggctatcttgagaaaggctgcttggtgggctaaatgacgaaagaaaatatccaggactgggtggacattcaaacatcaactgatctatccagtatccaggttataagtgtgttgtaatgcttcaatgcgtatcattgtccaaaga

SEQ ID NO: 41950 - DNA, 318 bp, Zea mays
  Clone ID: LIB3062-020-Q1-K1-C1
cttgtttctggttcttttatgatgattgacgcaacaacaaaaatgcacttcatcgattatggcggctacctcgactgacataatgcctacctttgggtatgcttcttcttttctttaatctttcgcggttctatgtactaatggtcatcttgctaaattcacatgtgcacctttctattggcacctatacttttgtaccatttttctggattaatctactattaaaaatgccaaaatatataacgatccaaaaacgtgataggtttttttcggtagctagctttgttaatatgctggaaccaaatatttttaagaaac

SEQ ID NO: 41951 - DNA, 459 bp, Zea mays
  Clone ID: LIB3062-020-Q1-K1-C11
catgatgtttttgacatgggtcgtacaaaataggcacttcttgtaatggagttctgtgagaagtctttggttagtgcaatggagagcagaggtagtggttactatgaggagaagaaggtgcttttgattttcagagatgtctgcaatgctgcctttgctatgcatggacaatcaccgccaattgcacatagggatctgaaagctgaaaatgttcttcttggttgtgacggtgtatggaaaatatgtgattttggaagcacatcaactaatcacaaatgctttaacaaaccagaagagatgggcattgaggaagatgtcatcaggaagcatacaaccccagcctacaggcccccagagatgtgggatctctacagaagagaagttattagcgaaaaagttgacatttgggcttttgggtgccttctatatggaatatgctacttcaagtctgcatttgat

SEQ ID NO: 41952 - DNA, 450 bp, Zea mays
  Clone ID: LIB3062-020-Q1-K1-C12
cggacgcgtgggcggacgcgtgggcggacgcgtgggctccgcgtttacacccgccgccactgctgctttggcgccgtagctagcaaaggcgatatccatggcgacccctgcacggatcgagctggacaagctgagcgtggagcagctcaaggggctcaaggagcagacggatctggaggtcaacctcctccaggacagcctcaccaagatccgcaccgtcgtcacccgactcgagaacgccttcgtcgcgctccaggacctatccctccgcccccaagggaagaagatgctcgtgccgctcactgcgtccctctacgttcccggttcactggacgacgcggagaaggtcctcgtcgatgtcggcaccggttacttcatcgagaaaaccatggctcatgggaaagaatactgtgaaaggaaaaattaattattgaagtcaaattttgatga

SEQ ID NO: 41953 - DNA, 429 bp, Zea mays
  Clone ID: LIB3062-020-Q1-K1-C2
cgcatcgatgaagaattgtatgtggtcaagaataacaatgacttggaacaaattcaaagggagcctgcaggacagttgataaatgaaattgataatgcaaggttttatttgtcaaatgaggtaaatgaaggtggtcacagtcccataaattctgatgatgagggtatatatgtgcataggtctctcggggtagattatgtgaggtttgacgatgctaccatgagacacccaattatggacgttggaacagtttttaccgatgtgaagcagttcagatcggcactaaagaatttcatctcactactggaatgcttgctgttttggtggtttcagtaattaggccacaaggtgaacgcctgctatgttgagatgaagtaggaacgcctgctgttttgctgttttgtttgcctaagctagctgcttaaatca

SEQ ID NO: 41954 - DNA, 449 bp, Zea mays
  unsure at all n locations
  Clone ID: LIB3062-020-Q1-K1-C3
cgagactttagcaacaatcgaaaatgtgtttgcggtgatagaaggaaaagaggagcctgacagatatgtgatcataggcaaccatcgtgatgcttggacatttggagcagttgatcctaacagtggaacagcagccatgcttgagatcgcggagaggctgtccaagctacaagcgaaagggtggaggcctagaagaacaataatcctatgcagttgggacgcagaagagtttgccctgatagggtctactgaatgggccgaggagaacatggacactctagcttcaagagctatagcttacctgaacgtggacatatcagtgtttggtcctgggggtcttatgccccgtgcgacccctcaacttgatgaattgatcaaagaagcaagtaaaatggtaccagatcctgatgaaccatctcanaccttgtatgacaccatgatgcgccatc

SEQ ID NO: 41955 - DNA, 433 bp, Zea mays
  Clone ID: LIB3062-020-Q1-K1-C4
atgcatcaaggctagacccatccagaattggcacaccataccatcctatgcaggtgggggcaacttatactacccctagtcctcagcctgtaatggctgggaagttcagtcctgttgtttatgttcaaccaggtcctcaggatgcaatgcatggaacaaccgttggttttcaaggatggccttgccctttgttattgaattcgtaccaagctagcatgcagaaattccaaggcaaccccccggtgtatttagctcctccagtcatggcaactgggaaccttccattggtggtaccaagccctgcatcacttgtgcagccgttcgaggccattcatcccataatggtccctgctgcaagcagcatggtcccaggaaaatacatgtaaacttgtcgtaccaatgacaatctccttttgttggaagaaatcctgcg

SEQ ID NO: 41956 - DNA, 447 bp, Zea mays
  Clone ID: LIB3062-020-Q1-K1-B10
gcgggagcggcaaggcgaaggcgtcgtcgtgggcggcggcgatgagcgtcggcaccgtggaggcgctcaaggaccaggccggcctgtgccgctggaactacgcgttccggcaggcggcgcagcagcagcagcagcagcgcgccaggaggccagcaggcgcgagcggctcagtcggccccggcagcggcagcggcagcgcgcacgcgccgcctgcttctgctccctcgggctgcgccgcggcggcgaggaggagagccaggcagcagcaggaggaggagctccggacggtcatgtacctcagcaactggggtcccaacaactagctacgaactaccagtagctggtgatcgagcaggcgaagcgaagctgggcgggcaacaacctgagatgactccgagggcccgtgtcaagcaaccttgcctctagctagctatgctagtaggcgct

SEQ ID NO: 41957 - DNA, 362 bp, Zea mays
  Clone ID: LIB3062-003-Q1-K1-B3
attagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagc

SEQ ID NO: 41958 - DNA, 223 bp, Zea mays
  Clone ID: LIB3062-003-Q1-K1-B4
acaggatgttgcaccaacagagtttatagaatcgaagaggcgtccaaatcacttgatgtcatatgaatttaaattctttcgacaaaacactatagtggtatttatgttcagaacaatgttcgtatatgatgcaccacaaatcatccatgttgatgctgttaatgacatggagcacttgctcggatgcaattggctcgtatatacacatcagattgttctactg

SEQ ID NO: 41959 - DNA, 397 bp, Zea mays
  Clone ID: LIB3062-003-Q1-K1-B5
ggcggacacttctaaaatagtattagcacaatatatatagtgtagtagaagaaacagaagcaaggcgaggttctattcgtgatcgtacgatttttggaaggctgcttagttgattggtggactgggacctatctagagctgcttgtgatcctcattcctcagtaacttgtgcgtcatctatttttgccgccaaatttgctgaagtatgccaggattctagacatgatgtgaccctgcgtgcttaaggagatataagtctgcaatgcagaagattgtaacccaatacaaacacaaaacccagaagtttgtgcatgtggagttctatcattgtaatctgcacattatatcatatccaagaacttgcattattccttttcaaaaaaaaaaaaaagggccg

SEQ ID NO: 41960 - DNA, 386 bp, Zea mays
  Clone ID: LIB3062-003-Q1-K1-B6
acatagacgccatcctcgaactttattagatgagattggactgctatctgtagcactccgcggccatcagcccacatgcttaaggtcatgtatcttagctaatctgcaattccatagattttgttagcgaactttatcaccttggcttggataatgaagaacggtgatgggaaattaggatgcactctacatgactcagaactggctaaacgtaaggctcgagtctatatggtatgctgagctagacattcatgattgactcagagcatgcctacttcgacattgaccatacggactatgatggactatacctacttgcggaacctgtacctaatcgtcagactgggactcgcgctgaacctaggctctagacacttgaactatgg

SEQ ID NO: 41961 - DNA, 436 bp, Zea mays
  unsure at all n locations
  Clone ID: LIB3062-003-Q1-K1-B7
ctccattccatccacgtatgtagctagagctgccaatcggagatacgtacatggcccgtgtcgcgtcgctgctgctcaccgtcatcgtggctgcggcggcgtcgctgctgctgctgcttgcgccgtcggcggcggagctgacgcgggtggagcacccgcccaagaacgagggctcgctcgccatccttgcagttggcgactgggggcgccgggggcagttcaaccagaccctcgtggcccagcagatgggagtggtggnggagacgttggacatcgacttcgtcatctncacgggcgacaacatctacgacgacggcatcgncaacaccagcgaccccctcttcaaggagtgcttcaccaacatctacaccgcgcagagcctncagacgccctggtacatcgtnctcggcaaccatgactacacgggccacgcgct

SEQ ID NO: 41962 - DNA, 369 bp, Zea mays
  Clone ID: LIB3062-003-Q1-K1-B8
ggccgcccttttttttttttttttttttttttttttttttttttttttttttttttttggttgttttacagcatatcagcaaatgggtatttatggcacttattagcattatgtcactcgccacaagctggattactggaaataccgatgaaggatgagtaaccctgaaaaggttttactggcaacacatgtcctggaagcctgagttcagctaccatcaaccatggggggcacatcacttccacttcttgaacttgccgccgccgaacatgccgtgcccgtgcttgccatgcttgaacttgccgtgcccgtgcttgaacttgccgtgggggccgtgaccatgcttgaacttgccggggccaccatacc

SEQ ID NO: 41963 - DNA, 412 bp, Zea mays
  unsure at all n locations
  Clone ID: LIB3062-003-Q1-K1-C1
ccggattcccggtcgacgacgcgtccggaacaaattaagcgggacactggaaacaaagagagacatgggccttcgcggcggagctgttgccctgcttctgctcctgttcgtccacggaggccagcgagcagcagaggccggcggggacgcgttcgtgagggtccagggcacccgcttcgtgcaggacggcaagccgttcttcgccaacgggttcaacgcctactggctcatgacattcggcgccgaccccgcgcggaggggcaaggtcacctcggcgctcagccaggccgccggcgccggcctctccgtggccaggacgtgggcgttcagcgacggcggcggcggcggcggcagcgcgctgcagtactctcccggccgctacaacgagaacaccttncaggggctggatttc

SEQ ID NO: 41964 - DNA, 461 bp, Zea mays
  Clone ID: LIB3062-003-Q1-K1-C10
gcaaaatattttagctgccattgttggtacactattgtgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacattaaggcacaacaactacaacaacttgtgctagcaaaccttgctgcctactctcaacaacagcagtttcttccattcaaccaactagctgcattgaactctgcttcttatttgcaacaacaacaactaccattcaaccagctatctgctgcctacccccaac

SEQ ID NO: 41965 - DNA, 406 bp, Zea mays
  Clone ID: LIB3062-003-Q1-K1-C2
cagtgattcctttccatttaagtggataaacaagaaatggaaagaaggttttcatgtgactgcaatggcaacatcaggcaatcgatgggctatagtcatgtcccgcagtgctggattttctgagcaggttgtggagttggacttcttgtacccgagcgagggcatccatagacgctgggacaatggcttccgtattactgcaatggctgccacgatggatcagtctgcgctgatcctaagcaagccaaggcgtcgcccaagagacgagacacaagagactctgcggactacacagtttcccagtcaacatgtcaaggacaagtgggccaagaatctctaccttgctgggatatgctatgggcgaaccgtggcctaacatcgtccgttgctgacctaactggtggtt

SEQ ID NO: 41966 - DNA, 422 bp, Zea mays
  Clone ID: LIB3062-003-Q1-K1-C3
aatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaac

SEQ ID NO: 41967 - DNA, 302 bp, Zea mays
  Clone ID: LIB3062-003-Q1-K1-C5
gactagttctagatcgcaggcggtcacttgcgatctagaactagtgacagaaggacatacacattgctagatgatttaaaaaatgtactaaacttctgtaactaatacagatcggtatgtactgtaacagggtccaagctgaacaaaaatgaactggaaaatacttagtgacgggaatatgacattaagaaatgctttctgcaatacaggaaatatgatatctggttaaagactatttggctcaatactaatactctgactcttaaattatacgagtgcgactttatgaataggtattcctg

SEQ ID NO: 41968 - DNA, 436 bp, Zea mays
  unsure at all n locations
  Clone ID: LIB3062-003-Q1-K1-C6
cggccagctgctccgcgtacctggccgcggtgtgccaggtgctggtgaaggtggtgttgaggcgggacatctcgttcaagctgacgtcgaagcagcccgcgggggacgagaagaaggacccctacgcagacctgtacgtggtgcgctggacctggctcatggtgacgcccatcatcatcatcctcgtcaacatcatcggctccgccgtggccttcgccaaggtgctggacggcgagtggacgcactggctcaaggtggccggcggcgtcttcttcaacttctgggtgctcttccacctctaccctttcgccaagggcatcctggggaggcacggcaagacccccgtggtggtgctcgtctggtgggccttcaccttcgtcatcaccgncgtgctgtacatcaacatcccacacattcacgggccccgcggcaagca

SEQ ID NO: 41969 - DNA, 322 bp, Zea mays
  Clone ID: LIB3062-003-Q1-K1-C7
aacaatctggtgatgctgctttcagcttctacatttggtcgataagatgcagccatttatattggttatagtagggtgtatgtatatagtaggatgtaccatcaaaatccaatgtatcatgtatagtggttaggcaatactccgtaattatgtgcttgtaagttaataagaggccagctcgtactcctagaaaacaaaacccgtgatctatggcatggggcattctcattcccttgtacttcaggactagtatggattgtaaattcaacggtgaaggtgttgcaacatttattcagtaaagtatccttgttgaagaatttgt

SEQ ID NO: 41970 - DNA, 158 bp, Zea mays
  Clone ID: LIB3062-003-Q1-K1-C8
gagaaaatggcgtatttgtcccgcacagccgccgccgtcgccgtcgccgtgaggtcggcggtccgctccgcacctctcactggccgcgtcctcggagcgccactgccttcccttgcctcgccttccgctgcccggtccgcccgaatcctccgcaggac

SEQ ID NO: 41971 - DNA, 375 bp, Zea mays
  Clone ID: LIB3062-003-Q1-K1-D1
ccgattccaatctggaggtacacgtacgcgtccgaacaatctggtgatgctgctttcatcttctacatttggtcgataagatgcagggatttgatattgtttatagtagggcgtatgtatatagtaggatgtaccatcaaaatccaatgtatcatgtatagtggttagagcaatactccgtaattatgtgcttgtaagttaataataggccagcttgtactcctagaaaacaaatcccatgatctatggcatggggcattctcattaccttgtacttcaggactaatatggatcgtaaattcaacagttaacgtgttgcaacatttattcattaaagaatccttgttgaaaaattttgaaacacttcaataatat

SEQ ID NO: 41972 - DNA, 463 bp, Zea mays
  Clone ID: LIB3062-003-Q1-K1-B2
ggattcccgggcgagaccgtcaccaacgacgagatcgccgccgacctcaaggagcacgtcatcaagcccgtcatcccggagaggtacctggacgagaagaccatcttccacctcaacccgtcggggcgcttcgtcatcggcgggccccacggggacgccggcctcaccggccgcaagatcatcatcgacacctacggcggctggggagcccacggcgggggcgccttctccggcaaggaccccaccaaggtggaccgcagcggggcctacgtcgccaggcaggccgccaagagcatcgtggccagcggcctcgcccgccgctgcctcgtgcaggtgtcctacgccattcgggtgccggagcccctgtcagtgttcgtcgactcctacggcaccgggaccatccccgacaaggagatcctcaagatcgtcaaggagaacttcgacttcaggcccgggatgatca

SEQ ID NO: 41973 - DNA, 422 bp, Zea mays
  unsure at all n locations
  Clone ID: LIB3062-002-Q1-K2-H9
gaaaattccagcggacgagcgctctaagccgtttttcctcgtcctcgatccagccccgtgccgcttccagctccgatcgatctgatccctccccaccaccacgcccatggcggaccaactcaccgacgaccagatcgccgagttcaaggaggccttcagcctcttcgacaaggacggggatggttgcatcacgaccaaggagctgggaactgtcatgcgttcactggggcaaaaccctacagaggctgagctccaggacatgatcaatgaggtcgatgccgacggcaacggcaccatcgattttccagagtttctcaaccttatggctcgcaagatgaaggacaccgactctgaggaagagctcaaggaggcctttcgtgtgtttgacaaggaccagaacggcttcatctctgccgncgagc

SEQ ID NO: 41974 - DNA, 380 bp, Zea mays
  Clone ID: LIB3062-003-Q1-K1-A1
ctcagagcgaagctcaggtagacaaggcaatatctttgaagaatttcagccatcagcagatagcacctcccaagccagatatgctcgagcttcagatcgagatcctggtgatccttcaacaagtggacctgagaaagagctgacctctgaagatgaagtggctcgtttactgaactgcactgaccactattcagcattaggtttccgtcgatatgagaacatagatgtatcatctcttaagagagaatacaagaaaaaggctatgttagtccatcctgataagaatatgggcaatgataaagctgctgatgcatttaaaaagcttcaaaatgcatatgagattcttcttgattcactgaaacgcaagacatatgatgatg

SEQ ID NO: 41975 - DNA, 238 bp, Zea mays
  unsure at all n locations
  Clone ID: LIB3062-003-Q1-K1-A10
gtgttcgaagcccattgaagtaactggagggaggaactgtggaataaccaattgcccaattacggcaacaatccttagcacatctaaccatacaaaccatcgcaacgcagcagcaacaagcactgagccacctagccgtggtgaaccctatcgcctacttgcaacaacagctgcttgcattcaacccacttgctntggcaaacgtagctgcataccaacaacaacaacagttgcaaca

SEQ ID NO: 41976 - DNA, 452 bp, Zea mays
  Clone ID: LIB3062-003-Q1-K1-A11
atgcgttcgctagcagcatagacagcacaatactgtaccaacaatgacagccaaaatattgagcttcctgatgcgcctcggactatccgcaagtgatgctaccgcaaccattctcccacaatgctcacaagctactataacttcccttatttccccatacctcttaccaaccgagtcttcaatgtgtgaaaacccaattgttcaaccctacaggatccaacaggcaatcgcaacatgcatcttaccattatcacccttggtccttcaacaaccgttagccctattaaagccggtacctttggaccaattggtggcaccaaacaatctggcccaacaactaccaccacttgtgctatcaaaccttggtgcataccctcatccacaataaggtctttcatttgacccactggctgtaatgaactctgctgattatttgcaacaaccattaccct

SEQ ID NO: 41977 - DNA, 338 bp, Zea mays
  Clone ID: LIB3062-003-Q1-K1-A12
accgtcttgattcccggacgagaccaactgcacatagaagcacaatagtgtaccaacaatggcagccaaaatattttgcctccttatgctccgtggtctttctgcaagtgctgctacggcgaccattttcccgcaatgctcgcaagctcctatagcttcccttcttcccccgtccctctcaccaccggtgtcttcggtatgtgaaaccccaattcttaaaccctccaggatcccacaagcaatcgcagcttgccatctaacctttataaccctggttcttcaaccattattaaccctattacaacagttaccttttgtgcatttattggcacaaaaca

SEQ ID NO: 41978 - DNA, 385 bp, Zea mays
  unsure at all n locations
  Clone ID: LIB3062-003-Q1-K1-A2
aactagttctctttgtgcttctagttccctctgaaccatcttaccgtaaccacctctgccaggatcataatctgtacggtactcatctctcacttgtccaccacttcgtccacggccccattgcctgccttcttcaaagccccaatcgaaatcaacacggattggacgatcgtcaagcatcgttccactgatgtatttgacagcatcttcagcatcctccctggagtagtacagtacgaagcagaaaccgcatggggtcttagagttcttgtcgagccccatgatgatcttcttgatctcgccagcgcgggagaagagctcgtaggcctgctcctncgtggtgtagaaagacatattcccaatgtacagcgttgtcgacgcatgc

SEQ ID NO: 41979 - DNA, 371 bp, Zea mays
  Clone ID: LIB3062-003-Q1-K1-A3
ggatcgacatgtttatctccggagacgctccgaagagcgcgtcggatttgagcttccctaagggccacagcgagcttagctctagcagctgcagctttgacggcctcctcaactccataatcaaagtggagaaggacgatgcttccttcagcgatgacctgggatgcgacttgtactccctgggtgcctgtatatgatcgctaccttccacgtatctgcatctgtgttaatctcccattgtatgctgtgcagctagtgttaatcttaggtagaattgtagctgtgcgcctatctttgcttgctcacagccaagaaaaaaaaaattgatgtctgcacgtgatgtgctagcagtaagatatctggatttgtgg

SEQ ID NO: 41980 - DNA, 432 bp, Zea mays
  unsure at all n locations
  Clone ID: LIB3062-003-Q1-K1-A4
cactaacgaacgaactcttgctccgatcacgagctagctgaggtcgacgatggcggctgtgctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtncaccgactgcaacaagatcagctaagttacgacgac

SEQ ID NO: 41981 - DNA, 318 bp, Zea mays
  Clone ID: LIB3062-003-Q1-K1-A5
caaagaaggtgaaattacagtagaggaaacagatgagaaaatagaatctaaagttactgctgaacctgtaatcggggagacaactgaaggtcaaactgcagctggagaaccagttgaagaagctagaacagctgaggacatggtagaagatgttaaggtgctagatgataaatctacagcagctgagaaacctgtagagaatgccacagttgtggcacatgagaattcgactacagatgagaatactctgaaggatgcgattgtcgcgccaccagatgcatataccaccaacgccggaaaaactgctattggtgccac

SEQ ID NO: 41982 - DNA, 433 bp, Zea mays
  Clone ID: LIB3062-003-Q1-K1-A6
acgaactagttgtctttgtgcttctagttccctctgtaccatcttaccgtaaccacctctagcactgtcataatctgtacggtactcatctctcacttgtccaccacttcgtccacggccccattgcctgccttcttcaaagccccaatcgaaatcaacacggattggacgatcgtcaagcatcgttccactgatgtatttgacagcatcttcagcatcctccctggagtagtacagtacgaagcagaaaccgcatggggtcttagagttcttgtcgagccccatgatgatcttcttgatctcgccagcgcgggagaagagctcgtaagcctgctcctccgtggtgtagaaggacatattcccaatgtacagcgttgtcgacgcatgcagcgttgcctcatactccttctgtgtgcccttgaatcggcggtcc

SEQ ID NO: 41983 - DNA, 442 bp, Zea mays
  Clone ID: LIB3062-003-Q1-K1-A7
ggcaaggcagccatgaaaccccctcagctgccggcaggggagggggcctcctgggctgacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacaaaccggccggccgagatctgggcatgcaagcttgcatggccatgtcttggtcagtcagatctgcaaacaaccaaactgtaaaaaagaactggagcctgtcttggaaatcatggagcttgctgctgcttgcacccatgaaaaacatgaacgcatggagagctggttaactagctaggtagatagatatatcatatatgg

SEQ ID NO: 41984 - DNA, 207 bp, Zea mays
  unsure at all n locations
  Clone ID: LIB3062-003-Q1-K1-A9
ccgggacgacccacgcgaccgctccggaggctccaccactagcaacccgngcagcgagcccgccccgaccacngccaagacgaggggcggcgacngggncgacgagaacaacggcgggaccggcggggccatcgccggagccganaaccgnaacgacgcggcggacacccgccccacaggcggaaacagcaaccccacgcgcgacca

SEQ ID NO: 41985 - DNA, 398 bp, Zea mays
  unsure at all n locations
  Clone ID: LIB3062-003-Q1-K1-B1
cggacgcgtgggggcctgaggggctgggctgaagttgaaccatgagtgccgtcgcgggttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggatgagatagccgagcagctcgagttggtcgccctccttgcctacgatgaggatgaggacctcttctacggcgagcaggcccccgccgccgncgccgcccttaagacagattcggtgctcaaggcgctgaacttgggctccccgaagagcggcgacgccccgcgggggttccgggagaaacccaggcactccgagaag

SEQ ID NO: 41986 - DNA, 442 bp, Zea mays
  unsure at all n locations
  Clone ID: LIB3062-003-Q1-K1-B10
catttaaccaattggaagaagttgttgttgctgagagtaggcagtagctagctggctgaatggtgatagttgttgctgcaaataagcagcaacaacttcttccatttaaccaattggccgcactgaaccccgctgcttatttgcagcagcaaatactactaccatttagccagctagctgcagcanaccgtgcttccttcttgacacagcaacagttgctgcctttctaccagcagtttgcggctaaccccgcaaccctcttacaactacaacaattgttgccctttgtccaacttgctttgacagaccgagcggtctcctaccaacaacacatcattggtggtgccctcttttagattgcttattagttgtaattcaataataaagttttttggatgatgtatgtggccaaccagaattaagaagttacatttccagattt

SEQ ID NO: 41987 - DNA, 375 bp, Zea mays
  Clone ID: LIB3062-003-Q1-K1-B11
gcaacgtagaaagcacaatagtgtaccaacaatggcagccaaaatattttgcttccttatgctcgttggtctttctgcaagtgttggtaccgcaaccattttcccacaatgctcacaagctcctatagcttcccttctttccccataccttttaacaacggtgtctttaatgggtgaaaccccaattggttaacccttcaggatccaaccaggcattgcaaccagcattttaccattattacccttggtccttcaacaaccgtgagccctattacaggaattacctttgggccatttggggggacaaaacattagggcacaacaactacaacaacttgtgctagcaaaccttgctgcatactcttagcaacatca

SEQ ID NO: 41988 - DNA, 446 bp, Zea mays
  Clone ID: LIB3062-003-Q1-K1-B12
ctatcagtaccatcaatcatcattcatcttattagtataggcaccaaatcaaatctgcaacatcgattatctaactccaaaaaccatgaagctggtgcttgtggttcttgctttcattgctttagtatcaagtgtttcttgtacacagacaggcggctgcagctgtggtcaacaacaaagccatgagcagcaacattatccacaacaacattatccacaaaaacaacaacatcaaccaccaacacaacctcaccagcagcagcaacaccaaccacaacaagtatacatgccaccacaaaaacctcagcaacaaccagaagtgcatggtcaacaaccaccacaaccaccgcagcaccaacaaccaccaccacaaccacagcaccaacaacaacctcaatgggaaggcgcacaacaacattaccaacaatcaccagggcatgtgcaac

SEQ ID NO: 41989 - DNA, 419 bp, Zea mays
  Clone ID: LIB3062-002-Q1-K2-H8
cgcccacaaatggtggactagctgtccagacaatgggtagtgcctctcaagttgcttttggttacccagcagtccagctaccaacacttgaaacgggctcttcatgggcatttggtgcttcctcgtctgctcatgctgaagatgagaaaaaggctgatagaggactctctcttatgggttctgccataaggccaggcatcgcaccaaatgtcaaatttggagggtctggatcatatccggatcttccctgggtttctaccatcggcgccggaccaaatggcagaaccatatcaggtgtgacatacaagtttggtagaaatgaggtaaagatagtatgtgcttgccatggcactcacatgtctccggaggagttcatgcggcatgcaagtgcagatgctccggcccaagataatagtgca

SEQ ID NO: 41990 - DNA, 271 bp, Zea mays
  Clone ID: LIB3062-002-Q1-K2-G4
cggaattcccgccgcttctaaaccatcgatggattgactaatcaaaacactctaatactttcaccaacgtaataacatgtctgtcgctgcttattctaagcaacaccaacccgaaatgacactacatgcaacccttctctcacgctcaaaagttcaccctacagtataaaagatactttttaccaatgaaaagaatgcatctatggaattctacaacacaactctgaatacacatacacttgtgttaccgaagatggatattatgctcaat

SEQ ID NO: 41991 - DNA, 380 bp, Zea mays
  Clone ID: LIB3062-002-Q1-K2-G5
atgaaacacaccagctgcatcattaccagctcattccaagaacttgctcgacgcgggggcaccttgacgcactacgagtcccacatcgcgttcactcatcctagggctctaccgtgtccaccatggcatcaatgttagcgatcccaagttcaacattgtctctcctggatcatacatgagcgtctactacccgtatacagagaccgtcaagagactcactgccttccatcatgaaatcgacgagctcatctacacctacatcgagaactccgaacatacactcgtgctaacggacacgacgaagccggtcatcttctcaatcgcgcgtatcgaccgcgtgaataacatgacaggcctggtggagatgtactgctagaacg

SEQ ID NO: 41992 - DNA, 438 bp, Zea mays
  Clone ID: LIB3062-002-Q1-K2-G7
agaacacagggcacacgcactacacgcacggtacgcagatacatatagtgagaggatggctatagcttgcacatctatttaactaactaactaactgactagctagctcgatccgcagagcaaagcgaaagcagcaagaagcaaagcaatggagaaccctgctagtgcgctagtgctaccagcgcagttcaccaaactcaccttggtaaacctgtacatccgtcgagccgggccgcgcagattcgagataacccaggagggcaggtgcaacctggacaggatatactgtgagtaactttcacgtctacgacggccgcggccctgacaccagccttgtggcccgcgtgcacgtgatcaccagctaaatcgggaaccctcaccaactgttcgtggtcgtgttcgacaccgacaggctcaagggctacacgctcgtcacca

SEQ ID NO: 41993 - DNA, 377 bp, Zea mays
  Clone ID: LIB3062-002-Q1-K2-G8
ccagccagccagccgggtcctaccgcgtagctagcgtaggcgtaggcgtagccggaggggcgtgtgcgagaggggaagaaatgctggaggggagggcgcgggtggaggacacggacatgccggcgcggatgcaggacgcggcgacctccgcggcctcgcgcgcgctcgacctcttcgacgtcgccgactgccgcgccatcgccggccacatcaagacggagttcgacaagcggtacggcgtcgggtggcagtgcgtggtgggcgccaacttcgggtgcttattcacccacagcagcggcaccttcatctacttctccatggagcgcctctccttactgctcttcaaagccgacgtcgtcgcagacgtcgccgccgtc

SEQ ID NO: 41994 - DNA, 423 bp, Zea mays
  Clone ID: LIB3062-002-Q1-K2-G9
gagaaggatagcatgcggtcgacggtgttggtggcgcggagcctgcagaaggcgtgcgtgccgccggccttgctctcagacccgacgcccggcagcctccagcccacccgcctcgccgcccatgtcaatggcgccggctcctcgtgctctgtttacctcgcctctggctgccgcgtctacaggatcgagatacgactggatgctagtgtgatgctgtgcaaaggaaaggagagcctgtcgattcctgataatgcacaggtcatcagttcgtcggttgtggatcgctgcccacatcgttctgagatccagagtgtagctctcgcagacggcgaagatgactgtctgattctgggaacggtgactcatatggtcatcttatcgaatctcgtgtggacatcgtggctgatgacatcgacaggacat

SEQ ID NO: 41995 - DNA, 372 bp, Zea mays
  Clone ID: LIB3062-002-Q1-K2-H1
gtcatatggctgctgttgtgaaggctaaacctaaaactgaaccaccggctgacagaactggaccaaatagggaagcagttgggccagcacaatttactggtaccttggtatctaatgcttaagaaagtgcagacaatgtggttgtggatattgaaagaccacataacaggcagattaatgggatcccagcatctaacgcactgcctaggtcatcagaggatattgaggatggtgaggtcgttggaatcatcacacttgaggatgtatttgaagaactcctacaggaggaaattgtggatgagactgatgaatatgttgatgtccataaaaggatcctagtagctgctgctgctgctgcatcatcggttgcaa

SEQ ID NO: 41996 - DNA, 427 bp, Zea mays
  Clone ID: LIB3062-002-Q1-K2-H10
ctgacatttcgggtgcactgaacttgcagttgatcgattcagcagcatgtactaatctggatgctttcatgacagaactgccacgtgataatgaacacaagattgtaaacatcaataaggaagggcacatgttgacacaacttactatggctgatacttctgatgttcctatagaagatcctcttagcatcttaaactccagaactgatgatcatcgtgccctagagttgagggataaggagctccttgtgtcagagctgcaaaatacgcttgatcaaaaatcaaaacagttgggtgaaactgaaattaaacttagtgccatgatggatgaggttaattctctgaagaaagaacttgaacaaacccggggtcttcttgacgaatctcagatgaattgtgcgcaccttgaaaactgtttacatgaagc

SEQ ID NO: 41997 - DNA, 436 bp, Zea mays
  unsure at all n locations
  Clone ID: LIB3062-002-Q1-K2-H11
gaaccttcggatgtaccttttgatatttcatctgttccgaaggagacaaaatcccaaccccttgcggagaaaaagtctacaggcaagaaatcagcaggtccggcatctgctgtcagtgaccctgtttctacagttgatgcttcgtatgagaagcttctttcgtccattcccgaattcgctgattttggaaagctttttaagtcatctgcacctgtagaattgactgaagctgagactgaatactcagttaatgttgtgaagcatatttttgatggacatgttgtgctccaatacaactgtaccaatacaattcctgaacaattgcttgaacaggttattgtttntgttgatgcttctgaggctgatgaatttttagaagttgcttcgaagcctttagaatcattaccatatgattctcctgggcagacctttgtcg

SEQ ID NO: 41998 - DNA, 290 bp, Zea mays
  Clone ID: LIB3062-002-Q1-K2-H12
cgagggcatggaggagggggagttctccgaggcacgcgaggacctggccgccctggagaaggactacgaggaggtcgccgcagagggcggcagtgatgacggcgacgaggaggaggaatactgatctgcttgcatgaatctgtttggctgtcgagccaggttgtggtgttgaaaaacctttgtttgtgtcctgggtaatgtttgggtgtttccttccatcatcacttgctgaactgctctagtatttgcatttgtaattgaagtctgtcgctttaagcactcttggttct

SEQ ID NO: 41999 - DNA, 332 bp, Zea mays
  Clone ID: LIB3062-002-Q1-K2-H2
gttcatggcgacgtccatgctctccgccaccacggtgccactccagcaggtccaggggggcggcctgtccgagttctccggcctcgtcaggagctccgcgtcgctgccgatgcgccggaatgccacctccgacgacttcatgtccgccgtctccttcaggacccacgcggtcggcaccagcggcggcgggccgaggcgggcgccgacggaggcgaagctcaaggtggccataaacgggttcggccgcatcgggcgcaacttcctgcggtgctggcacgggcgcggcgacgactcgcccctcgacgtcatcgccatcaacgacaccgggggcg

SEQ ID NO: 42000 - DNA, 306 bp, Zea mays
  Clone ID: LIB3062-002-Q1-K2-H3
gactatggaccactcgaacgctttaagggccatgtaaactgtaatggtatgaacgtaggtagagattccagggatcacaagccttcacacaactgacatgagaactgttacgagcctgcatacgctgagtcagaactctatgtgacacgtgttctatatgatatgaaccgaaaggaggaaatgtctctgaggaaggcgtaccactaaacggatcagaccctgaaagacaatcacaacactcatgagaagttggcgcataaagttgatactatgacacaagctctggagtcacatgccaataaatct

SEQ ID NO: 42001 - DNA, 398 bp, Zea mays
  Clone ID: LIB3062-002-Q1-K2-H4
ggctgtagatcacttgaacgctataagggccatgtaaacgggaatggtatgaacgtatctaccgattccagtgaagataaagattcaaacaactcagatgagaagtgtaacgagtttgcatctgctgagtcggaggactcggtgtcaggtgttctatatgatatgttgcaaaaggaggtcatttctctaaggaaggcgtgccacgaaaaggatcagagcctgaaagacaaggacgacgcagttgagatgttggcaaagaaagtagatactttgacaaaagctatggagtcagatgccaagaaatcgaggcgcgagctagctgctatggagaaggagctggcagctgtgcgcttggagaaagagcaggataacagggcaagacgttttggtagttcaag

SEQ ID NO: 42002 - DNA, 438 bp, Zea mays
  Clone ID: LIB3062-002-Q1-K2-H5
aaaaagaacttgaaaggaattagcacaaccagagaaacgatttgttggctagcatgtgttctcttccagtattgatgttctatgtcttcttggcctgtatttgacacaaactttagttctcacagaaacaagtggtagtgtgctctatttgatcttgtcaatttgttagtcacttgtcgcacaggtcagtgggaggttttctcaattctttttttagttctcatttttaattgtaattccacctaaatgattatgtttctgggctatttttatttattcagactgttttctttactactgcctaatttatgtttctaggctatcttgtgtggatttcgtgctccagatcacctccctaccagatgagtacatcttacttcatgagaattatcaactttatgttcttccaaaagttctagaataaaagagaatggttgt

SEQ ID NO: 42003 - DNA, 432 bp, Zea mays
  Clone ID: LIB3062-002-Q1-K2-H6
gcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttg

SEQ ID NO: 42004 - DNA, 402 bp, Zea mays
  Clone ID: LIB3062-002-Q1-K2-H7
gcggcgggctggtggtgacggagctgagccacatcaaggagctggtgaggcagctggaggtgcacctcggcggctccccggacctgtgcaagcacctggcctcgcagatcttctccctcaccgagcgctccatcggcctcatcaactcctcctccagcggcctcgacggcgcccgccggaagcgctccgcgggcgacgccggcctcgcctcgccgctctcggccacgcccaccagcggcgtcaccgacgggccgttcaagaacaccaagaagaggaaggcgatggaacagcggaggcagagggtgagctcggccggcggcgagaacccggtcgacgacggccgtagctggaggaagtacggccagaaggagattctcggagccaagcacccaaggggctact

SEQ ID NO: 42005 - DNA, 451 bp, Zea mays
  Clone ID: LIB3062-002-Q1-K2-G3
aggcaacgaagttaatgatgatgttctatccaaagcattctcacggtttccatccttcaacatggcaagggttgttagagataagaggactggcaagactaaaggttatggatttgtgagcttttcaaaccctactgacttggctgcagcaataaaagagatgaatggaaagtatgttgggaatcgccctattaaattgcgtaagagtaactggaaggagaggacagatgttgaggctctgcaaagacaaaagaatcatgtccaaaggaagcctaaaattcccaagaagagtgttcttcacaagtagagatatataggccctaccgagggtgaagggcagctcatggatgcgttgctgccttgggatgatgctacttctggaatgtcttcactctctgcactactaggggggcggaaatcacgcaaagggctgttgtttcatgcaaattgc

SEQ ID NO: 42006 - DNA, 344 bp, Zea mays
  Clone ID: LIB3062-019-Q1-K1-H7
cgcagagaatccccaagcaaacatacagggtctaaggagaggacaggagaggagaggagatgtggggtctttgacaccatggctaccgtgcaaatgttctgggtcgtgatgttataaaacgtgacgaggttcgcaacgacactggtagaggctggctacaactactagatcgtgcccatgaacttcggcaccgacaagcacaacatcaccctgcatctagatctcgacccggatcgtaatgttccagatatgcatgattatgactgggccctttttgaatcactatcaatttgaacggacgctgattgcataaacaagcccaagcttattatggaacgaaacct

SEQ ID NO: 42007 - DNA, 374 bp, Zea mays
  Clone ID: LIB3062-019-Q1-K1-H8
gactaatacaactcaaccatggaaggcctcagccacttcagtatgctgtcaacgcagctttccgtgcttctctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggcccaaaaaaggcaaaccctaacatccttgtcggagcaatggtggctggccccgaca

SEQ ID NO: 42008 - DNA, 428 bp, Zea mays
  Clone ID: LIB3062-019-Q1-K1-H9
aaactgcttgaactggaagcgaccctagtccaaaccaccgcaccgacaccgactccgagcgccgccgggccgcgctacctccgctcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtcgggttcggcggcgctagcaggggcgacgccgtcgttgacgtcccgctcgagaccatgggggactctcggagcaaggtgaaggagctctcgtcgtgggaatcagatctgaagcggcgagaggcggatatcaagaggaaggaagaggcgctgaagaatgctggcgtgccaatggaggagaagaact

SEQ ID NO: 42009 - DNA, 315 bp, Zea mays
  Clone ID: LIB3062-020-Q1-K1-A1
ctggtgtgctgaataccctaaacagggcaaggtttaccgtcgcagtggattgcttcagtaaaactggtcacattccctccttgaaggaaggaaactcacaggagacgatatttaatccaccttggcggcatgagccagtcgcaataggttcaaggtttggagaagcatttcaagagccagcttcatttcttgccatacgacctctgtttgaggatgagagatacatggtaacatataacccaacaaaggataaagtatatgctttgcttaaggaccaggcaaaatcagacgacattatcaaaagctgtttccatg

SEQ ID NO: 42010 - DNA, 453 bp, Zea mays
  Clone ID: LIB3062-020-Q1-K1-A10
gatgattattttgatggatactacactgaagaaatgattgaatctcaggttgaccaactcgtccttgaggaggttgtacgagaaaggttccctaaattggccaaacatatggaattcttgggagttcaagtgggatggataactggaccatggtttctttcaattttcatcaatatgcttccatgggaaagtgtacttcgcatttgggatgtcatcctttttgaaggaaatcgcataatgttgttcaggacgacacttgctttgctggatttatatgggcctgcactagtgaccacaaaagatgccggagatgcaattacactactgcagtctcttgctggatctacatttgacagcagccagcttgtattgacagcttgtatgggctttcaatcagttagagaaatgggattgcaagagttaaggaaaaagtacaggcctgaaattttaact

SEQ ID NO: 42011 - DNA, 473 bp, Zea mays
  unsure at all n locations
  Clone ID: LIB3062-020-Q1-K1-A11
agccagagcgtccgcagaagggtaaggtcggaatagtcctggacttcaactggtacgaggctcttacaaactcagctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatncagctacatgaaggggcagaagctggtccagctggcgcccagtagctactctgccgattggcaggttcaatatgtttttgcacgcaatggcaaaccgattggaccacaggcgaattctaagtggctctacatcgccccgacggngatgtacgggtgcgtgaactacctcaaggagaagtatgggaatccaacgatctacataacggag

SEQ ID NO: 42012 - DNA, 404 bp, Zea mays
  Clone ID: LIB3062-020-Q1-K1-A12
cataaggatgatgacggattcttcctggactttatctgggactatgctcttacacacttaggtgataccaagcagcacgcgggagggtctatgactttcacattgcctgcgaagttcatccattgataaacggacactatccacagatcatgcatagatctcaatgaatcgatcaggtctgcctcagcattcactacctgaacatgctaaactggagaatcgctcccctagactacatatgctatcaacgagtacacatccatctacatgaatgatcaaaaactgtatcacctgactcccaataactactctggccattgacacgatcactatactgctgtacacaattgcatacccattggaccacatgcgaattctaagttgctcttcattgcccctacaat

SEQ ID NO: 42013 - DNA, 431 bp, Zea mays
  Clone ID: LIB3062-020-Q1-K1-A2
gctacgctaaagcaagtctagtctctagaggaggaggcggagggggaggccatgggcagggacgacgtggtccagagcggcgcgggcggcggcgagttcgccgccaaggactacacggacccgccgccggcgccgctggtggacgcggcggagctgggttcgtggtcgctgtaccgcgcggtgatcgcggagttcatcgcgacgctgctgttcctgtacgtgacggtggcgacggtgatcgggtacaagcaccagacggacgcgtctgcgtcgggggccggggcggacgcggcgtgcggcggcgtgggcgtgctgggcatcgcgtgggccttcggcggcatgatcttcgtgctggtctactgcaccgacggcatctcggggggccacatcaacccggccgtcaccttcggcctcttcctggcgcgcaaggt

SEQ ID NO: 42014 - DNA, 301 bp, Zea mays
  Clone ID: LIB3062-020-Q1-K1-A3
aggtcctgaagcaggtgcaccccgacatcggcatctcctccgaggccatgtgcatcaggaactccttcatcaacgacatcttcgagaagctcgccgcggaggccgccaagctcgcccggtacaacaagaagcccaccatcacctcccgcgagatccagacctccgaccgcctcgtcctacccggcgagctcgccaagcacgccgtctcggagggtaccaaggccgtcaccaagctcacctcgtcttagcccccttgtagtaggcgtcgttgctgtctgcttctcaagcaagcactgtgatg

SEQ ID NO: 42015 - DNA, 434 bp, Zea mays
  Clone ID: LIB3062-020-Q1-K1-A4
attaaagcaagccatgtggaggagggctttagcgatggtcctgttcatggctggcgccgggctggtcgccggggctgccggcgccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcg

SEQ ID NO: 42016 - DNA, 399 bp, Zea mays
  unsure at all n locations
  Clone ID: LIB3062-020-Q1-K1-A5
gaagaagatcgaagccttggacaaagacatacttgtcaaggagggagagatcacgatgttgcaggacaacatcgacaagccgttcaatatcatctgcagcccaagttcgatgcaggagttcggcatggggtgaagatggctgctattttgtaagtgagttggtggatgaaaattcaagttattgtagaagacaacacatttctttgcatattacatcctgctatgatgttctgaactatgatgggttcaacgggtgccatttttctcttagagctattgttgacatggaagaaatggtggcagcaccagcttagtatggacaacaactgaaatctcctacagaagttgtttctaatgtgctattgagctccattgngttttggcctaccgcaatcttgt

SEQ ID NO: 42017 - DNA, 386 bp, Zea mays
  Clone ID: LIB3062-020-Q1-K1-A6
atatgaactatgaaggaatgctgatggtcaggatatccactggaggacaatagttaatgcagactcgagagtcaacatgcctaaaacgatgtatgatcatgagtgcgttatatattatatattggctctggttacctgtactatttagtgcatcatttggtacttattttaatagtccaacggaacatagcgtcatactgtagccattctgaggatagtgcgatactattagacacttagctatcataggttaccagttcagctcatggtagcgacatttggtgacgcattacagttaagcttgctgcataacgtacgcatgtcctatgtgatctcaactatacgatcaactcaccatatgtgaagacacaccaacttatatccaa

SEQ ID NO: 42018 - DNA, 417 bp, Zea mays
  Clone ID: LIB3062-020-Q1-K1-A8
ctgtgtttggtgaaatctaccctgatccagtaagagttgtatcagttggtcgcaaagttgaagatctgcttgcagatcctgatagcaaagagtggctatccatatcgactgaactatgtggaggtacacatatcacaaacacaagagatgctaaagcatttgcactcttatctgaggagggtattgcaaaaggagttacgaggataacagccgtgactgctggatgtgccacccaggctatggagttggcgtcatctatcgattctgatatcaataaagcatctcagttggaaggagctttgttggaaaagaaaattgcttccatcaagagtgggctggatgcagctgctatccctgctgcgagaaaagctgatttgagaggcaaggtttcaaagttagaggacgaacttaggaagg

SEQ ID NO: 42019 - DNA, 459 bp, Zea mays
  unsure at all n locations
  Clone ID: LIB3062-020-Q1-K1-A9
gtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgncgcgctgcccagcaagtgcggggtcgccctgccgtacaagatcagcaccaacgttaactgcaacacgattaattaaat

SEQ ID NO: 42020 - DNA, 432 bp, Zea mays
  Clone ID: LIB3062-020-Q1-K1-B1
cgaggatggccccctcgtgcgcgagaagatcttgtatgccgtgaagcaatactgggttggtggtaagcagacggctgtagcttgaagcaagcacgtttcatgaggctctaacatgaggaattctgcaaccaaaccttacccgacaaacaaggattagcttaaatgatcaacccttgtagggcttgttcggttacaacaattcagaagcggattggaggggattaaatccttttctagttaaaaatgactagaagaggatttaaacctcaccaatccccttatggattggtgtaaccgaatatgtccgtagggggtagcactgaagcagccaggataccgtgctcgctggtgatcactgcaaccacataatcttctttggtcgtgtactcttttcaaaaagcttgtatctttggaaatttctttacggtcctc

SEQ ID NO: 42021 - DNA, 410 bp, Zea mays
  Clone ID: LIB3062-019-Q1-K1-H6
caggaggaggaggacgacgcgcccaccatggccatggcgacggcccttcgcaagcggtccggcgacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaacggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggc

SEQ ID NO: 42022 - DNA, 434 bp, Zea mays
  Clone ID: LIB3062-019-Q1-K1-G11
ccgggctgatcgcatggttatgcttgcgaaagcactagagtatgcagattttaacaacttggaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaacggcaaccgctcgggatactttgatgaaactaaggaagagtatgtagaagttcctagtgacagtggtattacattcaatgttgcacccaagatgaaggcgcttcaaattgctgagaaagctagggacgctctcctaagtggaaagcttgaccaggtacgtgtcaacctgccaaatggtg

SEQ ID NO: 42023 - DNA, 429 bp, Zea mays
  Clone ID: LIB3062-019-Q1-K1-G12
gtggagaggacgtggacgaggggacggggaggtggaggattgtagggcgaggcggtgccgacgaaggcacaggggccagataatattggaggaagcgaataactacgatattgggttctagaccaaagaagcaatggaaaaggaatcatctgccacatacgagccaaaaaggaacagtgaaatatgggtttttgagagttcaaatgagatttcaacggatcttgctgagtatatctcacaagtttcacaaatttctgtcaaagaaaggggatactttgccatcgccttatatggaggtcccctagtcactttttaggggaaactttgcgaagctacatacaacaatacactggattggtccaaatggaacatcttctggtctgatgaacgtgctgtggcataaaaccatgcagatagtaactataggtt

SEQ ID NO: 42024 - DNA, 140 bp, Zea mays
  Clone ID: LIB3062-019-Q1-K1-G2
cacatgcaagaaaggattggaagatgagaccctcggtatcaaccgtagttaggccaactacagggtccacggccttgtccttaagcggaggcccaatgcgctgaattactgttcttcgtaactagacgcagcatacgcac

SEQ ID NO: 42025 - DNA, 460 bp, Zea mays
  Clone ID: LIB3062-019-Q1-K1-G3
ctcagaaggcaagaagtttgctctgcatcttgttccatctggtattctccatgaagggacactgtgtgttgttggcaatggagcagtcatccatgttccagggttctttggagaaattgatggtcttgagtccaatggagtccgctgcggtggaaggatactggtatccgaccgggcacatctgctgtttgatctgcaccaggctgtggatggacttagggaagcagagcttgaaaattcatttatagggacaactaagagaggcattggtccttgttactccagcaaggtaactcgaaatggactgcgggtttgtgatttacgacacatggacacttttggggataagcttgacatcttattcaaagacgctgcttcgagatttcaaggctttcagtacagcaaaagcttgctcaaggaagaagttgagagatacaagaagtttgctgatcgcttggag

SEQ ID NO: 42026 - DNA, 473 bp, Zea mays
  Clone ID: LIB3062-019-Q1-K1-G4
gaattcccgggctcagaaggccggacgtttgctctgcatcttgttccatctggtattctccatgaagggacactgtgtgttgttggcaagggagcaggcatccatgttccagggttctttggagaaattgatggtcttgagtccaatggagtccgctgcggtggaaggatactggtatccgaccgggcacatctgctgtttgatctgcaccacgctgtggatggacttatggaagcagagcttgaaaattcatttatagggacaactaagagaggcattggtccttgttactccagcaaggtaactcgaaatggactgcgggtttgtgattcacgacacatggacacttttggggataagcttgacatcttattcaaagacgctgcttcgagatttcaaggctttcagtacagcacaagcttgctcaacgaagaggttgagagattcaagaagtttgctgatcgcttgggacc

SEQ ID NO: 42027 - DNA, 377 bp, Zea mays
  Clone ID: LIB3062-019-Q1-K1-G5
acggcagctgataatcaagatattgcgctgtttgtatgacaatctataggacgaggtagaggtaagcgtggatgaagaatgcagctcccaagagtcttacgtatggcgtagagtaacggggatgatttggccgactcaaattctcgactttcagtgattcattaataacctgtcgatactgatgcatcaacgtatattcatactgcttgaacattttattctttatctagctatgtgatcaactatgtttagtttttgtttgactaccagtcatctctaaagcagtttttgtaggatttcaaggatgatgggacagcttcttagctgtcacttgtaacatttaatatcatgcttgccttacaaaataatttagaatc

SEQ ID NO: 42028 - DNA, 453 bp, Zea mays
  Clone ID: LIB3062-019-Q1-K1-G7
attgcctttgatacgctgcagtctatcatggtgcatgggtttcagttatttgacatctggcaacgacatctagtggaaaggggtgcggactttcttgatttgcagaaatcttataagcaagcagcaggatctttttctgaatggaggggcaagcttactagggactttggttttgctattgatttgataagcatgttgatgtcatttggtcattactcgatgatcttttggcttcgtggtatggcgtttcatctggttgatgcagttctcttatggaacttgcgtgctcttatagtttcctttttgaagaggattaaaacttacatcaaattacggaaggcacttagttcactcgacggagcacttccagatgctacttatgatgaaatttgtgcatatgatgatgagtgtgccatctgcaggggaccgatgggtcgagctaaaaagttgtcc

SEQ ID NO: 42029 - DNA, 431 bp, Zea mays
  unsure at all n locations
  Clone ID: LIB3062-019-Q1-K1-G8
cttcggggttatctgtcagcctctcacacagttattgaagaaaggtgtgcacttcagttgnacgtctgaacatgacaccggcttttccaccctcaagcaagctcttacgtcggctcctgtgttatcattaccagattttgcttatcccttcacagtggaaacggacgccagtgcagtcggtattggagctgtattgatgcagcatgggcacccagttgcattcctcagcaaggctttgggccctaagacccgtggtctctccacttatgaaaaggaatacatggcgattattgtcgcagtccagcagtgacgttcctacctncaacatggcgaattcacaatcctnacggaccacaaaaggcctactgaactgaacgagcagcgcctgcacacgccctggcacacataatctttaccaaacttttgggctt

SEQ ID NO: 42030 - DNA, 282 bp, Zea mays
  Clone ID: LIB3062-019-Q1-K1-G9
tacattaccactgcttacatgccctacatcttcaacttcatctcaattctctgacaatgttagctcagactcataactctcactctctcaaatacacttctatccctcgagaagcctatcaactactttagcatcatgaaccacgaatagatcccatttcgtgatgctaacacttactacgtcttaaagtcctacagtttattaactgaccatgacaaagcttatggacatctgaaagatctgcctaaaataatcttatctatctacaattcttacattcac

SEQ ID NO: 42031 - DNA, 423 bp, Zea mays
  Clone ID: LIB3062-019-Q1-K1-H1
ctcggtccctcctcgtcgttctcccgtgtccgccgtgcactgtctgtctctggtggcggcgactgggcgggctgcgccgctgccctacgccaggatcccaggctgcatcttccgtacgccaggagggcctagccgcaggttgggtgggaggcagagatgagccgggggccgtcgccggagccgctggatttcttcatctggactgtgcaggatgtatggttatggctggaggaaataaatcttggaagctaccgccaggcttttgaagaaaatggtggccatggagagtatctagaaagcctgtcggtgttcaccactgagcagattctacgctttataagacgatgccatatgaaatggggagattttatcaccctctgtaaagagttgagacgcatcaaagttgcctgcctgaaaggggag

SEQ ID NO: 42032 - DNA, 386 bp, Zea mays
  Clone ID: LIB3062-019-Q1-K1-H10
gcgaaactgcttgaactgtaatcgaccctactccaaaccaccggacctacaccgactccgatgcccatggcgccgtgctacctgcgctcctctcttagaccctgccggcgtcgacgccgaatcgaatgcgatcatgcatcacgaccccaaccccttcgacgaaggcagcgcccatgacaaccccttctcaaatggaggagccggaggctgcaagcatcagtacggcttccggccgactgagcccgtcaggttcggcggcgctagcatgggcgacgccgtcaatgacgtcccgctcgagaccatggcggactctcggaacaaggtgaaggagctctcatcgtgagaatcagatctgaatcagcaagaggcggatatcacgaggaggg

SEQ ID NO: 42033 - DNA, 347 bp, Zea mays
  Clone ID: LIB3062-019-Q1-K1-H12
gacccactcgtgcgatacatcttccagaactaggcaaaagctcttcaaggctctcaagttctacaactctctgcggggccatgggcaccttcaagaagggggccgtcctagcgcttcccacggtcgccaccgaccacgacctcatcgtcaatgccaactagatagcctcacgccccgacattccaccacgtcactgtcccccgactcaaaaccctcgtcgccgacatcctcagtttcagttcattacgtatatccagtattagctaccatctcttcgcctgtacgatgacaccgcttaattccctctattaacccagctctcgtggagatttccccccgacgcatta

SEQ ID NO: 42034 - DNA, 440 bp, Zea mays
  Clone ID: LIB3062-019-Q1-K1-H3
ggagaagttgaaaggcgtattgctacacagctcttgactctgattgatgggctcaagtctcacggacatgtgattgatatgggtgccaccaaccgtccaaacagtatcgatcctgctcttaaaaggttcggtacgattgatcgcgagaatgatattggtgttccatatgaagttggccaccttgacgttcttcggattcacacgaacaacattaagctggctgaagatgttgacttgaagcttattgctaacgatacccatggttatgatggtgctgatcttgctgccctctgtactgaacctgctcttcaatgcattcgtgagaagatggatattatagaccttgtagatgagaccatagatgctgagatactgaactctatggctgtctcaaatgatcattttaagactgcacttgggacaagcaacccatctgctct

SEQ ID NO: 42035 - DNA, 428 bp, Zea mays
  Clone ID: LIB3062-019-Q1-K1-H4
ctggtctttgagtcgtcaacctatgggaaagtccttgtgcttgatggtattgttcaattgactggtaatgaggaatgtgcgtaccacgaaatgattactcacctcccactctgtgcaattccatcccctaaaaaggttgtggttattgatggtggtgatggaggtgtacttctagagatttccagacacagttcaatggactctattgacatatgtgtaattgatcagctggatattgatatctgcaaggaatacttcccacattaggctgatggatttgaagatgctcgtggtcaacttcatgttggtgactctgtggagttcttgataaatgcttctgaagggacatatgatgctatcaatgctgatttatctgacccaataggtcctgctcatgaacatgtggagaatcctctttttgagaccat

SEQ ID NO: 42036 - DNA, 439 bp, Zea mays
  Clone ID: LIB3062-019-Q1-K1-H5
gagcttgtctctgatgacgagtggcttaatggtgaattcatcacaactgtccaacagcgtggtgctgcaatcattaaagcgagaaagttctccagtgctctctcggctgctagctctgcttgtgaccacattcgtgattgggttcttggaacacctgagggtacatttgtttccatgggtgtgtactctgatggttcatacggtgttccttctggactcatttattcattcccagtaacatgcagtggtggtgaatggaaaatcgttcaaggcctcccgattgatgagttctcaaggaagaagatggatgccactgcccaagagctgacggaggagaagacgcttgcttactcatgcctcgagtaaattctaccacacccagagagcaattgccaccccaatgttttgaataaaaaaagaaactccaactcgattcata

SEQ ID NO: 42037 - DNA, 374 bp, Zea mays
  Clone ID: LIB3062-019-Q1-K1-G10
gtagatggaagcaagcggcggccacggcctcgaccggcagcttgtcaccgtaacagcaggggagggggaggagccgccgatctgacctgttcctacttctacttcctagttgcgctcgtgtgccgtgaggcgggagctctggaggccatggagagggagccggcggtcgatgagtgaggacgactaggaggaggatgaggtggcatgcgagtgctgcggcttcacggaggagtgcacggcgccgtacatcgagggcgtgcgcgctcggttcggcgggcggtggatatgcgtgctgtgcggtgacgcggtgggcgaggagctggggctcgcggtgaccccagccatctcccccggctaggcgctggaccgtcacg

SEQ ID NO: 42038 - DNA, 437 bp, Zea mays
  Clone ID: LIB3062-019-Q1-K1-E5
cttcacaaacgccggcgcaaactctcgcccgagcccgacagatcttcaattccccattgcgccggccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgctgatctagaacccactgtgatcgatgaggtgcgcactggcacgtaccgccagctcttccaccctgagcagctcatcagtggcaaggaggatgccg

SEQ ID NO: 42039 - DNA, 446 bp, Zea mays
  Clone ID: LIB3062-019-Q1-K1-E6
gttcatcactgataccaaggccgctattgcttaaacttacaaccgcacagattcagaatttctgaaagcggatagcactcaaactcgagatgctggctcaactgcctcaacagctattattgtaggtgatcgtttgcttgttgcaaatgttggagattctagagctgatatttctaaaggagggcaggcgattgcggtttcaagggatcacaaacctgatcagacagatgagaggcaaagaattgaggatgcacggggctttgttatgtgggctgggacatggagagtgggtggcgttctcgctgtctctcgagcatttggtgataaactcttgaagccgtatgttgttgctgaccctgaaatcaaagaggaggtggtcgacagcttcctcgaattcctcatacttgctagcgacggactcttggatgttgtcactaatgaggaaa

SEQ ID NO: 42040 - DNA, 447 bp, Zea mays
  Clone ID: LIB3062-019-Q1-K1-E8
gcaagatcttatcctgtataaaagtcggtgcgagaataggctgaatgagattacagaaagggcgtcctctgataaacgcgaggtggaatcattggctaagaaatatgaagagaagtacaagcaagtagctgagttagcttccaaactagcagttgaagaagctgcatatcgtgatgttcaggagagaaaagttgagctgcatgatgcactgattaaaatggtacaaggtggaagtgttgatggtttacttcaggttcgagctgatcgaatccagtatcaattagaagagatggaaaaagctcttagtgaacggtgcaaacactttgaacttaaattcaaaccatctgcatcagttgagcttccttccggttgggaacctgggccacaagagggactcattgagtgggatgaagactgggataaatttgaagatgaagggtttagtat

SEQ ID NO: 42041 - DNA, 442 bp, Zea mays
  Clone ID: LIB3062-019-Q1-K1-E9
gttcgtttgcggatgatagtaatgtttattactgtgtgggaactgcatatgttatacctgaagaaaatgaaccgagcgaaggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaaatcaatatccttgctggtgtataagcatgaggaaagcgcgattgaagagcgtgctagggattacaatgcaaactggatgactgcagttgagatgcttgatga

SEQ ID NO: 42042 - DNA, 443 bp, Zea mays
  Clone ID: LIB3062-019-Q1-K1-F1
cgtccgccgtctccgctccggttttcgctctctcgctgccgtcctaggtttggagccaggtcaccggcgctaggagggcgtgaaatcgagtcgacggtcggcactcggcactcacgcgttctccacctactgctggcgctcctgtgaggcgacgccggaccggccaccccgcatgcgaacagcgcacggaccggccaccggtgtgactcctccatccaaggcttcagctccagacggagccgccccgccaatcgccgtccgccgaaccgcctaggaatttggtttcctcatctaaagttactgcattatattccatagaaatggctatggggttgattaatgctaatcctataatccatgagaaaaaagaaagacgcattcgacaggcaccagagaccacagatgaaaatgcggcagagtccatagaccagctggaaatattt

SEQ ID NO: 42043 - DNA, 223 bp, Zea mays
  Clone ID: LIB3062-019-Q1-K1-F10
ctcacactcgcgaactccatttcgatcacattctaaatcaacgcattctcgtttatgtcctccagcattctctcagggtcagggccaatatcacaattggaaccaatgaaagacgcagcatcggaagtactctctcacgaatctcctcccataatctcctcgctacatgcgctggccacgctcgttcctttcctggcctacattcacgctttacctttgctcc

SEQ ID NO: 42044 - DNA, 418 bp, Zea mays
  Clone ID: LIB3062-019-Q1-K1-F11
acggaaaaacttggagctggctctgatggaagggtgtcttctgcagtacttaaggatggatctgtagttgaagctgatacagtaattgttggtataggagcaaaaccagttgtcagcccgtttgaagctgttggagttaaccctaaagttggtggaatagaggttgattccttgttcagaactagtgtacctggcatctttgcaattggagatgtagcagcgttccccctgaagatgtacaatagaattgctcgagtggaacatgtggatcatgctcggaagtccgcacaccactgtgtagagacgctcctaacattccagacaaaagcgtatgactaccttccatacttctactcgagggtttttgagtacgatggaagttcgaggaaagtctggtggcagttttatggcgacaatg

SEQ ID NO: 42045 - DNA, 415 bp, Zea mays
  Clone ID: LIB3062-019-Q1-K1-F12
gctcgatcctagcttctcttccaagaagcgcagcgcccatggccatggccacgcaagccggcgccggcacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcctaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagca

SEQ ID NO: 42046 - DNA, 448 bp, Zea mays
  Clone ID: LIB3062-019-Q1-K1-F2
cgtccgccgtctgcgctccggctttcgctctctcgctgccgtcctaggtttggagccaggtcagcgacgctgggagggcttgaaatcgagtcgactgtctgcactcggcactcacgcgttctccacctactgctggcgctcctgtgaggcgacgccggaccggccaccccgcatgcgaacagcgcacggaccggacaccggcgtgactcctccatccaaggcttcagctccagacggagccgtcccgccaatcgtcgtgcgccgaaccgcctaggaatttgttttcctcatctaaagttactgcattatattccatagaaatggctatggggttcgttaatgctaatcctataatccatgagacataagatcgacgcatgcgacaggcaccagagaccacatatgataatgcggcagagtccatagaccagctggaaatatttgatca

SEQ ID NO: 42047 - DNA, 440 bp, Zea mays
  Clone ID: LIB3062-019-Q1-K1-F3
ggtccggcgtctccgctccggttttcgctctctcgctgtcgtcctaggtttggagccaggtcaggggcgctgtgaagtcttgaaatcgagtcgaccgtcggcactctgcactcacgcgttctccacctactgctggcgctcctgtgaggcgactccggaccggccaccccgcatgcgaacagcgcacggaccggccaccggtgtgactccttcatccaaggcttcagctccagacggagccgccccgccaatcgccgtccgccgaaccgcctatgaatttgttttcctcatctaaagttactgcattatattccatagaaatggctatggggttgattaatgctaatcctataatccatgagaaaaaagaaagacgcattcgacaggcaccagaaaccacagatgaaaatgcggcaaagtccatagaccagctggaaata

SEQ ID NO: 42048 - DNA, 410 bp, Zea mays
  Clone ID: LIB3062-019-Q1-K1-F4
agcaaaaacagatgaatggaaggctgaatctctccatctcatcttcaggcagagaaaaagatcgcaaaggcgcacaaaggactatgtcgaggccatatcagatactgacctataactcgacatccatctacttatcacgcttctatcatgcgacgccggaccgtacaccacacattcgaacagcgcacggaccggccaccggtgtgactcctccatccaaggctttagctccatacggagccgccccgccaattgccgttcgtcgaaccgtctaggaatttgttttcctcatctaaagttactgcattatattccatagaaatggctatggggttgattaatgctaatcctataattcatgataaaaaacaaagactcattcgacaggcaccatataccacagatgaaaa

SEQ ID NO: 42049 - DNA, 375 bp, Zea mays
  Clone ID: LIB3062-019-Q1-K1-F6
aattaccggatcgagcacgcgtacccttgaccctaacctctctcacattaaactttgtcttcatgaacacttacacatgggcctccagcgcaactttctacattcaggccgtctacaatacccaaaccaataatcagccccatctaaactcttagatctaactctaatcttcatacaatctagctacatcccttcttcacaactactctacctaacatcattcccactaaacatgtaccagcaaacccaattaagatctacaatataatacctaatctacaacatctgcaccatcctactaattctcaacaccaatgtgtagaaaccctactatcataccagacaaaaccttatgactaccttacatacttttac

SEQ ID NO: 42050 - DNA, 377 bp, Zea mays
  Clone ID: LIB3062-019-Q1-K1-F8
cgggttcgtgaggttctccggggttcggtttcgtgggtgagcggatcgagatggcggcgtcggatgttgagtaccgctgctgcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggatgcgatgcggaacgccatcgagggcatgaacggcaaggagctggacggccgcaacatcaccgtcaacgaggcccagtcccgcggcggccgtggaggcggcggcggcggcggtaacggtggtggccgtggagccggcggttacggcgtt

SEQ ID NO: 42051 - DNA, 449 bp, Zea mays
  Clone ID: LIB3062-019-Q1-K1-F9
ctgccgaccctccgccgcctcacccccacctcctccctccgcgccgccgccgccatgtcctcctcctcgtccgctgtggccgcgccgatcgagcacttcgtgctcttcaaggcccgcccggaggcggtggcctcgggcgccgcggcggcgatggtctcctcgctgcaggcgctggccacgctcgtcccgggcctggcctacatccacgcgggaccggtgctccgcctccggtccccggccgcggaggcgctgggccccacgcacctcctccacacccgctacgccaccaaggaggacctggcgtcctacgcggcgcacccggcgcacgtggccgccgtgcaagggcacgttctccccaacgcgctcgacatcaccgccgtcgactgggtcaacgccgcgccgctcccgtcccccgcggcccccggcagcgccgtgcgcctcacgctggc

SEQ ID NO: 42052 - DNA, 455 bp, Zea mays
  Clone ID: LIB3062-019-Q1-K1-E4
agttcatcactgataccaaggccgctattgctgaaacttacaaccgcacagattcagaatttctgaaagctgatagcactcaaactcgagatgctggctcaactgcctcaacagctattattgtaggtgatcgtttgcttgttgcaaatgttggagattctagagctgttatttctaaaggagggcaggcgattgcggtttcaagggatcacaaacctgatcagacagatgagaggcaaagaattgaggatgcagggggctttgttatgtgggctgggacatggagagtgggtggcgttctcgctgtctctcgagcatttggtgataaactcttgaagccgtatgttgttgctgaccctgaaatcaaggaagaggtggtcgacagctccctcgaattcctcatccttgctagcgacggactctgggatgttgtcactaatgaggaagctgttgcc

SEQ ID NO: 42053 - DNA, 393 bp, Zea mays
  unsure at all n locations
  Clone ID: LIB3062-002-Q1-K2-E9
gcggttctgaagaccggcaacaggatgaatgttggcacaaaccgtggggacgcacacgcgttcaagctcgacactctgctgaaactggtggatgtcaaaggcaccgatgggcacacgacccttctgcacttcgtggtacaggagatgatccggacggagggcgcccgtgtgtccgccagcacccagacaactccaagaacccaggcaaaccctctacgagaggagctggagtgcaagaggctaggtctccgggtagtgggcggcctcgccggcgagctgggcaacgtgaagaaggcggcggccatggactcggacgtgctgagcagctacgtcgccaaactcgcgggagggatagagaaagtgaccgangtgctgcggctgaacgaggagctc

SEQ ID NO: 42054 - DNA, 440 bp, Zea mays
  Clone ID: LIB3062-002-Q1-K2-F1
gtggagaagatcaagttccaccacttctccttcgaggagaccaccgccacgctccaccggaagctcgagaacaagaacgacttcgacctcggcctcaacctgctcgagtacgagatgtggctcggcgacgacagcatcgcctccgccgagctcacacagaccgtcaagatcgagaagcaggggatcaccaggatgcaggtgcccttcagcttcaggcccaaggacttcggatccgctgtctgggacatgatcaggggaaggggcacgggatacaccatcaagggaaagatcgatgtcgacactcccttcggcaacatgaagctgcccataagcaaagagggtggaaccacccgcctcaagaaggaggacgacgatgacgacgacgacaactgaagtgaggactgctggggcgctgctgttacctttcacgaaacgcagcg

SEQ ID NO: 42055 - DNA, 346 bp, Zea mays
  Clone ID: LIB3062-002-Q1-K2-F10
gtccacgagtgcatattccaatgccagtccgatcgtgagctcagctcatctccggtcgtcctctccccgcacgcaccaccaccagcagcagtccatcaccatgtgcggcgccctgctcatcacgctgatcctcgcggccgtgcccctctccttgagcggcagccgcggtgcgcacccgggctactcggactacgactagagcgcgtagcacagtggacgcgtgcgcggagctgatgcgacgaatggaggagcgcggtcccagctggcgcatcatcatcgacatcacgcacgcaatcgtgccggacctgccagcgttcgccacgatggctgtcgcggcgcccatgct

SEQ ID NO: 42056 - DNA, 404 bp, Zea mays
  Clone ID: LIB3062-002-Q1-K2-F11
gttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctg

SEQ ID NO: 42057 - DNA, 352 bp, Zea mays
  Clone ID: LIB3062-002-Q1-K2-F12
gtcgagctaaactaaataacaccatctagcaactctctctttcatcacactgatgtgggtatcttgttctactatgaggccatgttggacatgtgtggccgattcctggacattgagctcctaatgtacaccaacctcaacaggcttgtgtccaaagtcatgtaatcacttactgactacatgaagtgcgatggtgctcctaacgtggatgataacgaggatcacaccaacctagtaccgtactccaggatacatgtcatgctttctacgtacgctccagtcatatctgatgagaaggcctactacgagcagatcaatgacgttgatatcaccaacagtgccttcgagctat

SEQ ID NO: 42058 - DNA, 386 bp, Zea mays
  Clone ID: LIB3062-002-Q1-K2-F2
ccgcgacgctctctctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggtccccagggaggcatgctcgtcttcggcttcgggtccatacccaccggccccgaagagcaccccatcaagttcttccaagcattccattt

SEQ ID NO: 42059 - DNA, 422 bp, Zea mays
  Clone ID: LIB3062-002-Q1-K2-F3
cacggatgggtcagacgaatgggcgatctacggcggaaccggggtgttcgccatggccaccggtgtcatgaagagaagaaaccttgccgccggtagcaacgacgggaactctgacgagcttgccctggaagttttctgcccggtgtttggcgcatcacagcaaccaattagcaagcagcaggactccatctcctccgtcaccaagatcggactatggggcggacagggagggtcggcacaggacatcacggcagagcagccaccacggcgtctgcacagcatcaccgtccgcgctggcgttgccgtcgactccatcgagttcacctacaccgacgacgctgggcagaggcgcactgctgggcggtggggtggacttggcggcaatgttcgaacgatcgaccttggcgacgcataggatgtca

SEQ ID NO: 42060 - DNA, 387 bp, Zea mays
  Clone ID: LIB3062-002-Q1-K2-F4
ccggattcccgggggcttctcaagcatggatggagtgggtaatgaagaagcggaaagcttttgaccaacgtggtgacatggctgtggctgcttgggctgagcaacagcaacgcgaaatgacgctacgggcacggcgtctctcacgctcaaaggttgaccctgaggaagaaaggaagctatttgccaaggaaaagaaggcatctatggaattctacagcacaactctgaagagacatacccttgtgttacggaagagggatattatgcgcaagaaggcagaggaggagaaggataaggagatcagtagacttctaaccgccgaaaggccttgagttggatacagatgaagattaaaaccagaattttcttgggtaacgcttttgatac

SEQ ID NO: 42061 - DNA, 358 bp, Zea mays
  Clone ID: LIB3062-002-Q1-K2-F5
gtcaaatccttcagcttcaatatttttttttggttgcaactagcgtgacctcatatgccgtttatcacaggctctacaatggtcaccacgatctatcgtccatatcatcgcattgctcaacttctacacacatctcttcccatatatctatcaaatccttctacgatcgtcactcattgactgcactttactcacatacatacccgctatcgatgtcctctcacaacccaatctacttatcaactcgtcaacacaattagatcatacccacttcttctcagtactctacttatctgcacctggatcctatctcgatgaatataacacatatctcaagcactcaactagattcatgttg

SEQ ID NO: 42062 - DNA, 397 bp, Zea mays
  Clone ID: LIB3062-002-Q1-K2-F7
cgccactcacgcctggaagcatctggaggcgtggcacggcagccgtcgcccgccgcaccagcagcgaactgcgtcccggtgcccgcggcggcgaagcacaggagagaggcggcgagtgaaaccgatgacgcagccgatggatccgcccgacgtcgagatggagatggagcccgcgccccagcctccggctccgacagcggtcggggaggggtggagcatgctgtcgcgcgcccgcgggctgctcgaggagggcaaaccgtccctcgctctgcaggcggttctcttggccataagatctcaaggcggtgaacaagctctcatgcagacattgaaccgtgcacgtgaactctatgcacagagattgcaggccagtcctagtgttgatgagcttgcctct

SEQ ID NO: 42063 - DNA, 435 bp, Zea mays
  Clone ID: LIB3062-002-Q1-K2-F8
attggattgcattttccagcatatcccagtaaaggccgctgcgccgagtgggaagaaaaaggacaccgagctagcgcctgaagcagaagctgctgccaaagcttcgaagaatgccatagctacttgttctttgcttccgtacttggagtctctttggcccatcgggactttgcagatggcctcacttgcaggctcactgtacgggatgatgattaggctgctgccttcttttgtgcgcacatggtttactaccttgagagaccgttcattgtcatactcaatcgagtccttcaccaaacaatggtgcagccctcctcttcttctagatgagttttctcaggttaaggagtccgtatacggcgatgagaatttctcggttagcgtcaacaggtcggctttcgagatcgttgctacatacaaaaaggaggagacagg

SEQ ID NO: 42064 - DNA, 328 bp, Zea mays
  Clone ID: LIB3062-002-Q1-K2-G1
gtcatatggctgctgttgtgaaggctaaacctaaaactgaaccaccgactgacagaactgaaccagatagggaagcagttgggccagcacagttgactgataccttgttatctaatgctgaagaaagtgcagacaatgtggttgtggatatcgaaagaccacataacaggcagattaatgggatcccagcatctaacgcagtgcctaggtcatcagaggatattgaggatggtgaggtcgttggaatcatcacacttgaggatgtatttgaagaactcctacaggaggaaattgtggatgagactgataaatatgttgatgtccataa

SEQ ID NO: 42065 - DNA, 343 bp, Zea mays
  Clone ID: LIB3062-002-Q1-K2-G10
atctacctgctcctacgcctacttctggatccaggcaagccagggatcgctatgttggacttgtaggagcacgacttagaatcgaaagccgacgccggagcgtccaagacctacgctcatcacgctggtactgtccgtaagaacggtttcatcggcatcaagaaccggccctgaaaggttgtggtggttcctacatcagagactgttcaccatggacatgccaaatgccactttgctgccatagacatattcaacgggaaaaagctcgaagatattgctcattagtcacacaactgtgatattacctatgtgaaccgtactgagtaccagctgattgatctat

SEQ ID NO: 42066 - DNA, 412 bp, Zea mays
  Clone ID: LIB3062-002-Q1-K2-G11
gcagggccgtttctccgcgtgacttggggcgtcgtcgtcgagctttctccggccgagggcggcgcgaccggacaaccagcgtgagcgcgaccggcgacatgactcgtggcaaccagcgtgaccgcgaccgtgagcgcgcggcggcgcggaagcccaacgccaagaactcccactacgggcttaccccggagcagcgccgagagagggacaagaaagctctggaggagaaggctggcaacatggcgcagcatgcagctgccggtggcaccgggacctccacggacaacatcatgaacaaggcacgtggcaagaagtatgaggcagtggcgcgccgacacctatgtacgatcaatcgatgcctagagcttgtaacttgttagcatacttgtaggtgctatgctagctgggtcat

SEQ ID NO: 42067 - DNA, 390 bp, Zea mays
  Clone ID: LIB3062-002-Q1-K2-G2
gaaatttggccaatcttctgtttttgttacatccacacttctcgagaatggtggaaccttgaagagtgcaagtcctgcttctcttttgaaagaagctatacatgtcattagttgtggttatgaagacaagacagactggggaaaagagattggctggatctatggatcagttacagaagatattctaactggtttcaagatgcattgtcatggttggcggtcaatttactgcatacctaaacgggttgcattcaaaggttctgcacctctgaatctttcagatcgtcttcaccaggtgcttcggtgggctcctgggtctattgagatcttcttcagcaatcattgccctctttggtatgggtatggtggccgtctgaaatttttggaaag

SEQ ID NO: 42068 - DNA, 447 bp, Zea mays
  unsure at all n locations
  Clone ID: LIB3062-002-Q1-K2-E7
ggttcctggggtcggcgggacacgacccgctcttctactcgcaccactccaacgtcgaccgcatgtggcacatctggtcgaccaggctcggcggcgggcagggcatcacggaggcggactggctcgacaccagcttcgtcttctacgacgacgtcaagagcccgcggaaggtgcgcatcaggttccgcgacgtcctggacacgcgcgacctcggctacacgtacgacgccgagtccgacaaggacctgccatggctgcgctgcaagatctcgtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggngaaggagcagctgctggtgatcgagggcatcgagt

SEQ ID NO: 42069 - DNA, 153 bp, Zea mays
  Clone ID: LIB3062-002-Q1-K2-D2
atgggacaatgccaagaagtacatgcaccgcctaaggcgtcttcagaaacacgacaatgagcgatcaacagatatattgacattcaataaagagcgcatcaatcataatatgcaagagagaggtatggataaagactttgtaaaaggtatttg

SEQ ID NO: 42070 - DNA, 338 bp, Zea mays
  Clone ID: LIB3062-002-Q1-K2-D3
aagagacaatcccgataaatacatgcaccaagcccgacgtccgcgatgctgctagagggggtgctcttcatgagatcaaggagcgcatcaagaagtccaaggatgagatccatctgaaggtcaaaagcaagggcgaggcgtccggcgaggaatacggcaaggaggaggaggtcgaagtagagattgaggccaagtttgttgagaaggaagaggtcaaagacacgggtgacggtgcagcatgaaagggtaccaagaagaaggatacaaaggagaaagacaagaacaagaatgaaggtggtgacgattcatggaaggcagaggaagacaagaagggtaaa

SEQ ID NO: 42071 - DNA, 291 bp, Zea mays
  Clone ID: LIB3062-002-Q1-K2-D4
aagagacgatccagaaaaatacgtctattaagcccgaggtccgcgatgctgctagagggggggctcttcgtgagatcaaggagcgcatcaagaagtccaaggatgagatccatctgaaggtcaaaagcaagggcgaggcgtccggcgaggaatacggcaaggaggaggaggtcgaggtagagattgaggccaagtttgttgagaaggaagaggtcaaagacacgggtgacggtgcggcatgaaagggtaccaagaataaggatacaaaggataaagacaagataaagaatg

SEQ ID NO: 42072 - DNA, 426 bp, Zea mays
  Clone ID: LIB3062-002-Q1-K2-D5
cagaagcagttctccaggcaatagactagctagatgcgcatcaccaaagagtagcttgcgtctagaacgaagaaacaccctccactacatggccgcgctcagttcttgtgttgcttctggaggcctggcacttcaggccacccttgtggtttctcctcctcgccgtcgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttacgagcggccatagctgcagcagtgcctctttacagaaggttcatagcattagaaga

SEQ ID NO: 42073 - DNA, 405 bp, Zea mays
  unsure at all n locations
  Clone ID: LIB3062-002-Q1-K2-D6
ctcaagcactggaagacaagtacggtggctttttaggcgacaggattgtaaaggattacacagacttcgctaaggtgtgctttgagaacttcggtgacaaggtgaagaattggttgacctttaacgagccacagacatttacaaccttttcgtacggaacgggagtttttgcccctggacggtgctcaccaggagaaaaatgtgctcagcctattgctaactcactcaccgaaccatacattgctggccacaacatccttcgagcccacgctatgactgttgacctctacaacaagaattacaagggtacagacggccgcattgggcttgcgtttgacgtaatgngtcgcgtgccatatggaaatacatttctcgatgaacaggcccaagaaaggtccctcgatc

SEQ ID NO: 42074 - DNA, 440 bp, Zea mays
  unsure at all n locations
  Clone ID: LIB3062-002-Q1-K2-D7
cgcggagctcgctcgtgcggtcggatccacgggcatggcggccggtcagttcctcgatctggccggcgctaccgcccttggtgaggccgaggtcatgcaggtcctgacgaagaagttcggcgagatggccgagtgctccgccgcctgcggcgccatgctcggtggggccgggcccgacgaggaggccgcgttgcggcgctacggccgcaccatcggcgtcctgtacgagctcgtggacgacatccggagcgcatcgggaaacggcaagatgaggagcaacgccagcgtcctgcgctcgctggggatggaccgcgcgctcggcattgtggaagagctcaaggctcangccaagacagaggctgacagggttctcggataagtacggcgatcgggtgctgcctntatacagcttcgtggactacgcggtggagagagggttt

SEQ ID NO: 42075 - DNA, 402 bp, Zea mays
  unsure at all n locations
  Clone ID: LIB3062-002-Q1-K2-D8
cccacgcgtccgacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactaccgctgggacaccgcggngctgtccgtcgacccggagactttcgccaagaaccgcgagctggaagtgatccactgccgctgggccatgctgggcgcgctcgggtgcgtgttccc

SEQ ID NO: 42076 - DNA, 400 bp, Zea mays
  unsure at all n locations
  Clone ID: LIB3062-002-Q1-K2-D9
gccgactcccaactagcccctcacgcgctcatcggcgccctgtcgagtcgagcccgcatctcggccgatcgagagcgagcgcagccgcgcgccggtgagagctttgcttgctttcggtgttctgtaacgacttaacgaacgacggcaggcggtagataaaggcgcgcgatgtgcgacgcggcgccgaggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcgggccctgcgcggcccgctcgccaggaccaacttccccgcgctcgccaccacctcccgcncgcccgcgcccacgtgca

SEQ ID NO: 42077 - DNA, 333 bp, Zea mays
  Clone ID: LIB3062-002-Q1-K2-E1
gttgccaggaacagaaagaggcgatggaagtgaagcgtgactcgcgagactcctcgtggagaaatagccagtcaagtgaatagtgactaaagccaggagtcatcttgaggcgaccacctagcggtgtgacgagctaactcttgatgcaattgtcattgtagcagcacttcctatatacatggattaccattggacatagacagatgttggaactaggatggtgccatgcgtacatatgttggacctaatgcagtaatggaccgtcggccaaattcaatcgcctctaggtaccacaccgcctaccgcgtctaaggcaaggcttgtcgcagtagc

SEQ ID NO: 42078 - DNA, 428 bp, Zea mays
  unsure at all n locations
  Clone ID: LIB3062-002-Q1-K2-E11
ctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccggtcgcgtgcccatc

SEQ ID NO: 42079 - DNA, 407 bp, Zea mays
  unsure at all n locations
  Clone ID: LIB3062-002-Q1-K2-E2
cagagatcctagggaaaaattagatcggggtgaaaggcgtcgtggggaagatgccattgagagatcaacagatagattgtcggacaggagagaacgttccattgaaaggatgcaagagagaggtacagataaagcccttgaaaaaggtagagaggatagaaataaggatgagaggaataaagttaaatatgctgaaccttcggtggaccggacacattcttctgatgaacgattccgagggcaaagtttgccaccgtccccacctattgccgcaagttttgtaccccaatcagttggcgccaaccgacgtgaagaagatgctgaccgaaggngtgggagctccaggcatgttcaaaggtcatctnctaggcacgatgagaaagaaaggangcagtcagaggaaaata

SEQ ID NO: 42080 - DNA, 436 bp, Zea mays
  Clone ID: LIB3062-002-Q1-K2-E3
cagagatcctacggaaaaattagatcggtgtgaaaggcgtcttggggaagatgccatggagggatcaacagatagattgtcggacaggagagaacgttccattgaaaggatgcaagagagaggtacagataaagcccttgaaaaaggtagagaggatagaaataacgatgagaggaataaagttaaatatgctgaaccttcggtggaccggacacattcttctgatgaacgattccgagggcaaagtttgccaccgtccccacctattcccgcaagttttgtaccccaatcagttggcgccaaccgacgtgaagaagatgctgaccgatagggtgggagctccaggcatgttcaaaggtcatcttctaagcacgatgagaaagaaaggaagcagtcagaggagaatatttgtcattttaggatgatgggaaacaca

SEQ ID NO: 42081 - DNA, 189 bp, Zea mays
  Clone ID: LIB3062-002-Q1-K2-E4
gtcaaatacttcatctaaagtcgatcggtatgtaaggcatcagctgtaagatatcatcgggggatcaacaaatagcttgaaccacagcaaagaacgcatcattgataggattcaagatagaggtatggacgtatcctttgataaacgtattgacaatactaatagcgctcatacgagtaaagctaaata

SEQ ID NO: 42082 - DNA, 435 bp, Zea mays
  Clone ID: LIB3062-002-Q1-K2-E5
gccacctccttccccttcgatatttttttttggttggatctagcgtgacggcaaagacggtgtatcgaagggtcgacaatggttacgacgatcggtagtccatagcagcggcgggcgcaacttcgacccggttttcttcccatatatctgtcaaatccttctccggtcgccctccatcggcagcaatttccgccatagataccggcgatcgagggcctcggacaacccaatcgacggagcagcgcggcggcaggagagggcaaacccttttcttctcagtactctacttgtctgcgcctggatcccctctggaggaagataagacatgggtcaagcactcggcttgattcaagtggatcaatcgacagtagccatcaaggaaacttttgggaagtttgacgaggtcctagagcctggatgccacttcttgccatg

SEQ ID NO: 42083 - DNA, 376 bp, Zea mays
  Clone ID: LIB3062-002-Q1-K2-E6
ctcaaaggaatcgtgagccgtcccgccgctcgtcagccatcctctgcatctcggtgtcgcacactccgcatacgcacctacgagagtccagtgacagctagctagcgagcgagcgaagccatggctgtccgcaccctggcatcgaagaacgccctatccttcgcgctcggcggcgcggcccggccgtcggcggcgtccgcgaggggggtgacgacggtcgcgctcctcgacctctactacgacttcggcgcgctggagccggccatctcgccggagatcatgcgcctgcaccaccagaagcaccacgctacctacgtcgccaactacaacaaggcgctcgagcagctcgacgctgccgtcgtcaagggcgacccct

SEQ ID NO: 42084 - DNA, 403 bp, Zea mays
  Clone ID: LIB3062-002-Q1-K2-D12
tttcccccacgtgcgccgccgcgaccttcctcgatcccatctcccaacgcccccgcctcgcctcgggatcccgccgccgctccatctgcctttgctcccccacccgcaggcagcgagcgacagcgacggcgagggatggccaaggccaggtcgttggcgaagcagaagcaggcgcagcaatcaaacggcggcggcggccacgcgctgtcctccaagctcgcccggtacctcgacccggaggcctacttggacaaggaccaactgctggacgcggtgcactggatccgccaggcggtggggctcatatgcggcctgctctgggggagccgccccctcgtcggcgccgtctggatcgcactatctatggccatctcgactggcattatctattggtactacacct

SEQ ID NO: 42085 - DNA, 368 bp, Zea mays
  Clone ID: LIB3062-002-Q1-K2-C1
ggtcattcctgggcccggtgagaagccaatgatagttggtcagcacaagggggaggagaagcagtttgcagccgaagagatctcctctatggttctcatcaagatgcgtgagatcgctgaagcttaccttggcagcacgatcaagaatgctgttgtcacggtccctgcctatttcaacgactcgcagaggcaggccacaaaggatgctggggtgattgctggcctcaatgtgctgcgtatcatcaatgagccaaccgctgctgctattgcctatggtcttgacaagaaggcaaccagtgtcggtgagaagaatgtcctcatttgtgaccttggaggtggtaccttcgatgtctccctacttacaattg

SEQ ID NO: 42086 - DNA, 275 bp, Zea mays
  Clone ID: LIB3062-002-Q1-K2-C10
caccaccatataacaagtcaacattttcaaacattctaacactactactcgacagcgtcattatcataaatctgtatgaaacaagaacaattattcttacttatacaaatatcaaccactaaatcatccatacttccactaatatccatactcatattatacaactgcattctaaccatattgacgtccattgcataacacctctataaatatcatcactcgtcataaaactatccaaattttcattcgatcaatccgatatctaatcacactta

SEQ ID NO: 42087 - DNA, 428 bp, Zea mays
  Clone ID: LIB3062-002-Q1-K2-C2
gcatgccgcagcgaggaacgtgatcagaatcagccagtggtgcttgtgacggggtgctcggagggcggcatcggccacgcgatggcacgcgccttcgctgcggccgggtgcgccgtcgtggccacggcgcggtcacgcggttccatgcgcggtctcgacggcgacccgcggttcctgctgctggagctcgacgtgcgctccgacgagagcgcgcgcgccgccgtggcggatgcgctgcgggagcacggccgcatcgacgtgctcgtcaacaacgctggggttcacctcgtcgcaccactcgccgaggtgcccatggagtccttccaccaggttttcgacaccaatgtctatggtgcaatgaggttaattcaatctgttatccctcacatgatggaaagaaggaaaggaacaattgtgaatgttggaag

SEQ ID NO: 42088 - DNA, 428 bp, Zea mays
  Clone ID: LIB3062-002-Q1-K2-C3
cagtaatctatgtgcctgcgacgacgactaggtgggttaccgccggcgcgccgccgccgggggccccgtactactgcaggtgcgaggccttcatcggtatcttaacaggcgacgagcaaccagtctgcactctacgatggcggcgcctgcggccacggctcccgcggcctcccggtgtctctccggtgccaagtcgtgctgggctgctgagcggagctccagctcgtttgccgtctcggcgccttctactggcctccggcaaagtaggagccgcatcctcagcgtccgtgccaaggttgccactggcgtgcagagagccagcactgaggatgatggagcgaaaaggccgtggaagctcagtgatgctcgtcttgtcctggaagatggttcaatgtggagggccaagtctcttggcgcttcaggaacac

SEQ ID NO: 42089 - DNA, 349 bp, Zea mays
  Clone ID: LIB3062-002-Q1-K2-C4
gcggcggagcacggaggcgaaggacgaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgagttcatggatgt

SEQ ID NO: 42090 - DNA, 428 bp, Zea mays
  Clone ID: LIB3062-002-Q1-K2-C5
gtcctgcgccacacgccgcggccgtctccgggcaggaaggaagggggcgggaagatgatgatgacgcgggcaccgatggggccgatggagggcgcggcggtggacgagatggtgcgccgcctcgtggagggcggccgaggcgggcgccaggtgcagctgtccgaggcggagatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattcctcggagactatgtcgatagaggcaaacagagcctggagactatatgcttgctgctggcgtacaaaatccggtaccccgaaaatattttcct

SEQ ID NO: 42091 - DNA, 415 bp, Zea mays
  Clone ID: LIB3062-002-Q1-K2-C6
ttctatttttctcctctcgagtagcgtggcgggcgtggacgcggcggcgatgctgcggtcggcgctgcggcggggaggggcgtccgcgaggcaggtcgcgttggcgggagaagcctcgccgagagacctcctccggatgcgcgtggcggagcgggagcgcgcgaggcggcggcgtcgcgacccgggccgcgacgagttcttcgtgcccacgccagagtcgctggcgtggctcgactcggtctccctccccatggtgctcaccgacgccgccgtggccctcttcaccaagctcctcatgatggaacatgaagctacagatcaagaaaggagagagcgcaagataaagaatagccaccctgatcaaggaacagtaaggatgctatctcgtgaagaatgggaggaggtccaagaagtc

SEQ ID NO: 42092 - DNA, 436 bp, Zea mays
  Clone ID: LIB3062-002-Q1-K2-C7
gtcctgcgccacacgccgcggccgtctccgggcaggaaggaagggggcgggaagatgatgatgacgcgggcaccgatggggccgatggagggcgcggcggtggacgagatggtgcgccgcctcgtggagggcggccgaggcgggcgccaggtgcagctgtccgaggcggagatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattcctcggagactatgtcgatagaggcaaacagagcctggagactatatgcttgctgctggcgtacaaaatccggtaccccgaaaatattttcctggtgaggg

SEQ ID NO: 42093 - DNA, 410 bp, Zea mays
  Clone ID: LIB3062-002-Q1-K2-C8
gagaaattgtagctgaagtgaaaaaaaaaacagcagggaacaatggcactatcacgaagtatgagagcatgtttgcacagtggaagacttgcacttcttgccatattggtctctggtggaattgtattgcaaatcttggcttgtgctctctataacaactggtggccaatgctaacagttctcatgtaccttatcctaccaatgcccctcatatttttcctgggttctgatacttcctccatgatgtccaatgggggagacggctgggtgaacttcacgaaattcttgacgggcgcatcaatagtagggagcatcgccattccgtcgatcctgaagcatgcgggcgtcattggatggggagccctgacgatggagctgtcatcctttgtggtctttggcgtggcaatcct

SEQ ID NO: 42094 - DNA, 427 bp, Zea mays
  Clone ID: LIB3062-002-Q1-K2-C9
ccccagttcgtgaagaggtcaaaatggtcagggctactagcttttctactcgtgtccctgaatatgatgtacctgttgttgacaaggccgtggatgctacatggaagagagagcaaccacgaaaggcaccatccgtgccccaagatgcagactcatctgtgaaaactgcatccaagccatctggccgcccctgggataagatcgctgcaaatctgatggcttgtcttatggctattgtaatgttggttcgatcaatcaaagatcttgccacaatgagattgtcatctaaaggcgggtcagaagaaagctactgtacattgtacccggactccgtccagaaagaggaattccgtcctccttcgccattccctgggttcgctgaagccgacctattcgccgtggtcttgcaaaggctgggagagcttga

SEQ ID NO: 42095 - DNA, 349 bp, Zea mays
  Clone ID: LIB3062-002-Q1-K2-D1
agctcctctaccttttccatcgctctgctctgctccgcgtctccggccgccccggcaaaagcgatacacagccatggaggggtacgaccgcgagttctggcagttcagcgaccagctgcgcctgcagacgaccgtcttctccggcctctccctcggcgactccatctggtctccggccaccggcgccggcgggcggcgcaacaacaacaccgacctactcgcggcctccgcgtcggcagccgacgccggcaagcacaacggcgtgggcctcagcctgaatgatggagggcccggactcattggctccgggaagctcgacttcggcggcagcaaggcctgccgctacaac

SEQ ID NO: 42096 - DNA, 420 bp, Zea mays
  Clone ID: LIB3062-002-Q1-K2-D10
gccgactcccaactagcccctcacgcgctcatcggcgccctgtcgagtcgagcccgcgtctcggccgatcgagagcgagcgcagccgcgcgccggtgagagctttgcttgctttcggtgttctgtaacgacttaacgaacgacggcaggcggtagataaaggcgcgcgatgtgcgacgcggcgccgaggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcggaccctgcgcggcccgctcgccaggaccaacttccacgcgctcgccatcacctcccgacgtcccgcgcacacgtgcagctacggctccaccgtcgag

SEQ ID NO: 42097 - DNA, 425 bp, Zea mays
  Clone ID: LIB3062-002-Q1-K2-D11
catcaccatagagcaatgggttcattaagaaacaatagtataggaagttttgacaagaccataagcgtaaataagtatgaaagaagaataatttctgatacgttgtcagagtttaatccatgggatgattcatattcgactgctaacaattttgctaggatgcttagggaatctaaaaataatgatgtccattgcattgcgccttcatggaaatcaggaaccgggatcaaagagtccagattttcatttgctagacaggataaccaaggaaacttgtttgattcatctctcagaaactgtggtactggtactgagcagaatttcagtttgctaccccagaattctcgaggaaatatttaccagaatggccttgcattccaatctctagagaatgaattttcaaacaataactctcctggtgtatt

SEQ ID NO: 42098 - DNA, 423 bp, Zea mays
  Clone ID: LIB3062-002-Q1-K2-B9
caaccagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggag

SEQ ID NO: 42099 - DNA, 439 bp, Zea mays
  unsure at all n locations
  Clone ID: LIB3062-019-Q1-K1-C8
gctcgaccgcacaactgcaccgaggggggaggagacctaaaaactactacatcttggagctacgcatctagctaaagatcgagaggggtaaataaggacgagtgggcgctagctagaagagcagctgcaggtactaccatcatcgtcgtcgtcgtcgtcgccaggatgaccgtcgtcgacgccgtcgtctcctccaccgataccggcgcccctgccgccgccgccgtaccggcggggaacgggcagaccgtgtgcgtcaccggcgcggccgggtacatcgcctcgtggttggtgaagctgctgctcgagaagggatacactgtgaagggcaccgtgaggaacccagatgacccgaagaacgcgcacctcaaggcgctggacggcgccgncgagcggctgatcctctgcaaggccgatctgctggactacgacgccatct

SEQ ID NO: 42100 - DNA, 291 bp, Zea mays
  Clone ID: LIB3062-019-Q1-K1-C9
gttaagaactttacttgcctgttcaagctttacgggcctatcacgctcatggaggagctgttgaacctagtggtcatctgaggccaccattgcaaccattccaaggacaaagattatctaaccgagttcaaaaagatgtttgacctcatcaaacaatacaacctgaacgggcacattcgctggatctccgaccagatcaatcccgtccgctactgcaagctgtaccgctacatctgcgacaccaacggcgccttcatgcaacctgctttctacgacgctttcaggctgacc

SEQ ID NO: 42101 - DNA, 445 bp, Zea mays
  Clone ID: LIB3062-019-Q1-K1-D1
gtacaaacatatatcgtgccctgaagtgccgtgagccagagagtaatgaactcttgtcttacatgaagattgtgtataacatctgtccgtacttgaagtttggctatatggctgccaatggggcaattgcagaggcattaagaaatgaggacaggatccatattattgatttccagattgcccaagggacacagtggataacactgatacaagcgctagctgcaaggcccgggggtccaccacacgtgcggatcactggaatagatgacccagtgtcagagtatgcccgtggtgaaggtctggaccttgtagggaagatgttgaaaagcatgtctgaggaattcaggatacctttggagtttacccctctgcccggtatttatgcaactcaagttacaaaagaaatgctggacattaggtcaggcgaagcacttgctgtcaactt

SEQ ID NO: 42102 - DNA, 393 bp, Zea mays
  Clone ID: LIB3062-019-Q1-K1-D10
gaaagaaagaaaaaaaaactaggcattctgcttgcttgcttggggcgctctagtgctcgggtgctgcgcctgcaccggtcgcgcacagcctgggaagaggcgagctgaggtctgaggaagccgagaagccgggctcagcgtgcgtacagggacagagacggcaagccggagtgtggatccgttggtgcaaggaggaccatcactcagagcgagccatgctgcagcacggcgaggagaagaaggggaaggtgaagaaggggtggctggcggtgcgcgtcggggcggcggagggcgacggctgcggcagcggcggctcccagcagcgcttcgtcatccccatcgcgtacctgtaccacccgcagttccggcgcctgctggatgccgcgcgcgacg

SEQ ID NO: 42103 - DNA, 421 bp, Zea mays
  Clone ID: LIB3062-019-Q1-K1-D11
aacactcgtcctctagttctagatcgctatcggactgatgtatgaaaaggatggttacggactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggcccctttaaaagcaccaattttaactaccctttgcaacaaactgaaaaactttttaaaaggcgacccaaatttaaattaatggaacttgtttaaaaaacggataaattggaaaaccctggtattaaccaactttatcacctttaaaaaaaaaacccttttgaaaatatggttaatatacaaaaagacacaaccaattgatcttt

SEQ ID NO: 42104 - DNA, 452 bp, Zea mays
  Clone ID: LIB3062-019-Q1-K1-D2
aaacggcactgtccccgcaaagaaaagcagacccgtcgccgacgcgtgccttctcgttgagcccgatcttgtgggacgtcaccggattccaaaatccgttaggcaatggcgccccctctgctctcgccaccgatgctccccgacgcgctcgcgacgctgccacggactttcttctgctcccgcccaacgcggcaactgcccaccgtccggctcgccgtagccgtacgtggcgaccggtggagctggagtgcgcggataagggatctcacggtatttgccactttcacggaagcggatcgtgaaagggatgaagaggatgtcgccgacgattactattccgttctgggtgtgatgccagatgcaaccactgaggaaattaagaaggcatactacagttgcatgaaggagtgccaccctgaccttagtggggaccaccctgacgtgacaaactt

SEQ ID NO: 42105 - DNA, 429 bp, Zea mays
  Clone ID: LIB3062-019-Q1-K1-D4
agcttcttcactgacctccttgttgtcggcgaaaaccgccaaacttttgatctagaaggtgatagtggaagccttattatcctgactggccaggataatgagaagccgtgtcccattgggataatatggggtggcacagcaaaccgtgggaggctaaagcttaggtgtgaccatggccctgaaaattggaccagtggagttgatcttggccgccttctggatcgtcttgaacttgaccttatcataaccaatgaatcactcaaagatgccgtgcagcagcaaaggctcgcgttggtggctgcagctaactctgctgttggggagtcgtcgacagcagctgttcctgccccagaagaaaaggtggagatcttcgagcctctggggatcaaaatcgagcagttgcctcggcacgatgtttcggcctctacg

SEQ ID NO: 42106 - DNA, 425 bp, Zea mays
  Clone ID: LIB3062-019-Q1-K1-D7
cggagggcttccgctcgctcgcggagggcgaggaggtggagttttccgtctcggagggtgacgggggccgcactaaggccgtcgacgtgaccggccccgacggatccttcgtcaggggcggcggaggcggaggaggaggcggcggcggctacggctcccgcggcggtggcggatctggcggcggcggtcgcagctactgtggtagctggggcggcggccggagatccggcggcggtggcggtcccggcgcgtgctacaagtgcggcgagcccggccacatggcaagggactgccctagcgccgacggcggaggcggctatggcggatgcggctacggtggcggcggctacggaggacgaggaggaggcggtggctgcttcaagtgcggcgagcctggccacatggccagggactgctccagcggc

SEQ ID NO: 42107 - DNA, 442 bp, Zea mays
  Clone ID: LIB3062-019-Q1-K1-D9
gccaaaaataagcttccatctctaacaagaagaaaaggggcggttgcaaatgctgcacaagaacttgctcttgtcggccaggaaatcatgagttgactgacgacacactagatatacacaattagatgggacatgcttcggcctctgatggcaacaagattggatatcagctgccatggagggtgctagctattcagtcttagcgacgtcatcaagctccaaggccacagcaccaacaaatgcattttgttgctgctgttcgtgccttttgtacacatgctaacacataatccatgtcatttgtgaagagaagctgccatggacagtgacttcatccacaatattatgtggatggcggcagctggagatgttaggccccgatcgaatggtgatcagcagatgagacttgcttgggcttttctggcactcgtagttctttgct

SEQ ID NO: 42108 - DNA, 435 bp, Zea mays
  Clone ID: LIB3062-019-Q1-K1-E1
acgtcctcctcttgtgatcggcaatcttggcaccaccacggcctttcgctcaaggagccagccgtgtgccggccgaccagcccagaggcgtcgaggccgcggctattgacagttaggtccgggtcggagccagccgtcgaggcccgatgggcagcaggacgacgctgcccctattaataaagccgccatgcgtgtgcccggcactgcacaacatccatcgtccatcgacccacccaacctgctgctccggcccgcgcttcgcctgggtaccggcgtccgccgcgccccgtaccgtctcgtccaggaacaggaagagcagtaacccatgcacccattcatcggggatcaccaggggtcaggggagcaagatgtcgactgccaccgtcccaagattgcccgctcccagatccggggcaagctatcactatcagacga

SEQ ID NO: 42109 - DNA, 236 bp, Zea mays
  Clone ID: LIB3062-019-Q1-K1-E11
ggctgatctcactatgcggccactgaccatggccgacccgcctagcagcaaccttggcataggcctacaatacatcgacctaggccaagaacacaaatgaggagtgccaacgctcgtccatggctatgtagacgaacaaagcgcaccgcttcacgctgtacaccaacgacgagcgaaccgacgccgcgcttgtctaccagggacagcctccaccagctaaggatacatcgagctcg

SEQ ID NO: 42110 - DNA, 440 bp, Zea mays
  Clone ID: LIB3062-019-Q1-K1-E12
atccacactaacgaacgaactcttgctccgatcacgagctagctgaggtcgacgatggcggctgtgctgaacagcgggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaa

SEQ ID NO: 42111 - DNA, 380 bp, Zea mays
  Clone ID: LIB3062-019-Q1-K1-E2
acgtcctcctcttgtgatcggcaatcttggcaccaccacggactttcgctcaaggagccagccgtgtgccggtcgaccatgccagaggcgtcgaggccgcggctattgacagttatgtcgtgatctgagccatccgtctaggcccgattggcagcaggactacgcttcccctatttataaagccgccatgcgtgtgcccggcactgtacaacatgcatcgtgcatcgacccacccaacctcatcctccggccctcgcttaacatgggtaccggcgtcctccgcgccctgtaccgtgtcgtccaggaacatgaagagcactaacccatccacccattcatctaagatcaccaacggtcaagggatcaagatgtcaactgtc

SEQ ID NO: 42112 - DNA, 385 bp, Zea mays
  Clone ID: LIB3062-019-Q1-K1-E3
acaaactccggctcaaactttcgccctagccctacagatcttcaattccccagggcgccggccgatctaccttgacgcgcaggctcggtctcttcctaaagcgtcgcgctcggttgtttgacaggagaggaggaagattagggagtgcatctacgtccacatcgttcatgccggcatccaagtcggcaacgcgtgctgggaactttactgcctcgagcacggcatccagcctgatggccaagtgcctggagataagaccgccggacatcacgatgatgccttcagcaccttcttcagccagactggtgctggaaagcacgttccccgtgcaatcttcgttgatctataacccactgtgatcgatgacgtgcgcactgtcacgtac

SEQ ID NO: 42113 - DNA, 327 bp, Zea mays
  Clone ID: LIB3062-019-Q1-K1-C7
gaaaaagccatccggaccgcagccggcaacccgtccggcaaggtgcgactcgatctgccgacgctggcccggatggaatccttgcccgatcccaagcaggtcctgttcgacgccctgcgcacggccagcgagctgtctgccaaccggcttcgcaagttcaaccccgaagagaagcggcatcgtgtctccgacctgatggacagcctggaccggctacgccagattccctcgttcgcgcacctggaagaccagatccgcgcccatttcgccgcctgaatttccccatgctgcaattcgacctcctcgccaccgaaggccatgcccgcc

SEQ ID NO: 42114 - DNA, 444 bp, Zea mays
  Clone ID: LIB3062-019-Q1-K1-B3
cgccgggaacgtgaagaaagacgcaagagactaaagagagagcagcaggatgatgggtcaaggctacattcgcagcagattagggttgattatgctcctcaacccaaaaggcatagtcgcatcaaagaggcacctcagggctggttggactgtcctgcatttggggagccaatagataaaatcataccatctaaagttcctctcgatgaaacattcaatgagtcagtgcctcctgggaagcgatactcctcaaagcaactagttaacaaacaaagaaaagctggtcgtgaaataggtctggtgattgatttgacaaataccaccaggtattattcaccagctgaatggacgaagcaaggtactaagtatgcgaagattgcatgcaaggggagagatgcggtacctgacaatgaatctgttaataagtttgtctatgaggcaatg

SEQ ID NO: 42115 - DNA, 432 bp, Zea mays
  Clone ID: LIB3062-019-Q1-K1-B5
agcaggtggtaggatctacctaattggtggttatggaacaccacatgggaagagtaatgtatggggcggtaatcatcatgactttttgtttggttttggtatggagcatgtagagccatgagtaaatacagaggatctcttatgggtactaaagagaacagatatggtctctgctgggcataaaaagatagggaagtaaactcacgtttggaagaatcgtgagcaggaggagaagtgtcttttatcccccattgcataacacctgttttgcccttttgactagcatacatgggaatgaggacacttaagctttgtgatgaggtgaggtgagaaatgggagttgagagacagacttgagagggagagatgcaaagagcagaacaaaatgggcagcaatattggctatggaactgaagcacgagcacatggtag

SEQ ID NO: 42116 - DNA, 373 bp, Zea mays
  Clone ID: LIB3062-019-Q1-K1-B6
catacattcctgcacgcgaagccttcgcgcgtggtcacgatctccctagaacactagagcgtcggagggtccttgtggtgagtgtccaacgcctatagtctaacgaagtactgaatcctgcttgccaagatgcctaatagcgttggctactgccctctgctgaatgacactgatcatggcctaaccatatgcctgctaggcttcacctcgaacagagtcaaagagtgtcagtcatgggaacgcgtgccactggaactacgttcatggtgaaccaataccgatatcatgaacttactaggacgcacatgcacctgccgaatatagtgtccatatgtgcgtttgaaaggccaggcgcttgatctgatacgctttt

SEQ ID NO: 42117 - DNA, 435 bp, Zea mays
  unsure at all n locations
  Clone ID: LIB3062-019-Q1-K1-B7
ctggaggccggcagggccaacgagtgggtggtgacggcgaagctcggcagcgccatgaagatggaatcggctaacaaagcggggctcaggaagcagttcatgaggatatgggagaggctgcacgtcacggagctcggggtggcagccttcctcttctcctgcggctggtacgatcttgcgtacgggagggaccatttcttcatctacctcttcttccagtctgtcgcgtttttcatcgtcggcgtcggctacgtcggcaccatcgtcccgcagtcgtagcggaagcgtgtccagatcatccgcttctctctggttttcgcattgtgtcttgggtaagtttcgtagtggatgaccggtttgaggtaaagatcatgcatgcggtcctctcttccatcgtctntttttggggaccggccgtgtgtgcttcgtcgacct

SEQ ID NO: 42118 - DNA, 421 bp, Zea mays
  Clone ID: LIB3062-019-Q1-K1-B8
ctcccataaataaagcagctccttcgggggctgcgaactactcctcgtcgccaaaaccctatcggtgcttctttgccatggcgagcagcgctagccaggctagccttctgctccagaatcagctcaaggatcttgcgaagaaccccgtggatgggttcttcgccgtgcttgtatacgacagcaacatcttcgagtggcaggtcatcatcatcgtaccgcctgacaccctatatgatggaggctacttcaatgcaataatgacctttccccagaactatcccaacagcccgtcatcagtaagatatactcctgagatgtggcatacgaatgcgtatcctgatggacgtgtttgcatttctattcttcatccacctggagaagatcccaatggccatgagcttgcatgcgaacgatggacact

SEQ ID NO: 42119 - DNA, 419 bp, Zea mays
  Clone ID: LIB3062-019-Q1-K1-B9
gaaaaggctgcagacagaggtatgcatggtccatctagtcggagtgctgcctgcccaccgaaagcaaggctgctccagcaacgaagagctcatgctgcaccaacattcaccatcaagcggttggcagcagaggcagcatggatgcctgctataggcaatgtttctactgtgctgtgttttggcatctgcctggttctaaatctaacactcactggtggctcgaaccgtgctattttcttcctggcgccaatccttctgcttctgaaccaggattcagatatcttcgcagggtttggtgataggcagcgctatttcccagtaacagtttctatttctggctatttattgttgacagcgttgtataagatatgggaagagacttggcctggcaatggaagatgggctcttgatatcggggg

SEQ ID NO: 42120 - DNA, 442 bp, Zea mays
  Clone ID: LIB3062-019-Q1-K1-C1
tcggcgaccagttgggcgcggtgttccttcaatcggtatggctctgccaggatttgtgtctcaacaacaacttggtctcaataataattctgagatgacctggctaccaatattgactggtgcctctggagctctaggagcaccttatggttccccttatatagccatggatggaagttattactctcgacaatctgaacaagcatcttcatcagtttctattagagaacctagtgcaaataatgcttcttctctgttgaagtcccaagaaataacagaggttgcaagtgatgaaataactcaacgccaaaataagcctcgtcgatactcggagatgaactttggccaatgaacatagctgtgaccaatgaggattcattggagcttaggacccaagtaagacctgtgcaagagacccaagccttactaagtccttgcaaca

SEQ ID NO: 42121 - DNA, 426 bp, Zea mays
  unsure at all n locations
  Clone ID: LIB3062-019-Q1-K1-C10
gtcacactttacatataattccagattctagacaagtcaatgctgatgagttgcagcctggcgtctgctatttacagatcactgctgttgatcctgtaatggaggatgaggacttgggtagcaggagggaaaggattttttctttatttactggtactgtacgtgcacgtgtttttgaccgttttcttttcgatacaccattcacaaaaaatggaaaaacacaaggtggtctagaagaccagtggaagaggcgtaccgtgctccagacagagggttcctttcctgctttggtgaaccgtctgctagtcaccaaatctgaatctctggagttctctcctgttgagaatgcgattggaatgatcgaaacangaacagctgcattgagaaatgaactagaagaaccacggagttctgaaagtgatcaac

SEQ ID NO: 42122 - DNA, 434 bp, Zea mays
  Clone ID: LIB3062-019-Q1-K1-C11
ctgtatcgtccgacgaaggtgcatggtgttggccatgggtcacggcagggaacagagacgagcaggtcggcgctctgcccccagctcattgatcctgtcctcgctataaggtagtcctgcggtggcctccgaatttcactcgatcgaacacgacatgaagcggccacgcggcgccagtccccctctggctgcgatgaccaatccgaacgatgatggttacggcgtggtcgggatggaggcggacgcagacgcggacgcggacgaggagatgatggcgtgcggcggcggcggggagaagaagcggcgcctgagctccgagcaggtgcgcgcgctggagcggagcttcgaggtggagaacaagctggagccggagcgcaaggcgcggctggcgcgcgaacctcgcctgcatccgctccaggtcgccgtctggttcc

SEQ ID NO: 42123 - DNA, 426 bp, Zea mays
  Clone ID: LIB3062-019-Q1-K1-C12
acaagctatagctagctatagcttgcagcaccatggcagcaggaaggatgctcctcggcgtctgtggcgtcctgatggtggtcaccgtcacaaacacggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgtcaataacgcgccttgccctgggcaggagccgtccaagatcgcgcccatgtcaagcggcaccttcgtcgccgtccctggcaagatgcact

SEQ ID NO: 42124 - DNA, 450 bp, Zea mays
  Clone ID: LIB3062-019-Q1-K1-C2
aagggagtgggcaagggggtctatttaacgtaggctcctttttccggtggaactcgaggaaggggagctccagaaatctcgatgccagccctcctgcaactccgggttctcagagcgtgacagagcttgatccaaagctccctcaaactccacgtcccaacctgaaggagctaggcgagaagcggacgtcgataaagatcgtagtggacgaagaagcaagcccggcagacaaggtgggaggtgcggagaactcaggagaagatgtggcgaaggtgatagagaaaaatgcaggtgaaccgggcaggtcactgacaagcacattgagcaggaagatttgcagaaggagagcagatgataggctatcagatatccccgagaagattgaagctcgtggatctaagccggtgagtgaagggcctattcttgttagaggtgagccaatgataacag

SEQ ID NO: 42125 - DNA, 124 bp, Zea mays
  Clone ID: LIB3062-019-Q1-K1-C3
ggttcataggaagcaaatcacctaggacaaggtgaaaccttctctgtaggcaagcaggcaaaagggaatagatgttcccatcctgatcaaaaggaataaaaatattctgaaaattgccacatcc

SEQ ID NO: 42126 - DNA, 450 bp, Zea mays
  Clone ID: LIB3062-019-Q1-K1-C4
ctttgtccgcgtggacgcggctgacttgcgaacccaccggaccaaccaggacttggagcgtgcggcgtcggagttcgccggcggtgaggagcagaagaggaagggaaccaaacaaagatgggctgctccatctcggggctcaacgcgctctacgacgcggccacgggcggcggcgacgtctggatcaacgagcgccgcttccgcgtccttcgccagatcggcgagggcgggttcgccttcgtctacctcgtcagagagcaccagcccgcctccgatgcggcgttcgctaggcgtgaccccgcccacgtctcagaggatggaacgtatgccatgaagaaggtgctgatacagagcaaggagcagttggatctggtgagggaggagatccgtgtgtcgtccttattcaatcaccccaaccttctgccgcttcttgatcatgccataatagcc

SEQ ID NO: 42127 - DNA, 171 bp, Zea mays
  Clone ID: LIB3062-019-Q1-K1-C5
cccacctcaccttcccctctcccgtcgtcggtatggccaccgacgtgctgctcgcgcgcaacgggctcttgccggcgccgccgcagaggatccgggcggcggcggctgcgctcctgtggacatctgggagcatctggcggtaccccttctctaccaataccaggatgatgt

SEQ ID NO: 42128 - DNA, 445 bp, Zea mays
  unsure at all n locations
  Clone ID: LIB3062-019-Q1-K1-C6
aaggaaactgcagtgaagtcgccggcgccgccgcgacaggaggaaggagcagcagcggcaggggaggcccggcgatctcttctgttgcgtgcggcgagggagtaaaaggagccgcgacaggatgcactcctttgggcaccgcgccaacgcggtggcaacgttcgcggtcaccatactggccgcgatttgcttcgccgcctccttctccgacaacttcaacaccccgacacccactgcctccgttaagatcttgaatctaaactggttccagaaggaggccaacggcaacgacgaggttagcatgacgctgaacatttcggccgacctttcgtctcttttcacgtggaacacaaaacaggtgtttgtttttgtggcagcagagtatgagactccacagaatgctttgaatcaagtttccctttgngatggcattatacctgcaaag

SEQ ID NO: 42129 - DNA, 424 bp, Zea mays
  unsure at all n locations
  Clone ID: LIB3062-019-Q1-K1-B2
gaagttttgagggtagagcagttgggtgattacgacgaagagagatgggcctcctcgacaagcggtgggacgacaccgtcgcaggcccgcgcccggacaccgggctcggccgcctccgcaagcagcctgtgcgtcccgccgccgtcaagatcagtgatccggccggggacgctgcggcgttcgtgccgccctcgccggcttcgggtagcgaggagacgccggtgaaggtgacgcgcagcatcatgatcaagcgccccgcggggtacccgtcgtcgccgaggagcgcggcaagcacgccgncggcctcgccactggggactacggccgccatctcgccgtttgccggcgccggtggtcgcttcagaaggaaatcatcgtccgacgcatacgagagggcgaccccaccagggacgaccagccaccc

SEQ ID NO: 42130 - DNA, 237 bp, Zea mays
  unsure at all n locations
  Clone ID: LIB3062-018-Q1-K1-H7
cgacgtggtggacaagtgctccgccgactgccaggactgcgaggcgtcgccggccggcgacggcgtcgtgggcggagactttatcttaagcctgaccgagcccccggtctgcacaccgaggccgtgggactgctgcgacagcgtggcctgcacaagggactacatncccaactgcatgtgcctggacaaagtggagtcgtgctcgagcaactgcgaacggtgcgaagttctggatca

SEQ ID NO: 42131 - DNA, 147 bp, Zea mays
  Clone ID: LIB3062-018-Q1-K1-H8
tcactgatattattaagaggcccaagatctctggagcacagcttgcagccatcctacctctggctattgctcatgctatgggcaatctcttcaccaacatgagccttgagaaagttgcagtgtcatttacgcacaccatcaaggcta

SEQ ID NO: 42132 - DNA, 400 bp, Zea mays
  unsure at all n locations
  Clone ID: LIB3062-018-Q1-K1-H9
agcatttgaaatctggactcgggggtggggttgcatgttccctgagggtgattcatcgggggagctactagagaaggttcagaagacctactacctggtcagcctcgttgacaacgactacgtccagggggacctgtttgctgccttcaagatctgattatgctctcatggtctgtattgttgtatggttggacccaacaatattcttgcatccccgactacaggtctgatcgccatgaaagcttctgttcatttgagctcgggggagtccgctagtcttatttttcttgatttctcttggctttctggaaccatacgaatcaataagaaatgagctgtgttcactttccagttcctncgtgcaagtggcgcaacggccaggttctagatgtaaaattcg

SEQ ID NO: 42133 - DNA, 392 bp, Zea mays
  Clone ID: LIB3062-019-Q1-K1-A1
atgcgtagcaaattttctgcttgtatctatcatcgaaactgttcattcagcaactaaagcggttcaccgggatttattaagttagatgaagacattttatcccctctagcagtaaagaatgaactgtacacataccaaacacttgatttctgggaacatatcacaaccccagagatgtcttaatgaactctggagtatatctctctcagtattcccatacctattctcatcttttagactcatgacatggcataaaaactagcactatttgtggcgatgtctatatgcattcatttgacaaagtgcatcctacttcaaagaatggtcccaatgtctctatatcagccaatgcacgctttgtatcttgtgccaggcttattaaattgcataat

SEQ ID NO: 42134 - DNA, 426 bp, Zea mays
  Clone ID: LIB3062-019-Q1-K1-A11
cccacgcgtccgctcccataagaaaaatcgccaaatacgccattcatcttcttggcccgggtttcagaacgtgcggcagtttagccaggatggtggcgatcgagaaccagaaccagagccaggccgcggtggcggtggcggcggaggcggtgccggcgccggcgccgcggatccccaaggaggcgcggcgcctgctgcacgagctggcggcggcgtgggcggacgtggccgactgccgcgcgctggaggtcgtgccgctcaagggggccatgaccaacgaggtctaccaggcgcgctggctcactgcaggccctgccggccaggaggaggagcccagggcggagagggaggtgaggaaggtgctcgtgcggatttacggcgacggcgtcgacctcttcttcgaccgcgaggacgaggtgcgcacct

SEQ ID NO: 42135 - DNA, 445 bp, Zea mays
  Clone ID: LIB3062-019-Q1-K1-A2
caacggtatcgacggcaatccaatcctaccatggctcaagacattctccaacggcactccatcgagggaaacggccgttgctcccaccgctgctgatccacggcggctcaatcagcgctccggtaacccctcctctaagctcgccgtctgcccggacgccccggatgaagacggactgggacgaagcggccgtccagcctccatggcacggcgcaagcagccccacgatagtgaactccacgccgcccagccccggtcggcccatcgcgcctgacccggcatggctcgccggcatccagatctcgtccaccagtccaaactccccgacattcagcctcgtctccaccaacccgttcggcgtcttcaaggagtccatcccggtcggcggcggcgactcgtcgatgaggatgtgcacgccggggcagagcggcgcctgctcccccgc

SEQ ID NO: 42136 - DNA, 368 bp, Zea mays
  Clone ID: LIB3062-019-Q1-K1-A3
cccacgcgtccggacaaatttgctgcagtctgtatactccagggttatcttgacaacatgaacagaaaactgagatccacagataagtctgaagcataaaggtggcacctaagattccagtttgaactaaaccaaagagcaagggaaccttttttttttgatagaacaggaggggagggcccctactggaaattttatttaaaatttgaaaagaaaacaatgtttagaacaaacaagaagacaaattacagggggttaaggagagtttgtactgccattgatttctactgccattgttgaagccaagtcgggatggcagaatcaaatctatccaaagctctgtgaatgacaaggagcaatttatttgc

SEQ ID NO: 42137 - DNA, 442 bp, Zea mays
  Clone ID: LIB3062-019-Q1-K1-A4
ctcggcgctccctcttctgactccttcgaggtactcccatcgctatcgaccgggtcctcgagcgcgggagatggcggatcaggagaccccagttgcagttgaggcccctaccccggtccttggggagccgatggacctgatgactgctctgcagcttgtcatgaagaagtcgggtgctcatgatggccttgttaagggtcttcgtgaggctgccaaagccattgagaagcatgctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggc

SEQ ID NO: 42138 - DNA, 438 bp, Zea mays
  Clone ID: LIB3062-019-Q1-K1-A5
gagcaaatttgcggcgtgtatctagcattgaagctcttcattcagcaactaaggcgcttccacgagactttgttaggttagatcaagacattttatcccctcgagcgggaaagaaggagctgtacacataccagacacttgatttctgggaacagatcaaaaccccagggatgtctttgagatgctctgggttatatctctctcagtttcgccatacctctcctcatcttttagcctcaggagatggcaaaagaactgccactattgttggcgatgtctatatccatccatctgccaaggtgcatcctacttcaaagattggcccaaatgtctctatatcagcaaatgcacgcgttggagctggtgccaggcttatcaattgcataattctggatgatgttgaaattatggaaaatgctgttgttatacattcaattg

SEQ ID NO: 42139 - DNA, 436 bp, Zea mays
  Clone ID: LIB3062-019-Q1-K1-A6
gcgcgctcgtcagcaagccggcgaccagcactagggacgtattcggcgatgggcgcgtgaccaggcgcaagactggtggcaagcccaagccagcggggtccggcagcccctcgtacggagccgaccgaatcctgtacctgtgcccgatgtgcggtcagccaccaagctacctgaccagcgagttccccaggggactacggctgggacaccaaggcgctgtccgccgacccggagactttcgccaagaaccgcgagattgaggccagccactgcctgtggaccatgctaagcgcgctcggttgcatgacaccggagctgctcgtactgaacgtcgtcatgatactctaggccaattggatcaaggccgggtgacagatctttagcgaaagccgacttgactacctaggtgatcctagcctgatccacgcgcatagca

SEQ ID NO: 42140 - DNA, 387 bp, Zea mays
  Clone ID: LIB3062-019-Q1-K1-A7
gccggcggcacagcgcagcgcagcgcttccactgttgggtgtggtggatttcctccggccccgggcgatcgatcttttgcatggcagcagcggctagctccaaggggcgggcgatcgctgggagcttcgtcagccgcgtcctggccggcaaggccgactacccgaggagggccgtgcacgcctcgtcgtacgacaagaacccggaggagcaggtgcgcccggcgttcgtgccagacgatgtgatcggcggcgcggagagccccgacaagtactggagccctcaccccaagaccggcgtgttcggcccggcggcggtggacaccaaccagctgggcgtacccgctgacgctgtcgacgcgaatgcggctgcagcaagaggcacggtgc

SEQ ID NO: 42141 - DNA, 425 bp, Zea mays
  Clone ID: LIB3062-019-Q1-K1-A8
tctccagatcaaccatggttacataacattattaaggctccacatgtcaattagctgtagaactgtggacgccagacttcaacaattctctctgatgaacaagtccaataagcatgcacttagggtcatagctgagcatctttcactagaatacgctgctgacatataggatatatttgccaagatggatcttaacaaggatcaaatgctcaatttctatgagctgaaccttggtctgcataaatctggtcaccaaatacctcatgcacatgttcaaatactaatggaagctgctgatgctgatggaaaccggtccttggattatggagaatttggtacactatctgtgcatctaacaaagattgtaaatgatcagcatcttcataaagcatatgcatactttgaccggaaccagagtgtgtata

SEQ ID NO: 42142 - DNA, 334 bp, Zea mays
  Clone ID: LIB3062-019-Q1-K1-A9
ttccggtcgaccactcgtaccctggtaaacccgaaggattggatctgattatccgctattcttgtgtcccttacgcttggagcacgatggcagtatgatcataaaccggatgaaggaaccgccgaacggaaacttctataagcctgcataaacccgatagattggatctgattatcccttattcttgagatctttagttagagttttcccttctgtagggctaaaaccacgtgcagcttcatgatatatcctgcctctgtacaatcgtgaacaaatattacgtattaatgctctatctgcctgtattatatatgctgctttttgcccatgtgaa

SEQ ID NO: 42143 - DNA, 334 bp, Zea mays
  Clone ID: LIB3062-019-Q1-K1-B1
agcaggtggtcagatctacctaattggtggttttggaacaccacatgataagattggtgtatgagtcattaatcatcatgacggtatcattggctttcgtctagagcatgtagatccatgagtacatacacaggatctttcatggctactaaagagaacacatatggactctcctgctcatataaagatacgacaataaactcacgtttcaaataatcccgagcatgatgacaaacgatttttatcccccattgcataacacctgctatgaccttttgactaacatacatagcaatgaggacacttaagctttgttataaagtaaccagataaa

SEQ ID NO: 42144 - DNA, 295 bp, Zea mays
  Clone ID: LIB3062-018-Q1-K1-H4
gtggatcactggtattattaagaggccaaagatttctggagcacagcttgtagccatcctacctctggctattgttcagagctatgggcaatctcttcaccaacatgagccttgggaaagttgcagtgtcatttacgcacaccatcaaggctatggagcctttcttttctgttattctttctgcaattttccttggcgagctacctactatttgggtagtatcttctcttcttccaattgttggtggtgttgcattggcatctcttactgaggcatcctttaactggggctgctt

SEQ ID NO: 42145 - DNA, 423 bp, Zea mays
  Clone ID: LIB3062-002-Q1-K2-A2
agcacaagcacaaggagcacctcggcgagatgggcgcccttgccgccggcgccttcgccctgtacgagaggcacgaggcgaagaaggacccggagcacgcgcagcggcacaagatcgaggagggcgtggcggcggtggctgccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcat

SEQ ID NO: 42146 - DNA, 405 bp, Zea mays
  Clone ID: LIB3062-002-Q1-K2-A3
caagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtacccgtgtcgatgccggcgatct

SEQ ID NO: 42147 - DNA, 402 bp, Zea mays
  Clone ID: LIB3062-002-Q1-K2-A4
ccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatgaacgccgccgaggacgagatcgtgcgcctcacgcgcgaggtcgtgcccggcatgatcgtcaccgggattgaggtcgccgagatcgacggcgccccgaggatgggcccgacgttcggcgccatgatgat

SEQ ID NO: 42148 - DNA, 421 bp, Zea mays
  Clone ID: LIB3062-002-Q1-K2-A6
ggaaaatatcagctcctagcgaatcacctcgagcctctaactgagcagcaaatgctgggtttgaccaacctccagcaatcttcccaacaagcagaggatgcgttgtcacagggcatggaagcactgcagcaatctttggcagagactttggctggatctctcggtccagcaggttcttcaggaaatgtggcaaactacatgggtcagatggccatggccatgggcaaactcgggacgctagagaattttcttcgccgagccgacaacctgcgacagcagacgttgcatcaaatgcaacgtatcctaacgatccgacaggcttctcgtgctcttcttgcaatccacgactatttttcacgattggcgcgcttaagttctctgtggcttgctaggccacgtgaataacgaaaggccgtcagta

SEQ ID NO: 42149 - DNA, 177 bp, Zea mays
  Clone ID: LIB3062-002-Q1-K2-A7
ctccatcctcgcccatgagatgctttggtgcttcctgctgcctctctctccctggtcttcatgtgtaccattctctgattgaatatttgagtgaatggtgaatactgcatacctggatttcaggattcatatttgaatgaatggtggatacaccgcatacctggattccaggatcgt

SEQ ID NO: 42150 - DNA, 423 bp, Zea mays
  Clone ID: LIB3062-002-Q1-K2-A8
cgccgactgaaggtgaatcttcagacagccagattggttggtgtctagtgtgtgcgaagatggcgtagaaaagactgagagacagttggctcacacagacaattgacaactgactatagtatctgcctgcctggctgatgctgatagagatggggactcttgtcctgctgtctgttcttgtataaatctccgttgtcaaatatttatcgtccgattatttatttttaaactaaacaacgacaaataaaaaagaacgaggttgcaaaagatagatacaaaccaaaggatgtcgtcgctgtgcgctgatctgatcactgccactctgccaggtactacctcaaggacgcggtgcttgacggcggcatcccgttcaacaaggcgtacgggatgacggcgttcgagtaccacggcacggacgcgcgc

SEQ ID NO: 42151 - DNA, 411 bp, Zea mays
  Clone ID: LIB3062-002-Q1-K2-A9
agaagaccggtagcttggccaccagtggcagctcggacatctgcttcaggttctcggccttcttcgcctaggtcactcgttgatggtgaaggttacaatagtgctgatgaacagggtccctgttacgcctcgagttatgatgattcggaaagagagcgtatgtttgagcatgacctaaggcgagtgaaagggttggaaatcagaaagacagccgaagatgggaactggctattcagaactggtgctgatcaagtttattggaaatccaaaacctattgacttggttagccaaatttgggtggattatatggaaagggaacgggatcatttctctcagattataactgagatttttacattatactgtacgaggaaaaggagagacacggtttatggcgacaatgttgagat

SEQ ID NO: 42152 - DNA, 347 bp, Zea mays
  Clone ID: LIB3062-002-Q1-K2-B1
caccgaccgggagacggggaggtctcgcgggttcggcttcgttaccttctcctacgagagactccatgctcgacgctatggagaacatgaacggcaaggagctcaaccgccgtaacatcaccgttaaccaggcccagtcccgtggcagtgacggtggcacgctgtagctactgccgcagtcgctcgcgtgaggcagctatggtggcaatgcgccagtgacaagctggatatggcaagctgtcgtgcggctacggcaatgctgcaccaggtgtataggcatgaggatacatgatgctagtagccggctaaagcggtcttgctctaaaggtaagtgattgaagctttca

SEQ ID NO: 42153 - DNA, 164 bp, Zea mays
  Clone ID: LIB3062-002-Q1-K2-B10
cggactcgtgggtctggaacgatttctaggccatttgtagagaaccagattcagatgccaattccacagcctgggggtatcagacctggtgatggtatgattcggccttgtttggttggcccattacctggacatcatgttgctgtgtagccttcttttgatct

SEQ ID NO: 42154 - DNA, 364 bp, Zea mays
  Clone ID: LIB3062-002-Q1-K2-B11
caaacacacgcgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccaggagcagcggagccggcgccgggcgcccgaccagcagcagtacaggggcgtccggcgccgaccgtggggc

SEQ ID NO: 42155 - DNA, 366 bp, Zea mays
  unsure at all n locations
  Clone ID: LIB3062-002-Q1-K2-B2
cgagtcctcgacaagcacccaaatcgacgaattcttcccccctctccgatctcgacgcgcaccgatgcgggcgatgtcgtcggcggttaatggtatgctgcgggcacggctgcgcggggcagcgcgcgttcgcggcggcggcggcgagggggccgggcggtggacgaccccaggtcacgaggagcgccccaaggggtacctcttcaaccggccgacgccgcctccgggggaatctcgcaagtgggaggattgggagctgccctgctacgtgacctncttcctcaccgtcgtcatcctcggcgtcggcctcaacgcgaagcccgaccttacaatcgagacgtgggcgcaccagaaggcgctcgagcg

SEQ ID NO: 42156 - DNA, 385 bp, Zea mays
  Clone ID: LIB3062-002-Q1-K2-B4
gcacaagtgacagtagcttgatgacacattgaaacaccataagagctgtgatcatcctgaacctgtgagaagccctgagcaggatggaaaagactacaagaggcctaagcttgacggataggtctatatatatgattttggatgggttttctggaagctgacaagcaattagctgccggattcattgtatgatgacttatacatgttgatgagcacgtgtcttcttcgctggtgcctgaagaagtgaagatgccgcgctacaagattgatgcgctgcagagagcaccaagatgatgcgcccaacaactgattgcagctgacagatcgaggaaagtcagccagcaattattagtaggttccatcaaacattgcaatataatatata

SEQ ID NO: 42157 - DNA, 277 bp, Zea mays
  Clone ID: LIB3062-002-Q1-K2-B5
gagaaatacttctgaaaacgacgaccaatatcaacgccaacaggcgtaacctaggggcggcttaccactaagtgtttgcatccatggcaaggatcttcaaaatactattctagacgctaaatgcctgcaatcattcattgctagacctgcttgcactatttcttgctcctatacgatcatctgcatctcacaagtatactaagttcctaactctaattctaattattaacaacacactccagaatgctactgaactactctacaagaaatacctata

SEQ ID NO: 42158 - DNA, 405 bp, Zea mays
  Clone ID: LIB3062-002-Q1-K2-B6
cgccgatcccctcccctcccctttcccgccgactgatcccaccaattctgcacccgcgcagttcctgattcgattggcaagcgcaattggccgctcctgaccagacgccggatagggctggatttgattggattggatccccaattgtgtttgccacgtccgtgcgttcgggcgggcgggggagttactttagggtttcggcgggtgcggtcgccgtgtaggcggtagggttttgccatggcggagaagggctgcctcaagcggctccagaaggagtaccacgccctctgcaaggaagccgcttcgcagatcgttgctcgcccgctgcccaacgacatactggagtggcactatgtactggaaggaagtaaaggaacgccctttgaaggtggatattactatggg

SEQ ID NO: 42159 - DNA, 423 bp, Zea mays
  Clone ID: LIB3062-002-Q1-K2-B7
cgccgatcccctcccctccccttttccgccgactgatcccaccaattctgcacccagccagttactgattcgattgacatgcgcaattgaccgcatcctgaccagacacatcatagggctggatttgattggattggatccccaattgtgtttgccacgtccgtgcgttcggaccgacgggggagttactttagggtttcagcggctgctgtcgccgtgtatgcggtagcgttttgccatggcggagaagggctgcctcaagcggctccagaaggagtaccacgccctatgcaaggagccgtctacgcagatcgttgctcgcccgctgcccaacgacatactggagtggcactatgtactgaagggaagtaaaggaacgccctttgaaagtggatattactatgggaagctcatatttccacc

SEQ ID NO: 42160 - DNA, 436 bp, Zea mays
  Clone ID: LIB3062-002-Q1-K2-B8
gccaggaacgcgtctctttctccgacggttcagcgttagcggaggcgtccacaccaaccctctaggtctcggacccaaggatgcatgttacctgcccaacatcctaaaaaatctgaacccagatattcgatgccgaacaggttggttcgttcgtttgctgacgtgttctcttccgatccgccgaaacgcgtgtgcaggcgagcacagctacgtggaggtggcggtgcagacgaggagcggcaagtccgtgcgcgtggtggtggagctcagcttccgcgccgagttcgaggtggcgcgcgccagcgccggctaccgcgcgctggtgaccgcgctgccccgagtgttcgtcggccgggccgaccggctgcgcggcgtcgtcaaggtcatgtgcgccgcggccaagcagtgcatgaaggataacaacatgcacatggga

SEQ ID NO: 42161 - DNA, 354 bp, Zea mays
  unsure at all n locations
  Clone ID: LIB3062-002-Q1-K2-A12
ctcaacaaaccctaggttgcctgatcggttgatcgctccatggcgatcatctccgacttcaaggacgacgaggcaccggagcagcagctggcggccggccacggcgtcgaggtggccctcgtggcggcgttggagaggagcggcggcgcgctccccttcctacaggcggctatggatgtcgcccaccgcaggtccggcctgttccgcgacccttcggcggtgagcaaggtcaccgcgatggcggcggccgtcagggcgcagatcgaagccgaggagagggtgaccagngaggcggaggccaagaggaaggcggaggaggacgagaggaaggcggatgccgatgcgcagagggct

SEQ ID NO: 42162 - DNA, 437 bp, Zea mays
  unsure at all n locations
  Clone ID: LIB3062-001-Q1-K2-G4
tcggcccttcctctctcccatctcggctagggttaggtcgtctcgccaagtcgccatgatgcagcagcccccgccgcagcagccgcagccgggcatggcgccgcctccgcctccgcaggctgctggcgggcagccaccgcagtggggtgggatcccgccgccgatggcgcagcagtacggcgcaccgnctccgcagcagcctccggcgatgtggggccagcctccgccgcaggcgcactacgggcaggcaccaacccctcagcagtactacgccgcgccgccggtgccggtgcaggcgccagccgcccccgctgcggcggacgaggtcaggacgctctggatcggngacctgcaatactggatggacgagaaactacgtctcgggtgcttttcgaacactggggaggttcanaatgtgaagctcatccgtgacaaga

SEQ ID NO: 42163 - DNA, 400 bp, Zea mays
  Clone ID: LIB3062-001-Q1-K2-G5
tcggcccttcctctctcccatctcggctagggttaggtcgtctcgccaagtcgccatgatgcagcagcgcccgccgcagcagccgcagccgggcatggcgccgcctccgcctccgcaggctgctggcgggcagccaccgcagtggggtgggatcccgccgccgatggcgcagcagtacggcgcaccgcctccgcagcagcctccggcgatgtggggccagcctccgccgcaggcgcactacgggcaggcaccaacccctcagcagtactacgccgcgccgccggtgccggtgcaggcgccagccgcccccgctgcggcggacgaggtcaggacgctctggatcggggacctgcaatactggatggacgagaactacgtcttcgggtgcttttcgaacact

SEQ ID NO: 42164 - DNA, 425 bp, Zea mays
  Clone ID: LIB3062-001-Q1-K2-G6
cggacgcgtgggcggacgcgtgggcggacgcgtgggcaaaattgctccaaggttccaggagggaatcaaggccttctcaggaagcccaattgttggggagatacgcggtctgggactgatacttggaactgaatttgtcgacaacaaatctccaaatgatccatttccagctgaatggggtgttggttcgatatttggcgcggagtgcgagaagcgtgggatgctcatcagggtggctggggacagcatcatgctgtcacccccgctgatcatgactcccaatgaagtcgaagaaatcataagcaaattcggcgatgctctgaaggccacggaggaacggattggagaactgaaatccaggaagaattagccgatgctgctggttgtaacgacggtgaggatggtgatggcagcagtatattttc

SEQ ID NO: 42165 - DNA, 315 bp, Zea mays
  Clone ID: LIB3062-001-Q1-K2-G7
ggccgcccttttttttttttttttttttctctttttcaaatatgacaaaacgagccaggatgcaatcaatgacttcagaataagcccaattcatgaattagatacccgtgtctaatactgatacttgaaactgaattagtctacaacaaattttcaaatgatccatttacagctgatatctagtgtacattcgatatttaacacctagtgcgagaagcatgggatgctcatcatggtggctggcgacagcatcattctgacacccccgctgatcatgacttccaatgaagtccaagaaatcataaacaaattctg

SEQ ID NO: 42166 - DNA, 424 bp, Zea mays
  Clone ID: LIB3062-001-Q1-K2-G8
ggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggc

SEQ ID NO: 42167 - DNA, 400 bp, Zea mays
  unsure at all n locations
  Clone ID: LIB3062-001-Q1-K2-H10
gagactcatcatctaaaagctcagtaggaaagctgacatattcaggcgtaacatagtggaacacgtgcaataatgcactccgatgattctcaatgtgtttagctcctgcatccataaagcaaaagcaaaaaaaaaatgcttgaatacgactgacatctgccggttgagtagcctgagttggaagtcatcttcagcttctttgggttgggtgtaaagactagcatgcatgacatcaatgctaataatgtatgcgctatgacttatttagtgacgataattgtttcgaatgtgtatgctactaggaaagaaggtaatgtaggcatactaattntggaaaatctgagataccgtaacaattgcttagcacctaaactaaaaagcgataccagatgtatatatg

SEQ ID NO: 42168 - DNA, 403 bp, Zea mays
  Clone ID: LIB3062-001-Q1-K2-H12
cgcgccgtcgtcgtcgccgccgccatgtcgaagcgcgggaggggagggacggcggggagcaagttccgcatgtcgctgggtctccccgtcgcagcgaccgtgaactgcgcggacaatacaggcgccaagaacctctacatcatctccgtcaagggcatcaagggtaggctcaaccgcctgccgtccgcctgcgtcggcgacatggtcatggccaccgtcaagaagggtaagcccgacctcaggaagaaggtcatgcccgccgtcattgtccgccagcgcaagctgtggcgccgcaaggacggagtctacatgtacttcgaagataatgctggagtcattgtgaaccccaagggcgagatgaaaggatctgctatcactggacctattggcaaggagtgcgctg

SEQ ID NO: 42169 - DNA, 312 bp, Zea mays
  Clone ID: LIB3062-001-Q1-K2-H3
agctaacactcctgtatccgagctactactcctagtcctagtacaggctacagaggcggagcgagcaaaactgcctgtacatagcaaccatcaacggcgaccgatccaagtagtgagcattagtggatctactacgtacatatatagaaggaaacagctgcagctctctctctctcgctgtttcctgcgtgatctgcttgtgtagctactagctagctagcggagcggaacccatgggctgcgaggaggaagagaggctgctgttcccgtccttcgtctttcccgagagcttcgcggaagccggcaaccccg

SEQ ID NO: 42170 - DNA, 402 bp, Zea mays
  Clone ID: LIB3062-001-Q1-K2-H4
ctactgtctggttttggtggcagtgttctgtctgcactcttcctacggaacaactacgtctgtgttggtgcttctggagctttatttggcctgcttggatccatgctttctgagctactcatgaactggactatatactccaacaaggccagtacaattaacagataaatatatactttattttatccagctgcttgatagtcatttagctcgtatacttaatttgctcttgcaggcagcagctataataacactcctgtttataattgcactcaacttggctattgggatactacctcatgctgacaactttgctcacattggtggattcgcaacgggtttcctcttgggttttggtctgttggcaaggcctcaatttggctggatggaacaccacgagct

SEQ ID NO: 42171 - DNA, 431 bp, Zea mays
  unsure at all n locations
  Clone ID: LIB3062-001-Q1-K2-H6
cggacgcgtgggtgaggagtgaggacgactggggcgaccgccgccgccgccggcgcggtacgccagatgcccaggtaggggccattcgctagctcttcttcgtgcccttcgccggcgacgagcattcaccagttgctgatgcaaggctttcaaaagtttaacagtctcacttgatgcaaaagcaacacaatcactctaaaggtttggatcagtcatttcagagcatgggttcgcggtttccatcccatcagctaagcaatggcttgtatgtctctggccgacctgagcaacctaaagagaaggccccagtcatttgctcctcggctatgccgtacactggcggngacataaagaaatctggagaacttggaaagatgtttgatctccatagaaaatctggtccattgggtaatccgccttcaaggaatact

SEQ ID NO: 42172 - DNA, 415 bp, Zea mays
  unsure at all n locations
  Clone ID: LIB3062-001-Q1-K2-H7
ggcggcgctgccggtggaggcagcaagggcagctcggtgtacccggcggctgtcgtcgacccgcatcactcccgccagatctcctgcaaacccagggtgttcctgtatcagcacttcctcagcgacgacgaggctaaccacctgatctccctcgcgagagcggagctcaagaggtcagcggtcgccgataatatgtctggcaagagcacgctcagtgaggtccgcaccagctccggcaccttcctcaggaagggccaggatcctattgttgagggtatagaggacaaaattgctgcatggacattccttccaaaagagaatggtgaagatatccaagtcctaagatataagcatggggagaagtatgaaccacactatgattacttcactgacaatgttaacactgtncgtggtg

SEQ ID NO: 42173 - DNA, 426 bp, Zea mays
  Clone ID: LIB3062-001-Q1-K2-H8
gtcgcttccagccgccgccgcgtccgcctcgccaagcgcagcagccgccgcagcacatggctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggacccc

SEQ ID NO: 42174 - DNA, 292 bp, Zea mays
  Clone ID: LIB3062-002-Q1-K2-A10
gcggcgcccttttttttttttttttttttttttttttttttttttttttttttttggtgttttttttttattttatttttttatttttaattttatatattttttttattatattttttttttttatttttttatttattattatttttatttatatcagtatgaaaagaacataacctaaagcgagtgaaaaaaaaaaaaatcaaaaagacagacgaagatgggaactgtctattcagagctgttgctgatcaaacatatggagatgcagaaacttatgacaaggctaggc

SEQ ID NO: 42175 - DNA, 430 bp, Zea mays
  Clone ID: LIB3062-002-Q1-K2-A11
gtcagatataccaggcatgaccatggatgtatcggccctagactcggcatttgggtgtgatgtggggaatcctggatctctgcaattgggaccagatgggtcgtcaagagactctattagatccttagggcagctctggaatttcagcctctctgatctaacagcggatttgacgagtttgggagcagatctggacgtgctggagaactacactggcacccctttcctgccatcggattcggacattttgctggattccccagaccaagatgatatagtcgagtattttgctgacgccatcaacgggtctccgtcagacgaagagaaaccgtagtttttccggggtggcatggcaatggcatgcattcaggttcatcatcaggcagggctgccatctcatctcatgtagtgtaaagcagccaatctaact

SEQ ID NO: 42176 - DNA, 403 bp, Zea mays
  Clone ID: LIB3062-001-Q1-K2-G3
gaagagactcctcgactcgcgtcccgcgctcgggctattggaccgaggggttgcggtggatttggagcggggtggactcgtcgctgatggtattctccgatgcaagaggcagggagagagcgggacagggcggcggcggcggcggatctcggaggcgtcgccgctagcgtcaggccaacggatacagcagctgtaagcacaaagccggcaaagcgatacccactggccttatggataggcatattgggcctgataatgttagtcgctgtgtacatcttctcgttgtctctaaagccaaatgggatgcttttcgggctgatgcagacaaatttgatagaaaaggaaagggagaagccttgtcatgatcccagtattccagacacagaaatcccttacttgcact

SEQ ID NO: 42177 - DNA, 421 bp, Zea mays
  Clone ID: LIB3062-001-Q1-K2-E7
ctatatcgcacggccgccctttctttttttttttcagaccaaactacgacgatgcctgtgatatttatattaaatgcactaatttagtcacatccagaattacactgattatcatgatacaaggtcaacgcaacttccaggtctctcaactgggaaactagattgttaccaacacaatctcacagtagtaaatcgcactattgcggtaaaccctaaatcaaacacaggcattctaatcgctaaagatgtatcacgccacaactgcactcatttgatcaaatgtcactaatgtgctactaaatgagattcaagctcctgcctcagggcagcaattctgtgttgctgaagagcaatcctgttctttacatcttgtccgagcagcttcttatcaaagctgtcgacaacgtgggaattccttggc

SEQ ID NO: 42178 - DNA, 343 bp, Zea mays
  Clone ID: LIB3062-001-Q1-K2-E8
gccagcggcagtgacagcaaaaaaatggcatcatcaacgggatcagagatgagcgcggaaatcgatgtccagcttagtccagaggagaaagaaagtttagatgacatcatcaaggaagctgagagcgacttggagtctgaggaagtcctggatcaatccattgccattgttgccgagaatgaacgtctggacaaggactcatctgcaaaactcacaatttacactgtaggtggtgttttgaagaatctgacagagggcccactgagtgttatggataagcacatatatgcaggacacactgtcaaaccattttccagcctgattggagctggacagtctggtt

SEQ ID NO: 42179 - DNA, 329 bp, Zea mays
  Clone ID: LIB3062-001-Q1-K2-F1
cggatttgatatcaggcagagcaaaggaagatttgcatcgtgggcacagaagagcagctagtgccagtgctgatataggctcatggagcatgtcaatccctaatgaatgtgaaggaactacagaacagttatctgatggctcagacaaattgcctttgcgtaagatagtgaaaacatgtgctttgacaagtaccttgcaatctaagactagaacgaagtggaaaaatggagctgttaggtgggcaggcagtaaccaacaggatgttgaagaggctatccctctgaatacttctcagttgagtcagggcttaaaagaatgctttgaaagg

SEQ ID NO: 42180 - DNA, 424 bp, Zea mays
  Clone ID: LIB3062-001-Q1-K2-F10
gttggcttctcctccccctccggttcgggttccggttcgggagggtctcccgggttcggtttcctgggtgaaccgattcaaaatgccggcgtccgatgttgagtaccgctgcttcgtcagcggcctcgcctgtgccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggccgcaggtacggtggtggccgtggaggcggcggctacggcggtggcgggcgccgtgat

SEQ ID NO: 42181 - DNA, 285 bp, Zea mays
  Clone ID: LIB3062-001-Q1-K2-F11
tcgacaccagcaccttgccggccacactggtctttctcacgagccacagcacacaggcacaggcaagctgtagagcttagtgcaatcatagcatgggatggcgtcgccgttcgccggggcaactggacagacagtgacggcctcggcggctaagaagcggtccgtctgcgtcacgtacgtcgagggcatgaacgcctacagctgcttcaggtgcttatctaggcgaacatgctcggggtgcgcatgaccgctgactactccttcgtcatggtcgtggcgtcgctc

SEQ ID NO: 42182 - DNA, 420 bp, Zea mays
  Clone ID: LIB3062-001-Q1-K2-F12
agaaatccgctcgcacctcgacgcaccgcgcacgaaccgaccaccttccggccccaccactcccccgcgcgcgccgtgcgatcaccgccggcccccgccctcaccctggccgccttgaggaaaagcaaggccaacgccttctcctcctcctcctctccaccgaggtcgcgccgcgcgcttgccgtcacgatggccgcgtcgctgctcgtgctcgccgtggcgttcctggttggcgctggccacggcggcatcgatgggggtgcagcagctcacgtggaggtagagggctctgaggtgacctacgggagtgtgattaagctgttgcacgagaagacaaagcaccgtctgcactcacatgatgtgccgtacggctcaggcagcggtcagcagtctgtcaccggctttcctgaaggcgatgac

SEQ ID NO: 42183 - DNA, 423 bp, Zea mays
  unsure at all n locations
  Clone ID: LIB3062-001-Q1-K2-F2
acaaggcgcaggtttgcacacagcggtcatggaagaggccctatggtgttggcctcctagttgctggactggacgagtcaggggctcatctgtactacaactgccccagcgggaactactttgagtaccaggcatttgccatcggttctcgttcccaagccgccaagactttcctggagcgcaggttccagggctacaatgactacaccccggagcagctcatcaaggacgccctctccgccataaaggagacgctgcagggtgagaagctatccagctccaactgcacggtggccatcgtaggcaggaaggaggacggcaccatcgagccgttcgagatgattggcgccgcaaggatacaggaacttatcgnactcattgaggtcgccgaggaggcgcccgcggaggaggccagctccatgc

SEQ ID NO: 42184 - DNA, 401 bp, Zea mays
  Clone ID: LIB3062-001-Q1-K2-F3
ctttccttgtttcttcattccggtacgaaggggaggggtccaagtgaagagaagagaaggcctgcgagcgatgggcatcgtcgacgtcgtctccgagttctgctccttgccgaggactcgccggcatctcaagaagaggaagcagttccagacggtggagatgaaggtgcgcatcgactgcgaagggtgcgagcgcaaggtgaagaaggcggtggagggcatgaagggcgtgagctccgtggaggtggcggccaagcagaacaaggtgacggtcacgggctacgtggacgccaccaaagtcatgcgccgcgtcggcctacagacaagcaaaccggtgggagccctgcccctacgtgccctacgagatggtgcagcacccctacgcgccgggcgcctacgac

SEQ ID NO: 42185 - DNA, 392 bp, Zea mays
  Clone ID: LIB3062-001-Q1-K2-F4
ctgtccttgtctcttcattccggtacgaaggcgaggggtccaagtgaagagaagagagggccggcgagcgatgggcatcgtcgacgtcatctccgagttctgctccttgccgaggactcgacggcatctcaagaagaggaagcagttccagacggtggagatgaacgtgcgcattgactgcgaagggtgcgagcgcagggtgcagaatgcggtggagggcctgaagggcctgagctccgtggaggtggcggccaagcagaacaaggcgacgcgaacggactacgtggacgccaccaatgtcatgcgccgcgtcacctacgagacaggcaagcagctggagcactggccctacgtgccctacgagatggtgcactaccctacacgcccggcgc

SEQ ID NO: 42186 - DNA, 220 bp, Zea mays
  Clone ID: LIB3062-001-Q1-K2-F5
aggacaggtactttcccggagacgatgcatacaatcattggtgggtcaccataggaacggtgaccttagttgtttgggccttgcattgaccttggtaaaggcattatctaaaattccgagtgtctttttctctttaatgaaaacctttgatttggccaaaaaaaaagcatccaatgcttaagaagcttaagaaaaggggggccggttttaggattcaagc

SEQ ID NO: 42187 - DNA, 430 bp, Zea mays
  Clone ID: LIB3062-001-Q1-K2-F6
ggcgaacgcgatctgttccccaacctccgcagccgctccaccgtcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccgcaagcatctccccggatgtcattcagatgcttctgcggcatgtcaccaccgtcaagaactg

SEQ ID NO: 42188 - DNA, 363 bp, Zea mays
  Clone ID: LIB3062-001-Q1-K2-F8
ccccaacatcaatgaaagatgtaccatccaagtctcgatccagcagtgatcagcgacacatatcttcaggttgatgctcttggaagagtatctttttcttccatacggaggcctcggtctcttcttgaagtcgaccatccttcatctgctgatggctctcatgatcagaagtccactgtgaggcccctggagaaagaaccaatgcttgcagcaagagtcactgttgaagacgccctttgccttgttcttgaggttgatgacactgaccgtctgttgcagtctagccagtcacaggacaacattttcgaactgaaacgaagacggcaagtcctccttgaaggtctagctgcatcattgcagttt

SEQ ID NO: 42189 - DNA, 410 bp, Zea mays
  Clone ID: LIB3062-001-Q1-K2-F9
cttgtatatcaactctttctataccccagtatcaataagggtcttggacctaacaaaaggtctcgagttgcagctatcctgtgcataccgatcctctttgcctacccctacatgacgtacctgtcggaacctggattgtcaatcgttttgaatattgcgtcagtgataaagaataatctcggtgtcaccatcattacaggcactttcatccttcaaaacaatgccgtgcctcaggaccagcgaggcgctgcgaatggactgtccatgactgggatgtcctttttcaaggcacttgctccagcaggagcatgcattgtgttctcatgggcgcagaaacgccagcatgcgtttttcttcccaggtgaccagatggtattcttccttctgaacgccgtcgagctggtcgggct

SEQ ID NO: 42190 - DNA, 395 bp, Zea mays
  Clone ID: LIB3062-001-Q1-K2-G1
aagtcacactcgtagaaacttgcgcaatggctcaaaagcaaatgtgcatacgggtgctcctcctccctggttaaaagctaacgaacacgatccaaagaatttgtcactcaaaagctgtggtctttcttcccggaaagggaaattgaggaaactcaatccaaacagggttggtgctgcatgggcagaaagaagaagagctgatatggaaatggataagcaaggtgaaattgttccagcaacatctgattctagttggctgcctaattttggtagtgtcttgcaaatctgccccagggaaggatcaagggaaggattttggaaaagccacaagattcatgacacgaagagcgaccatgacttatccttggagataaaaccatatatcagcaaacgga

SEQ ID NO: 42191 - DNA, 399 bp, Zea mays
  unsure at all n locations
  Clone ID: LIB3062-001-Q1-K2-G10
caagttcaagctcgggaagaagatcgggagtggatcatttggggaactttacctcgccgtgaacgtgcagaatggcgaggaggtggctgtcaaactggaatcagtcacatcacgacatccacagcttcactatgaatcaaaactatacatgcttttgcagggtggaactgggattccacatcttaagtggttcggggtggaggggcagtacaatgtcatggtgattgatctgcttggtccaagtctggaggacttatttaactactgcagcagaaagttctcccttaaaacagtactaatgctngctgatcagatgatcagtagagtagaatacatgcacacaaaggggtttctacatcgtgacatcaaacctgattattttctcatgggtttaagacg

SEQ ID NO: 42192 - DNA, 386 bp, Zea mays
  Clone ID: LIB3062-001-Q1-K2-G12
cgtgggatacgctgacagacggacaggctgaagcaaggccagctgctggcggcaggaaggagaagcgaagctgctgcgccctaccctgccacatctcacgtcttactggtcactaaccagacgagagagctagcgcagttcggccgtcggtcgcgtacgacttcagcaaaggcgagcgcccaccgtctgaccctattaccttcctatcgggtccaattcggagcctggctaactccgcacgtctttaccccttttcccttccccgaccgacgaccgtacgtccaccaccggatccaggagcgaccctccttagtgctacgtgacgatcgaccggccgacgatcgatcacgaaggatgtctagcctcgaggagccgttggatctcgg

SEQ ID NO: 42193 - DNA, 434 bp, Zea mays
  Clone ID: LIB3062-001-Q1-K2-E6
ctagatcgcacggccgcccttacttttttttcttcagtccaaaagatgacggttcctgtgatattgatattaaatgcaaaaatttagtcagctccagaattacactgattatcatgttacaaggtcattgcaacttccaggtctctcaactgggaaactagatggttaccgacacaatctcagagtagtagatttcaatattggggtaaaccctaaaccaaacaaaggcagtctaatcgctaaagatgtatcacgccacagcagcactcatttgctcaaatctcactaatgtactctaaaagagattcaacctcctgcctcagggcagcaattttctgctgctgcaaagcaatcctgttctctacatcttgcccgcgcagcttcttctcaaagctgtcgacaacggtggaatgccttgtcatgagcttctcctg

SEQ ID NO: 42194 - DNA, 261 bp, Zea mays
  Clone ID: LIB3062-018-Q1-K1-F5
ggcacggtctaccggggcacctacgatggacaggacgtcgcagtgaagcttttggattggggagaagatggttttgccacagaggctgaaactgctgctttacgaacatcatttaagacggaggttgctgcttggcataagctcatccaccctaatgttacaaagtttgttggtgcatctatggggaccacagaccttaagattccatcaaacaattccaatggtgctgcacgtacaaatttgccagcaagagcatgttgt

SEQ ID NO: 42195 - DNA, 250 bp, Zea mays
  Clone ID: LIB3062-018-Q1-K1-F7
caaagaccaagcaacgaaagagctgtcgacaatgtgagcaataagcagtcatcagatgagaagaagtcagagaccaagcaacgaatgagctgtcgacaatgtgagcaataagcagtcatcagatgagaaaggaacatgccaagagcagtcttcaagagctggcatgcctgctttagtgattgttggggaaaggcgtcacatgcggttagtgggtcgtgtagagagatgtagtggctggtgtcgggcccgt

SEQ ID NO: 42196 - DNA, 317 bp, Zea mays
  Clone ID: LIB3062-018-Q1-K1-F8
cggcagcgcggcgaccatgaacatgtgctctaagtgccacaaggagatgataacgaagcaggatcaggccaagctggctgcctcgtctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccggtgcagcgcctgcaggaagagggttgggctcacgggattcaactgcc

SEQ ID NO: 42197 - DNA, 444 bp, Zea mays
  Clone ID: LIB3062-018-Q1-K1-F9
caagtggaaaaccctcaagaaccggaggctacaaaactggggtactctttgtcttcttcgcacttggtggttttggcttggagattgctttagcttcctcctttccttgacacggtgtcggattgagcaggaggagtggtgcatgagaaggggctcctgccgcaggccttgccttcatggctaacaaggataaccgacagaatctgccagtggactggtttatttccttctgcaatcaatcacgtgctgataaatgagtatcatccctacccaaagggatcatgccacaccaagatggtcctgcctactaccctgtcgttgctatcatatctcttgcttcacctgtcgtgattaatttcacaccccatcaaaagcttaaagagcagcaggacactgatccacaggacttactggcccatgagttgccttcgccagctgagacag

SEQ ID NO: 42198 - DNA, 242 bp, Zea mays
  Clone ID: LIB3062-018-Q1-K1-G1
attcccaggtacacctacgcttacatgaaacgaccataaaacttcaaatttttgattctgctatccaagagcacttcatcacaaggactggcatcttctaccgtggagctgatggaatcattattgtatatgacgtgacagaccaataaagctttaataatgtgaagcaatgattgaacgagatagacccttatgcaagtgataatgttaacaaactccttgttgagaacaagaatgacctt

SEQ ID NO: 42199 - DNA, 179 bp, Zea mays
  Clone ID: LIB3062-018-Q1-K1-G10
cacttcacgccctacctcaccgacgcgctcctccaggactgccacacgggctacctctagctccacgtcaaagactacagccacgtgcgctgcaaaatcagcagctggatctccggccactaccacctcttcttcacatgccccgcgtatctcaccacacccggcggcaacatgcgccc

SEQ ID NO: 42200 - DNA, 423 bp, Zea mays
  Clone ID: LIB3062-018-Q1-K1-G12
aggcctgagcccccaatatcaaaggaaatgatagcattgaaagactcggggatatctaacagcaatacctgatcactacttcgcaattttgtggggcgcattttaggacctagaggtaattctctaaagcgagtagaagcatccactgggtgtcgtgttttcattagaggaaagggctccatcaaagattcagggaaggaggacaaactacggggaaaaccgggctatgagcacctgagtgatccgctgcatatcttgatagaggccgagttccctgccagtatcatcgatgcaaggctgagacaagcacaggagattatagaagaattgcttaaaccagtggacgagtcccaagatctctacaaaaggcagcagctcagggagctggcaatgctgaactcaaccctgagagaggacagccct

SEQ ID NO: 42201 - DNA, 278 bp, Zea mays
  Clone ID: LIB3062-018-Q1-K1-G3
cggacgcgtgggagaaaaacccaagaaatatctctgcggccctgctcgtcccgagccgagccggcgagatggctgcgatgtctcgcgcgatccgcatcttcgccgtcacgtcccggcgaaccctgaccgctgcttcggggccggctctgccgaaggaagcggccgctgcggaagcgctgatgagggcagccgcgcccgtgcgcatgggacgggatctggtggacaggaagctcgtgcagcgggtgctcctagggtgccccctggtggggaagggctcc

SEQ ID NO: 42202 - DNA, 205 bp, Zea mays
  unsure at all n locations
  Clone ID: LIB3062-018-Q1-K1-G4
gcgccatgacccccacaagcttctggaaggatgccttattgctggagttggaatgagggcatgagctgcttacatctacattagaggtgaatacgtgaatgagcgtctcaaccttgagaaagctcggcaggaagcgtatgcagctggacttctgggtaagaatgctngtggctctggttatgattntgatgtgcatattcatttt

SEQ ID NO: 42203 - DNA, 311 bp, Zea mays
  Clone ID: LIB3062-018-Q1-K1-G5
gcaagatgggaagaccataaaacttcaaatttgggatactgctgggcaagagcgcttcaggacagtcactagcagctactaccgcggagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggcatcccattcatggagaccagtgccaaaaacg

SEQ ID NO: 42204 - DNA, 286 bp, Zea mays
  Clone ID: LIB3062-018-Q1-K1-G6
cgacggtgcatgaatgtcacgtcattattccccaggtggtgaatctccaggccgagctgacctggctgcgagcacacctcgccacgctcgagctgccggccccgcccccgctgccggccccgccgcagatgcccatgccaggcccgttctccatctcggacctgccgttgtcgaccagcgtccccaccaccgtcgacctgtccgcgctcttcgacccgccaccaccgcagtgggcgacggcgcatcagccgcaccaccaccatcaacagccgccgcagcaccacca

SEQ ID NO: 42205 - DNA, 284 bp, Zea mays
  unsure at all n locations
  Clone ID: LIB3062-018-Q1-K1-G8
gcagtcggctgccgtggtccggtgacctcctcacgatgcctcccgggaagagatccacacagcgcgtcagggaattccgaagaagaccctcttactgaatacgagaaaatgagggctgtgaatatgatgaagaacaatcaattgtttcaacggctaggccttggacaattaaaaacaatgatcaccgcaacaactacaaacaacaatcaaggcggtcctcaggaatcagngttcttatatgatggtgagaacgttgaggattctggtgaagaggatgttggcat

SEQ ID NO: 42206 - DNA, 319 bp, Zea mays
  Clone ID: LIB3062-018-Q1-K1-G9
acgcataccggacatgtaagccatgcctcgaaagtcatggatctgatgctttagtatgaccgggatggcgacgttggcacctacgatactgctatcaactgcctcagctaacatggagagcttgatgaggccaatggaatcgtacatcatatcgtgcataagggttgtttgccttacaccacaacgttcaacactctcattgatgctctctgctcacataatccactcgatgaagcattggaccttgcacgtcatctaactgttaagggactttctccagatgtctatactttcaatactttgataaatgccctttgca

SEQ ID NO: 42207 - DNA, 291 bp, Zea mays
  Clone ID: LIB3062-018-Q1-K1-H1
gcttggaacaactcttctggtggcggcaatgctctgaatagtcaagcccctggtggacgtgcaggctatggaagccagggctatgggtatggtggatatggaggggatccatcatacgctagtcacggaggatatggggcttatggagcacgtattgatagtgctggcaatcctgctactggtggatcatctggatacaatgcaggctatggaagtggtggtgccaactctggctattcaagtgcttggagtgatccttcgcaagggggtggaattggcgggtcggtcaat

SEQ ID NO: 42208 - DNA, 375 bp, Zea mays
  Clone ID: LIB3062-018-Q1-K1-H11
ctcgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggctaagctgatgggc

SEQ ID NO: 42209 - DNA, 427 bp, Zea mays
  Clone ID: LIB3062-018-Q1-K1-H12
ctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgt

SEQ ID NO: 42210 - DNA, 193 bp, Zea mays
  Clone ID: LIB3062-018-Q1-K1-H2
acagctcggtcacctccttacgatgcctgccgagaagagatccacacagcgctaagagaattccgaagaagagcctcgtactgaatacgagaaaatgagggctgtgaatatgatgaagaacaatcaattgtttcaacggctaagccttggacaattaaaaacaatgatcaccgcaacaactacaaacaacaat

SEQ ID NO: 42211 - DNA, 303 bp, Zea mays
  Clone ID: LIB3062-018-Q1-K1-F4
gcttctccgagtccatgccccagccctacacccgcgcccagctctccgagaagctccggcgccgcaagaacaagttccgcagcatgtccgcgcgcgtcgcggagggcctagacccggctcgcctcgcgccgcacgaccgcgacgtgctccacctctgctccaggctgtgggaccccgccaacgccgccacgtcgcccttcgtggccagcgccggaacgtccgggaacaagcgccgccgcgccaacctgcagggcacgtcactccctcccccagacgcgtctggggatagcaactcccatgact

SEQ ID NO: 42212 - DNA, 276 bp, Zea mays
  Clone ID: LIB3062-018-Q1-K1-H3
atcaaaattctggaaggggcaaaccaacgagtgccccgtgatttagaggatatggcttctcgtggcggtggacgaggtaggaagaggaaccattgggcatcccgccctgacaggggtggttcacgttctgaactggattcaaggtacagcagcagagatggactagcatcttctgggaaatcagagagtggtcgcggcagtcgtggaagggatgataatggtagccgtggcaagtacgaccctggtgaaaccgatgggcgatctcgtaggtctact

SEQ ID NO: 42213 - DNA, 430 bp, Zea mays
  unsure at all n locations
  Clone ID: LIB3062-018-Q1-K1-D12
cccacgcgtccgaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaagaggcgtaccaggtttactggtcgagctgtgtcaagggggttcatacggggcagatggtcctcaaggtcgtcgaggccatcgatgtgtatcttgctggaacagtcatgctgatatttgngatgggtctctacggcctcttcatcagcaacgctcccgcgggtgttcctcctgaatccgaccgtgccctgagcggctcgtcactggtcgggatgttcgctttgaaggaaccgcccgagtggatgaacatcacctngcttgacgagctcaagacaaaagtggggcacg

SEQ ID NO: 42214 - DNA, 312 bp, Zea mays
  Clone ID: LIB3062-018-Q1-K1-D2
gtacatgtcttgatgttagtaattagtagagtatctgaaactgcccattcccgatgtcataacggaaaaaatccttatatgaatatgactgtaagctgaaatcgaataacaaaagtagctcaaatatacaaatggtgacctgtattttcatgttctgctaggtatgacgaattggctagcaagagcaatgttgaatacattgctggaggagccactcaaaactctatcagggttgcccaatggatgcttcaaattcctggtgcatcaagttacataggttgcatcgggaaggataagtttggtgaggagatg

SEQ ID NO: 42215 - DNA, 317 bp, Zea mays
  Clone ID: LIB3062-018-Q1-K1-D3
cttggacatctatcccgctcttggcctattgcacattgcctgccatctgcttgctgacagggaaatttatcacgccagaggttaacaatgttgccagcctgtggttcatgtcacttttcatctgcatttttgctacgagcatcctggaaatgagatggagtggtgtaggcatcgatgactggtggagaaacgagcagttttgggtcattggaggcgtgtcttcacatctctttgctgtgttccagggactcctcaaggtcatagctggtgtagacacgagctttactgtgacatccaagggtggagacgacgaggag

SEQ ID NO: 42216 - DNA, 205 bp, Zea mays
  Clone ID: LIB3062-018-Q1-K1-D4
ggcagcttcccgttgcagtcaagttcatcagctcccccagaaacaatcgtttctgcttggcaagtgaatcaaactgagccagtgaagaagtttgagcccagatctaaactgtggtctgatactttgagccgaggtctagtcaatctggacatttctggaccaaaagcgaatcctcatgctgatattggatagtgactttgattca

SEQ ID NO: 42217 - DNA, 304 bp, Zea mays
  Clone ID: LIB3062-018-Q1-K1-D5
caagaaggaggccgagaacaagttcaagcagatctcggatgcgtacgaagtgctgagcgacccggagaagcgcgcggtgtacgaccagtacggcgaggagggtctcaaggggcaggtgccgtcgtcgggcgccggcggtgcggtccccggcggcgcaaccttcttctccaccggcggcgacgggccgacggtgttccggttcaacccgcgcaacgcggaggacatcttcgccgaattcttcggtggctccagccccttcggcggtatgggcggcggtggcattggcggcagcggcatggggggt

SEQ ID NO: 42218 - DNA, 305 bp, Zea mays
  Clone ID: LIB3062-018-Q1-K1-D7
cagcaagacgctgcagttcgagcacaagctgttctacttcgatctgaaggagaacccgcggaggaggtacgctcaagatctccgagaagacctcggccacgcgctccaccatcatcgtccccgtcgacggcgtggcctggttcctcgacctcttcgactactacatccgcaccgacgagcgcgacgccttcagcaaggagctgcgactccagaccaaggtgttctatttcgatatcggggagaacaagaggggccgattcctcaaggtttctgaggcctctgtcaaccgaaaccggagtaccata

SEQ ID NO: 42219 - DNA, 276 bp, Zea mays
  Clone ID: LIB3062-018-Q1-K1-D8
cccaatccaaaccagacaagcaaggaatcccccgatggctcatcgcgttctcctcctcctctctctcgcgtcggccgccgaggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccg

SEQ ID NO: 42220 - DNA, 339 bp, Zea mays
  Clone ID: LIB3062-018-Q1-K1-D9
cgaactactaaagcatgttttgcactgtctttatatagtgatgccatcaatgggccctgcatgttaggttatggttcagttttggacaggaacagttagtgcattctttgatggaacagcaggctaggtatgttagggaaaaaaatttggtgcagcactgctgcaaaccagagtggttgcagcccctcacaaaaagaaggatagaccccacccgtattttttccgtatgttagttacgcacgcggtagaccctagtgttgtttcatgcatggatcagtcttatggattcttgtattatatctgttcccccattaaccagtgctgtcaaagttttgggct

SEQ ID NO: 42221 - DNA, 300 bp, Zea mays
  Clone ID: LIB3062-018-Q1-K1-E2
gtttttctttctggttattatatctgccgcaggatgtatattttgatgatgaatctgcagagggagtaatctcctcccttcgccttggagacgaccaagaaaggtttattctttttatatttgatttgactactgttcttccttttgtaagcacatttggtgtttgatacaagaattggctaatgaagatgtcatttgcagtggctcgctctttacaaattccaactggtttgcatttgacgaggacaaggcactgaatgatggtttggttagcccagaagcttccccatctccaaattc

SEQ ID NO: 42222 - DNA, 287 bp, Zea mays
  unsure at all n locations
  Clone ID: LIB3062-018-Q1-K1-E3
cgagtcgcgacagagagagaggcggagttgcggagaagatgcagagcagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatacggatccgncctcaacatccgcaaggatctcgatgcccaaatcctctccagggtccaaaggcccccttgtgctttg

SEQ ID NO: 42223 - DNA, 275 bp, Zea mays
  Clone ID: LIB3062-018-Q1-K1-E4
gattgtgatagcgacaagcatgcttgttttgcatcaggtgttagcgagtgagaacccagagatgacttcttctgagctggagaatgccacttcggaactgttcaacgtcctcacaaggctgctagacaactttccagatgttggcactgagaaaatcattgaggccatgatgtactcgtcaacctcaaggagcttgtcagatcatgaaaggatgaacgccagaaaagagatattgactagggtcttccttagaagcctccagaccgatgacaccg

SEQ ID NO: 42224 - DNA, 278 bp, Zea mays
  Clone ID: LIB3062-018-Q1-K1-E5
caggctccctcctccctcctgcctactccttcctgcaaatcgccaaatcctgcaggcaccaccggtcgggttcctgtgcggggaacaggagagaaggggagagaccgagagagggggaggcgcggcgtccgccggatctgctccgacccccgacgcatcctgtcacgccgtcctcactctcagccagcgaaaatgggtgccggaagcaggatgaccgagaaggagcgggaggagcaggagcatgagcaggtcggccgtgctaccggcggtggcgcggc

SEQ ID NO: 42225 - DNA, 213 bp, Zea mays
  Clone ID: LIB3062-018-Q1-K1-E7
accaacaacaacagcaacggcgtggaggtgaagagctacttcaacaagtccgccgggagggcggcgagcagcaacaacaacaacagcagccacgccggcggcggcaacaagaagggcggcgccggggagtacggcaggaagaagcacgccaagagcgatggcgcggcggcggcggcggccacggacaagcagcggttcaagacgctgtcggcg

SEQ ID NO: 42226 - DNA, 244 bp, Zea mays
  Clone ID: LIB3062-018-Q1-K1-F1
gtcaagcgtgaaaagatcaggaggaaccagctgatctaccaggacaagccgcggctcaagactgggttggagatgctcaggaccagcatgtacatagaagacagcttgtcacaggtgacgctgccgttcttcgtcctgcacggcgaggccgacacggtgacggacccggaggtgagccgcgcgctgtacgagcgttcggccagcgcctacaagaccatcaagctgtacccggggatgtggcacg

SEQ ID NO: 42227 - DNA, 423 bp, Zea mays
  Clone ID: LIB3062-018-Q1-K1-F10
gaatcgtctgccaactacgcaggccgtggtggtcgtggtgaccgcggcagggggcgtggtgcccgtggccgctggcgcggccgtgctggaccttcgtcccgcatcagcgacaatcgtggtcgtggctcaaacgcacgaccgccctgccagatctgtggcaaggagggtcataccgccatccgttgctggcacaggaatgacgacagctacaacactgatcctcccatggtggcaatggcggccacctcctcgaccaaaattgatccaaattggtacgtcgacacgggagcaacagatcacatcactagtgatctcgatcgactgatgcttcgtgaacgctatcatggtggtgagcaagtccaagtcggcaatggtgcaggaccgtcagacgaagagaaagctcctggaaggacaatctaagaa

SEQ ID NO: 42228 - DNA, 427 bp, Zea mays
  Clone ID: LIB3062-018-Q1-K1-F11
cgccggtttgtggccgcctccgccgcagttcgccggtctgtggccgcctccctgctctgcagttcgccgatctgtggccgccgccgccgtcacctgtcagtcgtcgattggagcagccgccggcgcgacgtgaggtatgtgaccgtcagcctgccagtcgccggtgtgcagtgaggtctgtggccatcagcctgccagccgccgattggagccgccaccgcgaggtctgtggccgtcgttcgttgattggagccgccgcccgacgagccgtgggctcgtggccgatgccgccgtcgatttgtggtcatcagtcgctgattggagttgtcgcccgatgattggtgggtttgtagccgcccccgccaatagactgtgggtttgtagccgttgttgtcgatccgtgtcgcagtgccacccatcgatccac

SEQ ID NO: 42229 - DNA, 448 bp, Zea mays
  Clone ID: LIB3062-018-Q1-K1-F12
gctcttggaagcatgttcttgggtacattctggttagggagaagaatggttctcgggtgattgccgggccaggcgcatagcatcattatcacctcaaatggagatgtatattcgtttggagcaaactgctccggtcagcttggccttggggattcagaagaccggttcaagccatgtgttattaggtctctacaaggcatcagaatcacacaagctgcagttggttcgagatgcacaatgcttgtgagtgacacaggaagcgtctactcatttgggaaggaggatttcagggtcgcagaactagttgacggtgctcattttcagatcacaactcctaggattgaggagtcactgaaaggtgtgtttgtagttcaagcagccatagggggttacttctctgcagttctgtccagagagggtcgagtgtacaccttctcatggggcaaag

SEQ ID NO: 42230 - DNA, 315 bp, Zea mays
  Clone ID: LIB3062-018-Q1-K1-F3
ggagagggcatgggtcctgtcaaaaagactgccagagccctaggagaatcattgtttgacaaagagcttggaaaaccaattgggcagcttattgtcatttgtggccggaacaaaacgctaagctcctcactgcaggcagttgaatggaaaataccagtaaaggttaggggatttgaaacccaaatggagaagtggatgggagcttgtgattgcattataacaaaagctggaccaggtaccattgctgaagccttgataaggggtcttcctataatccttaatgacttcatacctggacaggaagttggcaacgta

SEQ ID NO: 42231 - DNA, 449 bp, Zea mays
  Clone ID: LIB3062-018-Q1-K1-D11
gtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgccgcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtg

SEQ ID NO: 42232 - DNA, 430 bp, Zea mays
  unsure at all n locations
  Clone ID: LIB3062-018-Q1-K1-A9
gcgactgccaacagccttcagaagccttggtacctggtccttggtaaccatgactacacgggaaacgcgctcgcgcagctcgaccctgccattcgcaaagtggatagccggtacaccgccattgccaagtccttcattgtcaactcagggattgcggattttttcctcgtcgacacaacgccgttcattgtccactactggaacaacaccaagttcgattggagaggcgtcgctcctcgagacacctacatcgcgaatctcctcaaggacttgaagtgtgcactgacagcgtccaaggctccctggaagatcgtcgtgggtcaccaccccatcagcagcgcctgcgggcatgggaacaacactgagctggaggagttgcttctcccggtcctcaggacacacggngttgacatgtacttgaatggccatg

SEQ ID NO: 42233 - DNA, 132 bp, Zea mays
  unsure at all n locations
  Clone ID: LIB3062-018-Q1-K1-B1
atctgaggcaagatattgatcagctagtactcagaagacactagcccttcgtatctgaggataggtnctacggctcggctattctgaacggtaaaacttgcacaaggcaactctgacattacaacaatggat

SEQ ID NO: 42234 - DNA, 435 bp, Zea mays
  Clone ID: LIB3062-018-Q1-K1-B11
gcagaagccaccgatcggcgtgccgcgtgcgtgaggcgatcggagcatcccgtgccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgcccttgacagacagcactcggagttttcatgatgggtttcataatcctcccatgatgatttaacatttgtttgatcaatttcagttcaacgccttttcatcgttccatatgcatatatg

SEQ ID NO: 42235 - DNA, 374 bp, Zea mays
  Clone ID: LIB3062-018-Q1-K1-B12
cgcacgcaagccaaaggaaaaggcaagatgcggagcccaaggggtggaggcggcctggagcacgtggatctgatgcccggcatccccgacgacgtcgccgtggactgcctggcccgcgtcccgcacgcctcccaccgcgcgatgcgccgggtctgccgcggctggcggagcgccgccgcggcgccggccttcgcgtcggcgcgcgccgcggcgggcgccaacgaggacctggtgtacctgatgcagttcgggaacccgtccgccgacgacgggcccaaggacggggacgacgggccgggcaacaccccggcgtacggcgtggcggtgtacaacgtgacgacgggcgagtggcggcgggagcgcggcgcgccggc

SEQ ID NO: 42236 - DNA, 180 bp, Zea mays
  Clone ID: LIB3062-018-Q1-K1-B2
agcgccagcggcggtcagcgtcagcgtcagcgcccgaccaaatttcccccctcacctcggcctgggccgtcgtcggcatggccaccgacgtgctgcgcgcgcgcaacgtcctcttgccggcgccgccgcagaggatccgggcggcggctgcggcgcgccggagggcatctggtagcgaca

SEQ ID NO: 42237 - DNA, 334 bp, Zea mays
  Clone ID: LIB3062-018-Q1-K1-B3
gaggtgctggccaccaatggtgacactcatcttggaagtgaggactttgaccagaggatcatggagtacttcatcaagttgatcaagaagaagtacagcaaggacatcagcaaggacaaccgtgctcttggaaagctgaggagggaagccgagcgcgccaagagagccctcagcaaccagcaccaggtccgtgttgagatcgagtccctctttgacgggaccgatttctcggagccgctgacccgtgccaggtttgaggagctgaacaacgacctcttccgcaagaccatgggccctgtcaagaaagccatggaagatgctggccttgaaaaga

SEQ ID NO: 42238 - DNA, 323 bp, Zea mays
  unsure at all n locations
  Clone ID: LIB3062-018-Q1-K1-B4
ggatattggtcgttgcctgaaatgcgaatgctttgtcactgatgtatttggacgatctagtgaaggggtatccgctgtgactgctcctattttgccaggaaggcctaaaattgaaaagctggagattgaaggaagaggtttccacactgacctatatgccgttcagggtacctatagcggaggcaaagaaggcaagagtaaaatacaatggctcagatcgatggttggaagccctgatcttatctncatacctggcgaaactggaagaacgtatgaagctaatgttgatgatgtanggtataggcttggtgcaatttatacac

SEQ ID NO: 42239 - DNA, 274 bp, Zea mays
  Clone ID: LIB3062-018-Q1-K1-B6
ccgcgaatcacagacgcgtctatctcagcttgctgcgctgcactaccctgccctgccatcatatggtacgtgagcccggccgagcgagagcgaggtacaggcatggctgctccgaagctcgcgacgctggcgctggccgtgctcctggcggcgaccgtggtggctaccgcggccgcggtgcacgcggcgatgtcgtgttccaccgtgtacagcacgctgatgccgtgcctgccgttcgtccaaatgggcggggccatgccgtcccagccgtgct

SEQ ID NO: 42240 - DNA, 288 bp, Zea mays
  Clone ID: LIB3062-018-Q1-K1-B8
caccaagcagagcaagccagtgaggtctctcagagcgtagccagccagctacaatggcggtgagcgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcaag

SEQ ID NO: 42241 - DNA, 397 bp, Zea mays
  Clone ID: LIB3062-018-Q1-K1-B9
acgccgcgtttgtctaccccgacggcctgcttcctcttgcccccgactccgccagccactgggccctgcatatacaatacccgagacagctgtgtgtactatgactacagggagaacaacggattcatcaccgccaggcgtcaggtcagagtgtgttaagaaaagatcgtggcgaatggcgactcacctgctagagggagtgcgacggtagctgcaagcctgcgcaggcgtaggaccacaagcgttgctgctgctggcagaggtggtgccagctcgatgctccagttctacaccgatgaagctgctggccgcaaaatgtcaccaaacacttttctgatcatgagcattgggttcatagctgttgtcgctatgctccatgtttttgggaaactgtacc

SEQ ID NO: 42242 - DNA, 426 bp, Zea mays
  unsure at all n locations
  Clone ID: LIB3062-018-Q1-K1-C12
acactgctgtctcccacggcctgtggctgaacatccctgactatgatgcacccacccagctggtcaagcctaaggagaggaacgaaaggtacgttgatgctgtcatgacaatccccaagggaaccttgttccccatgtgcggcatgaaccttgccttcgacagggatctcattggccctgccatgtacttcggtctcatgggtgatggccagcccattggtcgctacgacgacatgtgggccggatggtgtgtgaaggtcatctgtgaccacttgagcctgggagtcaagactggcttgccatacatctggcacagcaaggctagcaaccccttcgttaacttgaagaaggaatacaagggcatcttctggcaggaggacatcatccncttcttccagaacgtgaccattcccaaggattgcaaca

SEQ ID NO: 42243 - DNA, 297 bp, Zea mays
  Clone ID: LIB3062-018-Q1-K1-C2
ccacctgctagctctctgtctcctgctcagagtcgcagttcgctttgttgtactagagcgctgagcagatctttccttgtttcttcattccggtacgaaggggaggggtccaagtgaagagaagagaaggcctgcgagcgatgggcatcgtcgacgtcgtctccgagttctgctccttgccgaggactcgccggcatctcaagaagaggaagcagttccaggtatatataaaccatcttcttctatttctgttcggagtctcttatcccagccagcccaacaactgaactgaacggg

SEQ ID NO: 42244 - DNA, 242 bp, Zea mays
  Clone ID: LIB3062-018-Q1-K1-C3
aatgttctgcctcctaatgccattgtctcagctggttctgtgagttctgcatgcactgctggaggtggacagttgtacatgtggggtaagatgaagaatacaggcgatgattggatgtacccgaaacctgtgatggatttaagtggttggaacattcgctgcatggcttctggtaacatgcaccacattgttggtgctgatgattcttgcataagctggggtgtcgcccataatggagagct

SEQ ID NO: 42245 - DNA, 329 bp, Zea mays
  Clone ID: LIB3062-018-Q1-K1-C4
aagacaatctctgcctgctcaaatgaagtatctgaaggttgtaagtgtccagtgggtttcaaaggtgatggagaaaaaagttgtgaagacattgatgaatgcaaagagaaactttactgtcagtgcaagggttgcagctgcaagaatacatggggaagctacgagtgcagctgtggtgatgacaatatgctatacatgagggagcatgacacttgcatcagcaaagagggaactgccactactgttggctggagcttcctctgggttattttctttggacttgtttttgctggggttggagcatacgccgtgtacaaatacaggctgag

SEQ ID NO: 42246 - DNA, 283 bp, Zea mays
  Clone ID: LIB3062-018-Q1-K1-C6
gaacagattggcttcatggccttttccctgtatttatgtgtagtcaggtccaattcttttctgagtatgagcgcaagtttttcgtagatgactcgcggtcacggcaatatttgtgatattgtgtcatctgtggactatggttaaatttcagttatttgttttctttcaccttccagaactgttagcaagagcattctggaccaggatgctcgaacacaactggctgtatgtacatttgggaatggtgaataaagaaggggtaataaactgctgcgaaataaaa

SEQ ID NO: 42247 - DNA, 262 bp, Zea mays
  Clone ID: LIB3062-018-Q1-K1-C8
tgaattcccgggcttagtaatcggattgggccaaggatggatttcattcctggtgtcgattgtcctagtgagggtgtaccccggctgctggcgtgcttgagtcacaatctgctccgccgagagcctttgaagctcgtcgatgggggccagtctcagagaacctttgtatacatcaaggatgccatcgaaactgatgagctcatgattgaaaatcctgctctagccaatggtcacatcttcaatgctgggaatcctgacaatg

SEQ ID NO: 42248 - DNA, 422 bp, Zea mays
  unsure at all n locations
  Clone ID: LIB3062-018-Q1-K1-C9
cacgccgccactgatctgctctgttgctggtgactaggagcagtagcgagagggattctggatggccaagtcgaagaaccacacggcgcataaccaatcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggagatccatcagttggtaccgaagtgtattttatgtcttgttggttacctggaatttaattaanaccatcagttgtat

SEQ ID NO: 42249 - DNA, 189 bp, Zea mays
  Clone ID: LIB3062-018-Q1-K1-D1
acgaatgtgctgcctcctaatgccatagtttgaattggctctgagagttctgcatgcactgcggaaagaggacagtatcacataggggggaagatgaagaatacaagcaatgattggatttacccgaaacctatgatggattcaaattattggaacattcactgcatggcttctggtaacatgcaccac

SEQ ID NO: 42250 - DNA, 424 bp, Zea mays
  Clone ID: LIB3062-018-Q1-K1-D10
gcagctcaacattgaagatgttgtgctgccagatattaaaagtacacaaaaacaggatggtgcatcaagtgaaagaggccctggaaatgagaatgtactggatgatttatacggggaggaaaatagttcaaattggttgaacgaagagcatgacgtacagatggctgatgtggaagaagagcatggcgaacagatggatgatgtcgaagaagagcatgatcttggaaatgatggtggtgatgatgatcttggggatgtttttgattggtactaagttgatcatggctggatgatgtggaagaagaacctgatcttggaaatgaatggggggaatatgatcctggggaatgttttgaatggttctaggttggacatggctgggaataagactcacggatttatgattatgattctgctaaatgtt

SEQ ID NO: 42251 - DNA, 208 bp, Zea mays
  Clone ID: LIB3062-018-Q1-K1-A8
ggatgaagagaagaaggacggcggcgagaagaatgaggagaagaaggacggcggcgacggagacggctacgagaaggacgaggccggcgacaaggacaaggacccggccgtcagcctgtacatgcactacccgcggttcccgttcgctggagggtactaccagccgccggcctacccgtcgtctccggggtacccgtacgcctaccag

SEQ ID NO: 42252 - DNA, 400 bp, Zea mays
  Clone ID: LIB3062-001-Q1-K2-D2
ggattgcaggagtgcccgaagatgaagagtccggcctcctcccccgcccgtccgcagccggccgacggccgtcctcccgcggcccccgcttcccgcctccaccggcagcctgggcgacggtggacggccccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgcccctatgttgtgcggtcggcaattggcttcaccatcttctccgttgttctggtcacctgggccacgaccttcgtcgtcggaggcgagcggttatttgggccagtgtggaa

SEQ ID NO: 42253 - DNA, 420 bp, Zea mays
  unsure at all n locations
  Clone ID: LIB3062-001-Q1-K2-D3
ggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagattgggcaacggcagcggctcagctcgtcaagtttgtgctgggatgccagtttatcccctctagtctattacagaaatgttgttcggaactgagtctaatataaacatnctggtctgagtttattggtgagtggtgccagtttttttcaatatacatttatcttaanaacagcggtactgatgttttttggcctaaa

SEQ ID NO: 42254 - DNA, 433 bp, Zea mays
  Clone ID: LIB3062-001-Q1-K2-D4
caggctagctctctagccagtccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcaacaaggtgaccatgctcggggtgcgcaagaccgccgactactccttcaccaaggtcgtggcgtcgctcagcctcgcgggcaggaagcggcgcggcggagcgttcggcgcccagatgaggttttacgcttacacagtggggacggttgcacgacgtgagcaagcgcagcgaagccagcacaaccgccggcggacaagcgtccccatagacgagatccatggcggagcgccggaagagcgtctcctccatgccgtttgcttcggcgagcgccg

SEQ ID NO: 42255 - DNA, 349 bp, Zea mays
  Clone ID: LIB3062-001-Q1-K2-D5
gtggcggggacgagcccgacggccatccgcatcgcgcagggggcggcgtccaagacgtggtacaccagcttcggcgcgatggtggccatcgacgacccgctgacgacaggcccgacgcgcgccgcgggcaccgaggtgggccgcgcccagtgcacctacacgtctgcggaccagcacacgttcggcctactaatggtgatggacttcgtgttcacggccggggagcacaagggcagcacgctctccatcctcggccgcaacgaggtactcagcgacttacgcgagatgagcatcgtcggcggcagcggaaagtcccgaatgaaccccggttacttcaagcccccaacct

SEQ ID NO: 42256 - DNA, 434 bp, Zea mays
  Clone ID: LIB3062-001-Q1-K2-D6
ggatgctggtcggcgacgtcccgtgggagatgtttgtcgagtcatgcaagcgtctgaggatcatgaagagttctgaagccataggtcttgcaccaagaacgaaggacaagtgcaagaacaagagctgaagaagatgcagtgttaaagatgttgcccattgtatcagaagaatggtccccttgcagtgcgctgccgttttttttttcctactagaaatataacgcgttttaattactagttggagggagacctgtcttgttcaactcgttcatggaccagaagcaataatatatccgtgtgtagctggattggtgttatgtcatgtcccctaccgtgtctcccagaatctacttggtgattttattccagtgttgttaatcaagtttatgtgattgttaagtaaagggcatcaatgggactattattatttaaaa

SEQ ID NO: 42257 - DNA, 384 bp, Zea mays
  unsure at all n locations
  Clone ID: LIB3062-001-Q1-K2-D7
ctctcgatcgatcgcttcctccatcgaggcggtaaagcgccgcccagatcgccggaagcaagcggcgacctcaccagctccgagcagcagcagggaggctcgtggaaccattagtcgttttctggcagcggcatggaggggctgagctggaaaacggtgtgttgtttatcggtgctctgtgccgtgcctgtcttgcgcccggccgagggcatncgcttcgtgatcgatagggaagagtgcttctcgcataacgtggaatacgagggggatactgtccatgtatccttcgtcgtcatcaaggctgacaccccgtggcattacagcgaggagggcgtcgatcttgtggttaaggatcctaatggcgctcaagtccgggattcccga

SEQ ID NO: 42258 - DNA, 430 bp, Zea mays
  unsure at all n locations
  Clone ID: LIB3062-001-Q1-K2-D8
ctctcgatcgatcgcttcctccatcgaggcggtaaagcgccgcccagatcgccggaggcaagcggcgacctcaccagctccgagcagcagcagggaggctcgtggaaccattagtcgttttctggcagcggcatggaggggctgagctggagaacggtgtgttgtttatcggtgctctgtgccgtgctgttcttgcgcccggccgagggcatccgcttcgtgatcgatagggaagagtgcttctcgcataacgtggaatacgagggggatactgtccatgtatccttcgtcgtcatcaaggctgacaccccgtggcattacagcgaggagggcgtcgatcttgtggttaaggatcctaatggcgctcaagtncgtgattcccgagataagactagtgacaagtttgagttcatagttcagaagagaggcg

SEQ ID NO: 42259 - DNA, 445 bp, Zea mays
  unsure at all n locations
  Clone ID: LIB3062-001-Q1-K2-D9
cagctcgctagcatagcagcaaccagcaatggactccaccaagttatccgcgctgctggcgctcgcggtgctcgggctctcctcgtcgccgctcgctctcgcgtgggagaaggcgcaaccggagtgccactcgtgcgagtccggctcgccgccctcaaccggcgtccccctgcccccaatcagcataccgtcagtccccctgcccccagtcagcataccgtcagtcccactgccccctgtcagtataccgtcggtccccatcccaccggtcacccagctgcccccagtcgtcggactgccgccggtgacccttccttccattccgatcatcggaggaagcccgccgaagaaaggccaccggaaggcgtgcccgccgnctccgtctcccncgacgcccacgcncacgcncacgccgtcctcggacaagtgccccatcgacgcgctg

SEQ ID NO: 42260 - DNA, 407 bp, Zea mays
  Clone ID: LIB3062-001-Q1-K2-E10
caagctccttcgcctcgaaccctctcgcgcttgggctggctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggatgatattggtgatgttacaatcactaatgatggagcaaccatacttaagatgttggaagttgagcatccagccgccaaggttcttgttgagttggctgagctccaagatcgtgaggtaggagatggaactacttccgttgtcatcatagcggcagagttactcaagagaggcaatg

SEQ ID NO: 42261 - DNA, 427 bp, Zea mays
  unsure at all n locations
  Clone ID: LIB3062-001-Q1-K2-E11
cgacgagagctgcgctaggtgatctcgactgcttcctggtcccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctggcaatatgacagcagccatgtgtgtgtattctggactctntatgaggtttgcatggatggtacagccccgaaattatttgcttctagcatgccatgcttgcaatgaaagcgtccagctgtatcagttatctcgctgggctaggtctcaggggtacctggagaagaaagagccagaggccaaacagtaaagagggtatccaacactgcagtcatttgttcaataaagaaaatatgctgtggaaaaca

SEQ ID NO: 42262 - DNA, 420 bp, Zea mays
  Clone ID: LIB3062-001-Q1-K2-E12
ggtaaaaggaccatcctgcacaaaggtaatttaataggatataaagcgaagttgggacgctaaagaggtgttaaaagaagttagccaattgttggaattgatgaacggtaaaacactactcgagcaagcgaggttaaatttgctagaaaacttagaacacgatacacttactaaatagtgaagtcatatcgttatattcaaatggtactacgaagaacgagatgcagtcacgagcttatcattgtgcccttggagtcaagttgtgctaacaatagaactctaccttagcaagggtcatgacatagtattagtatctatagtctactccggtgtatagatctgagtgtattttttgggagttcatcattaaaatgctggtgatgcaatctgtcgagagttggaacatggtgatactccaga

SEQ ID NO: 42263 - DNA, 431 bp, Zea mays
  unsure at all n locations
  Clone ID: LIB3062-001-Q1-K2-E2
cgacccaattctcctcaatcaaagaaagtccccacgcagagcaagccaagatctgcgccgcggcgaggcgaggcgaagcaaagcaccggctggctcccatggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccttcgcagccgccgatcggcgagatcgccgaccaggccgtctccaggttccgcaaggtcatctccatcctggaccgcaccggccacgcccgcttccggcgggggcccgtcgtcgagccgncaccggtgcctgctccggccgtcgccgctcccgctccggccccc

SEQ ID NO: 42264 - DNA, 388 bp, Zea mays
  Clone ID: LIB3062-001-Q1-K2-E3
cgacccaagtctcctcaatcaaagacagtccccacgcagagcaagccaagatctgcggcgcggcgaggcgaggcgaatcaaagcaccggctggctcccatggccgcggacctgatggggtgctacgccccgcgccgagccaacgaccagctagccatccaggaggcggccgcagcggacgctccaaagcctggagctcctcgtgtcgtacgctgtccacgcacgccgacgcgccgaacaaggccgatgctcaccagctgcagaagccggcttcgcagacgccgatcggcgagatcgccgacgcaggccgtctgcaggttccagcaggtcatctgcatcctggaccgcaccggccacgcgcgcttgcgacgcgggcccgtcgtctagcc

SEQ ID NO: 42265 - DNA, 432 bp, Zea mays
  unsure at all n locations
  Clone ID: LIB3062-001-Q1-K2-E4
gtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaagatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggcttccttgatgaccatagctgcaaatgctggcattgatggagctatagtcatagggaaactgattgaacaagaggacctcagttgngctatgatgc

SEQ ID NO: 42266 - DNA, 364 bp, Zea mays
  Clone ID: LIB3062-001-Q1-K2-E5
gggaagtgaactagcggtccacgatactccgacgcccactttgctacctcggagccctagccgccgcccatggatatcgccggagaccggcgccggtagcgatacgcaaaaggagtggtacgttctttgaccttgtttattgctgcgcccgaggcgtgtggcgcggggggagcaggaaggagaggggaagaacagaaggggaaggcgggcggggccgcgatgtcggtgcggatcaaggcggttgtagaccggttcgtgaaggagctgcaggaggcgctggacgcggacatccaagaccgcgtcatgaaggagcgcgagatgcagagctacatcgaggagcgcgagcgcgaggtcgccgagcggg

SEQ ID NO: 42267 - DNA, 279 bp, Zea mays
  Clone ID: LIB3062-001-Q1-K2-D12
cagaaatccagctcgcacctagtacactcttacgcacgatacctaacaacttcccaaggcgaccactttgtcgctcgcgctttgctatcaccggcagaccccaccctcaccctaaacgccttgactaaaagcacagacaacgaccttatactcctactactatacacagacgtcacgccgagcgcttggcgttacgattgccgcgtcactggtagtgctcaacgtggccttcctcgtatgcgctagccactgcagtctcgatggtcgtacaagcgatca

SEQ ID NO: 42268 - DNA, 228 bp, Zea mays
  Clone ID: LIB3062-001-Q1-K2-B5
gaacctcgccgaccacctcgccgaccccgtcaacaacaacgcatgggcctacgccaccaactttgtgcccggcaagtgagggggtcggaggcgccaccgcccaccggccaccgctgcggatatctaggtgttcggatgcacgtgagcgcgcactggttccagtttgtaccatgatgtaaattacttaccgtaccagggttcaatcggcaaggaagaattgttgtgttc

SEQ ID NO: 42269 - DNA, 434 bp, Zea mays
  Clone ID: LIB3062-001-Q1-K2-B6
aagatgcactgccatggctggcggtctatttactgcatcccgaagcggcctgcattcaaaggttctgcgcctctgaacctttccgaccgtcttcaccaggtccttcgctgggcccttgggtccgtcgaaattttcttcagcaagcactgcccactttggtacggatacggcggcgggctaaaattcctggaaaggttttcttatatcaactccatcgtttatccctggacgtccattcctctcctggcttactgtaccttgcctgccatctgcctgctcacggggaagtttatcacaccagagcttaccaatgtcgccagtatctggttcatggcacttttcatctgcatctccgtgaccggcatcctggaaatgaggtggagtggcgtggccatcgacgactggtggaagaacgagcagttctgggtcatcgg

SEQ ID NO: 42270 - DNA, 99 bp, Zea mays
  Clone ID: LIB3062-001-Q1-K2-B7
aagatgcactcccatgtctgtccgactattcactgcatgccgaagcgtcctggggtcgaatgtacttctcctatgaacgtatccaaccgacttgaccaa

SEQ ID NO: 42271 - DNA, 426 bp, Zea mays
  Clone ID: LIB3062-001-Q1-K2-B8
cgcctcggcttgtccccaccaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaagaactccaatccagtgtggaacgaagtactgcagctctcagtaacacatcctacgaagccagtgcaccttgaagtttttgatgaagacaagttcacagcagacgacagcatgggtgttgctgagatcaacattactgacatctacgatgctgcgaagctggacctgaagcacgcctctgatgggacaaggatcaagacgatctaccctgt

SEQ ID NO: 42272 - DNA, 304 bp, Zea mays
  Clone ID: LIB3062-001-Q1-K2-C1
aaaccgccaaccgcagtttatgttggcaagattgccccaacagtagacaatggtttccttctttcacttctcgagctgtgtggacctgtcaagagttggaagcgtgccgaagatccaagtaatggaaaacctaaaggttttgggttttgtgagtttgaatctgctgaaggcatccttcgtgcgacacggcttctcaacaaattgagccttgatggtcaggaactggtgattaatataaatgatgccaccaaggagtacctgaagaaacatgttgaggaaaagaagagaggcccagtgaagtcaa

SEQ ID NO: 42273 - DNA, 408 bp, Zea mays
  Clone ID: LIB3062-001-Q1-K2-C10
gcatctcacatgataaaatgctgcctaaatatttcttggaagaactcttgagtggcccggaggtcgcccatggtgatgaacctgctgaagctggtagtgatgacagtgatgacgatagcgatgatgatgtgatggatgtagacatcgcggcaacctcttctaaaggttcaaggagtaaaaaggcaggtcaaggacagagttcgagtcagccggcatcggatttctatgcagatctatagtcgtcaagtttcctaagttagaagctgagtactctcctctatggttcattctgggttactgtacgcgagtgcgtgtgcgagtgggcaactttgaccgccggtgcatggcatgccaaatgttgttttatgtataagtatatcgctgatggcatttatcagaagtagaagc

SEQ ID NO: 42274 - DNA, 444 bp, Zea mays
  Clone ID: LIB3062-001-Q1-K2-C11
ggtttggatgattggctctgttcacagctgaggaatcctacacacccgagctgctctattcctacttctatccagggcctctccactttgctaagagaaccatatgttaggacattatttgttcaagctgatggcatcaagctgctcattcccttaatttccccagcttccacacaacagtcaattcaacttcctttatgaaacttgcctctgcatctggcttttatccttttatgatgctgcagttgattatttgtccaccacaagggttatgccaagacttgtagaggttgtcaagggctctactaaagagaaagtggtcagagttgttgtgttgtccttccgcaatttgctggcaaagggtgcatttgctgcccagatgatcgatcttggattgccacaaatggtacaaaacttgaaagctcaagcatggactgatgagga

SEQ ID NO: 42275 - DNA, 414 bp, Zea mays
  Clone ID: LIB3062-001-Q1-K2-C12
gacaatcaaaagctaccccctatccgatccaaccctctctggctgctacctcgttcggccggcatcggcagtgcacgatggctctgaggatgtgggcgagctcagccgacaatgcgctcaagctctcggcgggcggcggcggagcccgggctgctgctgccggcccggccttctctatctccaggttcttctccactgttcacgatgggttgaagtacactcagtctcacgaatgggtcaagacgacgggcgacgtcgccaccgttggcatcacggaccatgctcagggccacctgtgagaggtggtgttcgtggagctgccggaacccggcacgaaggtcgccgcgggaggacccttcggcaacgtggagagtgtcaaggccaccagcgacgtcaactccccgatctacggcg

SEQ ID NO: 42276 - DNA, 436 bp, Zea mays
  Clone ID: LIB3062-001-Q1-K2-C2
caatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgaca

SEQ ID NO: 42277 - DNA, 401 bp, Zea mays
  Clone ID: LIB3062-001-Q1-K2-C3
ggacatgtgcacaactggaggcactgaatgtttccgtgctaggtggcgtgtctcagacagtagacttgcagacgttgtgcaacatagaaggctgggatgcgtacgcgttggcttttcaggcgacggaagagcaggcacatcttcaattcatgaaccctggcatggaggatgatccaacttgtggtcctatcctagacaacgttgccggcaagaagctcttcaccccagacaaaccaaaggataacgtggtgctgaatggagactttgacgagggtccatggatggtccccaacacgagcttcggcgtgctgctcccaactaaccttgacgagcaaacgtctgccatacctggttggatgatcgagtcaaaccgcgccgtccgctacatagactctgatgag

SEQ ID NO: 42278 - DNA, 439 bp, Zea mays
  unsure at all n locations
  Clone ID: LIB3062-001-Q1-K2-C4
aaaaggctttagagctaatgataaacagcaagaaggaaacgactccacctccgcagcaaaagatggagagattgcaaagttttgaggaggaacacaagaatgctctccagagagcaaagaccctggatgttcctcatgctgcggacctgtctgaagaggagattcaggaggatagcactgcaccaccctctgatactcatagcgaaacaaccacggaaacaaaatctggaggtagaacgagttgggacgaactgatggagaagcttttcaccagggatgaagatgggagacttgtcgtgaacaaggacgcgatggcgagggaaattgttgtcctgtaacgagtgccgagactgctctgtccgtggtagtttattctattagcgaactgtataaaaagagtagcttgcggtgtgatatatntaaaactgttttcaacaac

SEQ ID NO: 42279 - DNA, 398 bp, Zea mays
  Clone ID: LIB3062-001-Q1-K2-C5
aaaaggctttagagctaatgataaacatcacgaaggaaacgactccacctccggagcgaaagatggagagattgcaaagttttgaggaggaacacaagaatgctctccagagagcaaagaccctggatgttcctcatgctgcggacctgtctgaagaggagattcaggaggatagcactgcaccaccctctgatactcatagcgaaacaaccacggaaacaaaatctggaagtagaacgagttgggacgaactgatggagaagcttttcaccagggatgaagatgggagacttgtcgtgaacaaggacgcgatggcgagggaaattgttgtcctgtaacgagtgccgagactgctctgtccgtggtagtttattctattagcgagctgtataaaagag

SEQ ID NO: 42280 - DNA, 432 bp, Zea mays
  unsure at all n locations
  Clone ID: LIB3062-001-Q1-K2-C6
gagaatgtcactgtaacaccccaccttggagctagtactgtcgaggctcaggaaggcgtcgctatcgagattgcggaagccgtggttggtgcgctgagaggggagctcgcagcaaccgctgtgaatgcgcccatggtcccagctgagatcctgtcagagctggctccatatgtttctctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaaacgcgactacacggccaaacagcgcggccttcgnctcacggaggagcgcgtggcgcacgacagccccgcggcg

SEQ ID NO: 42281 - DNA, 428 bp, Zea mays
  Clone ID: LIB3062-001-Q1-K2-C9
gggagagcgaggagagacagatacagatcgcgcgctgagatgtcgtcggactcctcgtcgtgggcgcgcgccctggtgcagatctcgccctacaccttctccgccatcggcatcgccgtctccatcggcgtctctgttctcggcgcggcatggggtatcttcatcacggggagcagcctcatcggggccgccatcaaagcgcccaggatcacatctaagaacctcatcagtgtcatcttctgtgaggctgttgcaatttatggtgtaattgtggcaatcatcctccagacaaagcttgaaagtgtgccaacatcccaaatgtacgatccggagtctcttcgagctggctatgcgatctttgcatctggtcttatcgttggcttcgctaatcttgtttgcggggtatgtgtggggataatcggaagcag

SEQ ID NO: 42282 - DNA, 341 bp, Zea mays
  Clone ID: LIB3062-001-Q1-K2-D10
cagatcgataccataccaggctccatcaatggactccaccaagttatccgcgctgctggcgctcgcagtgctcacgctctattcgacgtcgctcgctctcgcgtgggaaaaggcgcatcccgagtgccactcgtgcgagtcctgctcgccgccctcaaccggccttcccctgccccctatcagcataccgtcagtccccctgccatcagtcatcataccgtcagttccactgcccactgtcagtataccgtctgtccacatcccaccggtcacccatcttcccacagtcctcagactgccgccagtgacccttcctgccattccgatcatcggatgaagcc

SEQ ID NO: 42283 - DNA, 334 bp, Zea mays
  Clone ID: LIB3062-001-Q1-K2-A1
catctctccacacaactaagaagccagcggcagtaacaggagtgaagcaaaaaaatggcatcatcaacgggatcagagatgagcgaggaaatcgatgtccagcttagtccagaggagaaagaaagtttagatgagatcatcaaggaagctgagagcgacttggagtctgaggaagtcctggatcaatcccttgccattgttgccgagaatgaaggtctggacaaggacgcagctgcaaaactcacaatttacactgtaggtggtgttttgaagaatctgacagagggccccttgagtgttatggataagcacatatatgcaggacacactgtca

SEQ ID NO: 42284 - DNA, 440 bp, Zea mays
  Clone ID: LIB3062-001-Q1-K2-A10
aagaataaagattctctctttatgtgtagggctgacaaatgtgtactagcatcttctggctttcaaggtgatagtaaagctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgacagcgaggggaaagggtgtgttttcacctatgatgcagtaggttcctatgagagaactggttatagtgctcaaggaacgggatctactttgattatgccagtcctggacaatcaactaaaatcaccaagtcctctattgctccctgccagggatgctgtcacaccattgtcggaatcagaggccatcgatctagttaaggatgtgtt

SEQ ID NO: 42285 - DNA, 392 bp, Zea mays
  Clone ID: LIB3062-001-Q1-K2-A11
cggtatcccaggggataccgaagggttacgagagtacatggccaagtttggacccctggacgattgtgtcgtcatgaaggagcggtcttctgggcgatctcgcgggtttggctatgtaacattcgcctcagctgacgatgcaaagaatgttcttgattgcgagcatgttcttgggagccgtacattagaagtgaaggtagctactccaaaggaagaaatgaaatcacaaggatcaaagaaagctacaaggatattcgttgctcgaattccgcaatcggtggatgagtcgatgtttcgtagacattttgaagcttttggggaaattcttgatctttacatgccaaaggaacatggttcaaaagggcatcgtggaattgggtttatcacgtttc

SEQ ID NO: 42286 - DNA, 414 bp, Zea mays
  Clone ID: LIB3062-001-Q1-K2-A12
gaactccctgggcctcgtctcggccaggaagaccgccgaggcgatcgacatcctgaagctcatgtcgtccaccgacatcgtggcgctgtgccaggccgtggacctgcgccacctcgaggagaacatcaaggcgtcggtgaagaacaccgtgacccaggtggccaagaaggtgctgaccatgaacccctcgggcgagctctccagcgcccgcttcagcgagaaggagctgatcagcgccatcgaccgcgaggccgtgttcacgtacgcggaggacgcggccagcgccagcctgccgctgatgcagaagctgcgcgccgtgctggtggaccacgccctcagcagcggcgacgcggagcgggagcccttcgtgttctccaagatcaccaggttcgaagaggagctccgcgcggtgct

SEQ ID NO: 42287 - DNA, 353 bp, Zea mays
  Clone ID: LIB3062-001-Q1-K2-A2
ctgggaaaggcatccgatttatccgtgctgattctcaggttttcctttttgccaactcaaaatgcaagcgctacttccacaaccgcctgaagcctgcaaagcttacctggacagcaatgtacaggaagcagcacaagaaggatatccatgctgaggctgtcaagaagaggcgccgcgccaccaagaagccatactcgaggtccattgtgggtgcttccctagaggtgatccagaagaagagggctgagaagcccgaggtccgcgatgctgctagagaagctgctcttcgtgagatcaaagaacgcatcaagaagaacaaggattaaaagaaagccaaaaaagcttaagtgacc

SEQ ID NO: 42288 - DNA, 380 bp, Zea mays
  Clone ID: LIB3062-001-Q1-K2-A3
ggatgcgacaaatgttggggatgaaggtggttttgcacctaacattcaggaaaacagagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttacca

SEQ ID NO: 42289 - DNA, 289 bp, Zea mays
  Clone ID: LIB3062-001-Q1-K2-A4
tagggaaacgtgggcgacgcggccatcacccacgttctacacagcaagcaagagttcacgctcgacaacggcgtacgccacctactagtgctctccatcagagccagcgcctgctacaccggcgagtgcgacatttccagtactcccgttcccgctcattccttgtctgcgaaagagctgactcacgagaccaacgaggatgtcgagaacatcgaggactagtacatggtcacaggctacgggaacgcatacgtacacaactacttacgcgttcagtacggtatggagt

SEQ ID NO: 42290 - DNA, 426 bp, Zea mays
  Clone ID: LIB3062-001-Q1-K2-A5
gtccgtaacaagatctcttggctggaggcaaggttgggcgcccgcgacctgtgtgatgacattgtgcacgataacgacgacacagtgcagtcagaagagcattggtttgtgcgaaggtgcagagggctgtgggcaatggcaggggagaggctagggttcactgacgaggagagattgaggaagttgcagactaagaaacttgtgctcgcaagcaggctatctgattataaggaagggtgcgcccctggcgctggtgtagcttttgtggtgtttaaagatgtctacaccgcaaacaaggcggtaaaggatttcaagatggagaggaagaagacaccgattggtaggtttttcccagtgatggagctccagctcgagagaagtcgatggaaagtggagagagcaccaccggcatcagatatctactgg

SEQ ID NO: 42291 - DNA, 428 bp, Zea mays
  Clone ID: LIB3062-001-Q1-K2-A6
cttggtcatatgtcaatcacacagtgccaggttattgtttcaatgggggatgaatatgtacctgaatatgttgataagagggctctactagacaggctatgtagggcgctgggaggtgcagagaaagtcgagatagaatggggaaaccatgctctgtccaacagagtgcaagaagcagttgtggccattgtagattttgtcaagagggaggggcccaaaggctgggacgacccatggagctagatacagcagttataatctcatttgtaactagtttgtgcttttcctcttctctcttttctccaattgtaacatctttcttttgcattattattggtccatttttcaatagtgatatgctatttttcttataaccccctcccccaaacatgcatcgcgttctcattctagtatggtgtatcacatat

SEQ ID NO: 42292 - DNA, 401 bp, Zea mays
  Clone ID: LIB3062-001-Q1-K2-A7
agcaaaggtccggcgagccagagcaatagttaacaaccatctccacaaacaggctacgacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttccagctctacaaccgtaggaccgccgccaagccgccttcgttctccgtctcccagcagcaggccggtgccgccaccttcaagaccgacgccgccatccctgacgccgccggccggaccgtcgtctgtgacgtgcacggagccctgctgcgctcctccgcgctcttcccctacttcatggtcgtggcctacg

SEQ ID NO: 42293 - DNA, 427 bp, Zea mays
  Clone ID: LIB3062-001-Q1-K2-A8
ggggctcaggtcagagacataccttcttccattggatttctcataaacttgcagaccttgagccttcaaggttgccaaagcttgcagagacttcctcggtccatcagggcattgctagagcttagatgcctttgtctctatggaacttccctaagctatgtaccaaagggtgttggtaaattgaagcatctcaatcatctagatggtctaatcattggtcatgacaacaatgcgcctgagggttgtgacttagatgaccttaaagcattgtcagaactaaggcaccttcatatagagagtttggatagggctacttccggtgcgtctgcactcgcaaacaagccattcctagaggatctgtacctctctgagcaagcaccagcaatagaaaatcaggaggatctggaggacaaagatgaaacagaaa

SEQ ID NO: 42294 - DNA, 431 bp, Zea mays
  unsure at all n locations
  Clone ID: LIB3062-001-Q1-K2-B1
caacgccgagctcgacccggagaagaggctgtaccccggcggctcctacttcgacccgctcggcctggcggccgaccctgagaagaaggagcggctgcagctggcggagatcaagcacgcgcggctcgccatggtcgccttcctcggcttcgccgtgcaagccgncggcaccggcaaggggccgctcaacaactgggccacccacctgagcgacccgctccacaccaacatcttcgacacgttccgaaggtcctcttaagcccgccattggctccgcccgtccatcgaccggccggaacgtgttcttggattaattaactacgatctctatgagcctggggatggatcaacccgtcgtgcgtggtctcgttttgtgatgagtgggagagagaggatggcaagatcgatcctttngtaatggagatcctcgt

SEQ ID NO: 42295 - DNA, 356 bp, Zea mays
  Clone ID: LIB3062-001-Q1-K2-B10
cggacgcgtgggtctggaacgataacaaggccatttggagagaaccagattcagatgccaatgccacagcctgggggtatcagacctggtgatggtatgattcggccttgtttggttggcccattacctggacatcatggtgctgtgttgccttcttttgatcttgaacgtttgggtcagccacgtcctcttggaatgttgaacagcaatgactttggtggtgatgggttcaacgcttcagggggtgcagcgtatcctgaaagacatgataataccgaagacagtcggaaacattttccagcaccagcccctctagatgatcaaggcttgcgaaaggaccctaaacattttgagag

SEQ ID NO: 42296 - DNA, 430 bp, Zea mays
  Clone ID: LIB3062-001-Q1-K2-B11
gccacaaaagatgaggtgtcagttcacagtataagattaccaaaaaacagcactgttggcgatgtgctgaatgatatcaaaacgaaggttgagttgtctcataccaatgctgagctaagattacttgaggtcttttatcacaagatatacaaggtatttgcaccaaatgaaaagattgaaaacatcaatgatcagtactggacactgcgtgcagaggaggttccagaggaggagaaaaatcttggccccttcgatcgtttgattcatgtatatcattttacaaaagacactcaaaaccaaacgcaagttcagaactttggagaacctttttttatggttattcgtgaggatgagaccctatcttctatcaaagaacgtatacagaaaaagcttaaggttccagatgaggatttctcaaagtggaagtttg

SEQ ID NO: 42297 - DNA, 400 bp, Zea mays
  Clone ID: LIB3062-001-Q1-K2-B12
gtttactatgacaccagtgaggggaggaaggtatgcacctattaccatttggtgtccaggcctgctattctcctaattgaccccgtcactgggcaaaaagtacatgcttggaatggaatggttcacccagaccgtttactcgaggatttactaccttacctggataaaggtccgaaggggcaccatgcagctcaacctcaaaagcgcccaaggaaagttgatcaggaagcttctacgggcaagcaaggcaaaatcgctgtagaggatgaggatgaagaactagcaagggcaatagcagcttcgctagaggtagtcattgaagcatcagacgccagtgatgatgatatggctgaagctgaacctgatgaggaaaatgagcccagcttaaacatcaagcctg

SEQ ID NO: 42298 - DNA, 247 bp, Zea mays
  Clone ID: LIB3062-001-Q1-K2-B2
gcggcatcagccggcaacactggaccatcatcacatagtgcaacgacagtgacactcatggggggttgcatgagtctgatgagcttgatgcgagctgcaaattctagcattggcagagccatccttgagccacacatgggacagctagtacactcagagcaatgatcattcgtgccccaatggcgaacgaaattagtcatgacattcatgaacatgctattgacatagagtccaggatgccggaata

SEQ ID NO: 42299 - DNA, 385 bp, Zea mays
  Clone ID: LIB3062-017-Q1-K1-H12
tcgctcagaggcggccttgaccttagtaagcgagaacccagccactctggtctctctctggtctggctctgctctgctcttgggtctcgcgctcgcgactcctcgggcggcgcgcctcgccggtcgccatggcctcctcctcttctgaggttaggcccgcgagcaggaggatcgttgattacctcaacgacggcgaggagctcggggcccagggggcggcggtggagacgccgccgtgttcccctgctgcggttgcggtggggaaacaggccaagtcagcgctgcccaggttcaggtggccgcggctcgtcaggctgcggagagagggaggcggcgacgaggggaagccgggggtcgtggtggagaagggcgacgacctccacgt

SEQ ID NO: 42300 - DNA, 124 bp, Zea mays
  Clone ID: LIB3062-017-Q1-K1-H2
ggggcttggaacacattctgatattattcaactataaagttcaagctatatgctctttgttcggattgcaagctaccatgcaaatgactgacaggaaaatgatcctagccacacgcatacaaaa

SEQ ID NO: 42301 - DNA, 358 bp, Zea mays
  Clone ID: LIB3062-017-Q1-K1-H3
ctccgcgcattttccttgcaaccgattgcctatccccctcccaaccaaagaccgatggcgcccaaggccgagaggaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacttcttcgagaagctggccggcg

SEQ ID NO: 42302 - DNA, 412 bp, Zea mays
  unsure at all n locations
  Clone ID: LIB3062-017-Q1-K1-H4
gcgggggnggnnnnnnnggnnngnnnnncttttttgactgctcaaaatacttcatattaaataaggttatacgggtcgtaacgacaaatttagagcctcaggactaagttttagagttctaaaagcttcagtgcactttagctcgctttaaaagctctaaagctttaatttaaggtgggcttataatgtttagaggtaacatgtaaatcatttgtttggagccttaactttaaaacttaaagaggttaattacccaaaaagaccccagggccaaataaccttaaccccattgccttgggtcccagcacggatcaaaatttcttcaaacgagatgaagaacggaatggttcgtcgcttcacatatagcgcgggtgtgccaagattcaggacggaaagttcagtttgtcaccgc

SEQ ID NO: 42303 - DNA, 419 bp, Zea mays
  Clone ID: LIB3062-017-Q1-K1-H5
cttgagggaaaaaaaataaagggagaagctctcctgagaagcatatagcaccagcggaacacgggaacggcggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgatgagactgttaagttcgaaatctgggatactgccgggcaagagaggtatcatagcttggcttccatgtactataggggtgc

SEQ ID NO: 42304 - DNA, 424 bp, Zea mays
  unsure at all n locations
  Clone ID: LIB3062-017-Q1-K1-H6
agccacgcgtccgggggcttggaacacattctgatattatgcaactataaagttcaagctatatgggcgtgtttggatggcagcctcccatgcaactgcctgacaggcaaatgatcctagccacaggcataggaaatcgaacgcccggcattgttgcctgngccaggcaagaaactgataaaacttaggcgtatagtgctggatgctccatccactggacatacacttaagcttctgtcagcttctgattggattgaaatgttccttactttgagcattaaggtgcttcggtagaaggtacgagcccgccatcttttcgacctatacgtgcgagatgtccgtgcttgaggtagctctatgtcgagggaaagacgtcgcctagagccatcccatctctgagcatcgnggtctccccgatgtggat

SEQ ID NO: 42305 - DNA, 347 bp, Zea mays
  Clone ID: LIB3062-017-Q1-K1-H7
aagggatctccggtccccgggccccggctcctcccctcccgattccaatctggtctcaccgggcctggcggcgagggagagatggggaagaaccaggcgtacaaggcgatgcagcgggcgcggctggggtcctcgtccggcgcgccgggcgccgccgacgcccccgaagacggcatggaagaggaactgaaaaggggtgagctggaggctgacaaagacaaaatgatgagagagtatagagctcaactggatgctgaaagagctcaaaagctagcaaacggaagaaatcactcaaggtcaaactcaaaatcatcatcttccaagaaagagaggaaggataaggacgc

SEQ ID NO: 42306 - DNA, 429 bp, Zea mays
  Clone ID: LIB3062-017-Q1-K1-H8
ccacgcgtccggtcgcgaggcaaggccatcgtccgccatgacgctctccctctccacctctttggtcgccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactatgtcggcgacacctcggcgctcgtggtcatggacagccagatcgagaagttccgcaagaagtggggccacatcaaggagtactggcccgaggaccagtggagggagatgcacccagacggcgacccggagttcgagcccgagggggacaactg

SEQ ID NO: 42307 - DNA, 166 bp, Zea mays
  Clone ID: LIB3062-018-Q1-K1-A1
caaaatgcggtagcattggtgaagcacgagctgtatttgagagcattacatgcaaagacctggtgtcttggaactacttgatctttggatattcacagcatggccttgcgtgagcattgactatactggctaagagacttggatggacacatgataccggatgcac

SEQ ID NO: 42308 - DNA, 433 bp, Zea mays
  Clone ID: LIB3062-018-Q1-K1-A11
gcgcatacacaaatggcacctgtcgtacagcaagatgtatgacaggcacggagacgctgcatcgacatgatgcatggccattatactgcgcgacgatcgagccttaatgcaggtctgctgccacattgaagtctggatctgcctgtaactgaccttcctcgggtaccattcgggcactatgtacacacgtctgggccattaccaagtatgcggccgagacgcggtagcatgcattgcgcgcgcgaagtgactctatggcaggggacgcggtgtgcgcgtgtcttgagatgtgattccttccttccttgtttagttgctgctgctcctgctggtgtagtactggtgtatccagtccttttaatttcttgattagtttgctcggctgaagaaatcaggacgcgtgcctggagttgctgctcagctccatgtactt

SEQ ID NO: 42309 - DNA, 430 bp, Zea mays
  Clone ID: LIB3062-018-Q1-K1-A12
gattcttgaggcgaagccccggtgcgtaagagtctgccatggccagcgagaatgaggtctttgggttcgaggaagtcgccaagcacaacgtcaccaaggactgctggatcatcatcgccggcaaggtgtatgacgtcactccgtttatggatgagcatcctggtggagacgaggttttgctagctgtaaccgggaaagatgctacagctgatttcgaagatattggccacagtgattccgcaagggacatgatggagaagtaccacatcgggcagatagatgcttcaacaatcccagcaaagcgtgctcatgtgcagccccagcaagcacccagccatgcagacaaggataatgaacctcccatcaagatcctacagttccttgtgcccattatgatcctgggccttgcatttggtatacggcagtacac

SEQ ID NO: 42310 - DNA, 304 bp, Zea mays
  unsure at all n locations
  Clone ID: LIB3062-018-Q1-K1-A2
gtcagccagccctaaacccttctgtcccgatggcgtcgtcgtcgtcttcgccgccgccgaagctgccgattcccggccgcggcaacatactcatcactagcgcacttccgtacgtcaataatgtcccgcacctagggaacatcatcggctgtgtgctcagcgcagacgtgttcgcgcggtactgccggctccggggttacaacgctatctacatatgcgggacggacgagtatggcaccgncaccgaaacgaatgccatggaggagaagtgcacgcccaaggagatctgcgataagtaccatgc

SEQ ID NO: 42311 - DNA, 188 bp, Zea mays
  Clone ID: LIB3062-018-Q1-K1-A3
gcgtaagaagaagacgtacaccaagcccaataagatcaagcacaagcacaagaaggtgagactcggccgactgcaattctataatgcggacgacgccactggcaaggggacccgccttcgcaaggagtgccccaacacagagtgcggcgcgggcgtcttcatggccaaccacttcgaccgtcactact

SEQ ID NO: 42312 - DNA, 347 bp, Zea mays
  Clone ID: LIB3062-018-Q1-K1-A4
gggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccatgaggcgcttcaggaggctcttccgggcgacaatgttggcttcaacgtgaagaacgttgctgtcaaggatctcaagcgtgggttcg

SEQ ID NO: 42313 - DNA, 177 bp, Zea mays
  Clone ID: LIB3062-018-Q1-K1-A5
atgaacgaccaaggcagtgatcatgactccgtgcactcccctggggctgtctcgtcgcgcgaggaacacgtcgcgagccttatttctggttccagctgcagatcccaatgcatgagctgtagttccagcgtataagactaagaggtcaccagagcagggacaccgcttaatcaggcg

SEQ ID NO: 42314 - DNA, 230 bp, Zea mays
  Clone ID: LIB3062-018-Q1-K1-A6
gcgatggtgtcaagggcaccatctttttcacccaagtgggagatggccctaccactgtcaccggagagagtgtctggcctcaagcctggcctccatgggtttcatgtgcatgcgcttggtgacaccaccaatggctgcatgtcaactggaccacactacaatcctgcgagcaaggaacatggagcaccagaagatgagaaccgccatgccggtgatcttggaaatgtgac

SEQ ID NO: 42315 - DNA, 296 bp, Zea mays
  Clone ID: LIB3062-018-Q1-K1-A7
ggctggtggatccacccatcaagcacctgctgcatgcctggcatgacgagctcgaaaggcttgcgattgagcttgcaaaaactgccatcaaaacctttgctgaagtcataagcactatcgtgcatcttcaggaagaggaagtaaacctaaggaggcggtgtgatgaaactcgtagggatctgaaccgaaagaaggcacagttcgaggactggcatcaaaagtacttggagagacagacagcagaaactcaaaacatagatcctgtcgaggataggaaacgcaccttcgaggaacta

SEQ ID NO: 42316 - DNA, 414 bp, Zea mays
  Clone ID: LIB3062-017-Q1-K1-H1
cagtgttgccagcctgtggttcatgtcacttttcatctgcatttttgctacgagcatgctggaaatgagatggagtggtgtaggcatcgatgactggtggagaaacgagcagttttgggtcattggaggcgtgtcttcacatctctttgctgtgttccagggactcctcaaggtcatagctggtgtagacacgagcttcactgtgacatccaagggtggagacgacgaggagttctcagagctgtacacattcaaatggacgacccttctgatacctccgacaaccctgctcctactgaacttcattggagtggtagctggcatcttcaatgcgatcaacaacggatatgaatcatggggccccctgttcggaaagctcttctttgcattttgggtgatcgtccatctttaccc

SEQ ID NO: 42317 - DNA, 340 bp, Zea mays
  Clone ID: LIB3062-017-Q1-K1-F2
aagtgagtgagaaagagagagagaggagggaaaatgctgcgccacgccgaccggcgagtcgtttaccgcgccgtcgctccgtccaccgcgcgccgggcgctcgccacggcggaggtgcccgccgaggccgtcgaggactccacgttcgtcgaggcctggaaaaaggtcgaccccaacatcgagcccccagcgacgcccctctgcctcatgcagacgcgcccgcccacgccagctaccatgcctaccaagctcaccgtcgacttggtcctaccctacaagtccgagatcgccaacaaggaggttgacatggtaattgtaccaactacaactggtcagatgg

SEQ ID NO: 42318 - DNA, 414 bp, Zea mays
  Clone ID: LIB3062-017-Q1-K1-F3
tgctttctcatatgaggtgggagtgcagatggttgagatttacaacgaacaagtgctgtatcttttatcaaatgatattgcacaaaaaagacttggaatttggagtacatctcagcctaacggacttgttgtccctgatgcaagtttacatccagtcaaatcaacattggatgtgctagagttgatggaaattgggcaaacaaatagagcagttggatcgacagctctgaatgaaaggagcagtcgatctcacagcattctaactgtgcatgttagaggggtggatttgaagaatggttctacttccagaggatgtctacatctgattgatcttgctgggagtgaaagagttgagcgatctgaagcaattggagatagattaaaagaagcacagtatattaacaaattcctctc

SEQ ID NO: 42319 - DNA, 429 bp, Zea mays
  unsure at all n locations
  Clone ID: LIB3062-017-Q1-K1-F4
gctgaactagagtcggcattctctggattgaatgtgcttattgagacatactgtggggacattcctgctgagtcctacaagaccctcacgtcattgagtggtgtgactgcttacggttttgatcttatccgtggagccaagacccttgatcttatcaggagcagcttcccctctgggaagtacctcttcgctggtgttgtggatggacgcaacatttgggctgatgatcttgctgcatctcttagcactcttcagtctcttgaggccgttgctggcaaggacaaacttgtggtgtcaacctcctgctcactgatgcacaccgncgttgatcttgtaaatgagactaagctggatgatgagattaagtcatggcttgcatttgctgcccaaaaggttgtcgaggttaatgcccttgcgaaggctttggca

SEQ ID NO: 42320 - DNA, 420 bp, Zea mays
  Clone ID: LIB3062-017-Q1-K1-F5
cggacgcgtgggttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtaagctgtaacat

SEQ ID NO: 42321 - DNA, 337 bp, Zea mays
  Clone ID: LIB3062-017-Q1-K1-F6
ttgcgaggcactgcaagcagtactgataaaactgaaataacctagtttacgctgattactgggtcgattatccaaagaggcctgcagacctgaactatatatgcattcttcacgaagattacgtgatacaactaatgaggactgaattggacctacgtgtgctcactgggggaatctaggctgttacggttggtacttaaaggcctacataacgtactacataggctattgcatactatatgcaatacgatgcaatataggaggccctctgattaaaccttgttggcttcaacgtggacaatcgttctataagagacctgcttacttactctttcat

SEQ ID NO: 42322 - DNA, 413 bp, Zea mays
  Clone ID: LIB3062-017-Q1-K1-F7
caggtaagcagcagcaggaaccctagcaccgccgcatccgcagccatgggtatcgacgctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgccttacatttg

SEQ ID NO: 42323 - DNA, 176 bp, Zea mays
  Clone ID: LIB3062-017-Q1-K1-F8
acactataaatatgctgcacaactcataccaacttactcatattccctcattcaacttcacatacattcatatcaacataataaatcctataatagatcctaatttctcacacacataaaacacttcaatctacaactcttaatcaaactaacactctatctcacatcaatctaac

SEQ ID NO: 42324 - DNA, 387 bp, Zea mays
  Clone ID: LIB3062-017-Q1-K1-F9
ggccgagctggtcaaggcctgcaccaccatcatctggatcgcgtcggcgctccacgcggccgtcaacttcgggcagtacccgtacgccgggtacctcccgaaccgcccgtccgtcagccggaagccgatgccggcgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgc

SEQ ID NO: 42325 - DNA, 339 bp, Zea mays
  unsure at all n locations
  Clone ID: LIB3062-017-Q1-K1-G11
caaaacggacatgtcagccatgccttgaaagtcatggatctgatgcttcangagggccatgatcctgatgttttcacctacaatactgttatcaactgcctcagtaaaaatggagagcttgatgaggccaagggaattgtaaatcagatggtggatggggttgtttgcctgacaccacaacgttcaacactctcattgntgctctgtgctcacagaatcgacttgaggaagcattggaccttgcacgtgagctaactgtgaanggactntctncagatgtctatactttcaatattttgataaatgccctttgcaaggtangagatcctcatcttggca

SEQ ID NO: 42326 - DNA, 423 bp, Zea mays
  unsure at all n locations
  Clone ID: LIB3062-017-Q1-K1-G12
ggtgacggtggccgcggcgctgccgcccgtgtaccagggccacggcgacgtggacgtgtggtcgcccgtgctcttcggccccggcgtgcgcttcgcgccctacctcgccgacgcgctccggcaggactgccaggcgggctacctcgtacttcaggtcaaggtcgacggccgcgtgcggtggaaggtcggcagctggatctccggccactaccacctcttcgtcacctgccccgcgttcctcgtcaccgncggcggcaacggcgcccccggcgctttcgggttcaggttccagaccaccacgtactgtcacgtcgaggtttaattaggagcgagaggaagcagagaccatggctacctctctagctgctgctcctgccgttgcctggtgtggcaataactctgtctatctctctctctctctct

SEQ ID NO: 42327 - DNA, 434 bp, Zea mays
  Clone ID: LIB3062-017-Q1-K1-G2
gtccgtagaattgaagcgatcgccattaacgtttcagtgtttagatactggaggtttgggcgtccttgatgatggcttcactttcctagtgtggttaggtaggatgctcccgcctgaacttgtgaacaacattcttggagtgagcttggcaaacttccctgacctatcaaagattgtattgagagagtgtgacaatgaattgtcaagaaatttcatgaaaatactaagatccctgcgcgagaaggatccttcctatcaccagctatgccgtgtggtgcgacagggtgaacagccaagagaaagctatctgcttctatctaaccttgttgaggaccagatggctgggacaagtagttacgttgattggatacagcaaattcaccgtcaaacgcaaagctaatgacgaagaaccaacaggaagcgatgcttggaat

SEQ ID NO: 42328 - DNA, 443 bp, Zea mays
  Clone ID: LIB3062-017-Q1-K1-G3
atctgcttgcagtcaagaaggatcttgaaccagaatattcatgcagagttgttcaacgcatccatgaagatgtgccagaagaagtccttgctttggacaaaagagttgagtgtaactccaggattgccgttgcactttcattaatggatgagtgcttccttccgattattgaccagagaactggcatcaacttgatacgaaatgttgcgtatagctgtggatcaaattttgcccggttggatttccgtggattctatatatttattttagaacgtggagatgaaataatagctgcagcatctgtccgaatacatggaaccaagttagctgacatgcctgtcattggtacccggaatatgtataggcgacaagggatgtgccgccgacttggagattgaatccaaatgatcctcagctctctcaatgttgagaagttgatcatt

SEQ ID NO: 42329 - DNA, 202 bp, Zea mays
  Clone ID: LIB3062-017-Q1-K1-G4
cggacacatgggccaacggtttaacccgatcgagcgcggcaacgcaaacctgcgatgcctgctgagagcaagggatggcagcctcatggtcagtgctgtcggcagtcctcgtcgatgcacaagtggcttctgccgcgccggtcacagagccaacgttcactctgggcgcctatgaactacagattccgctctgatgatgcta

SEQ ID NO: 42330 - DNA, 351 bp, Zea mays
  Clone ID: LIB3062-017-Q1-K1-G5
ggaaaccttccgccacctccttgggaggctcagccagcggcaagcaacgaaatgccaaatggtgaattgggaggcgtgcaacctcttcctgggacagctgggcagttcggcggcatgcagcaggcactgcaaccacaagttaaccacatgggagttccacaaaggcagccaatgtacagcaaccagccaggggttgtggtggcgccaacacagatgcaggcaggcttggggaaccagcagttgggttcgacatccatgatgggcatgcctccacagatgtatggcggcggatcgcaggcagccatgatgtacccgcaacaaatgccaatggcgccgcagcaaccgatgtat

SEQ ID NO: 42331 - DNA, 250 bp, Zea mays
  Clone ID: LIB3062-017-Q1-K1-G7
cggacccttccgccaactgtataacattatcaagcaccgtaactcaaacctcggcacgcctacttaaagcaggggatcgcaacctcatactcagacctctcggcagtcctcgtacttgcacaaatcacttctgccacacctgtcacagatccaacgttcactttacgcgcctaagatctactaattaccctatgatgatgctaacgacgtagtacattatcaaacaatctcaccacaaaacttagctaaa

SEQ ID NO: 42332 - DNA, 375 bp, Zea mays
  Clone ID: LIB3062-017-Q1-K1-G8
acgcgtctatctcagcttgctgcgctgcactaccctgccctgccatcatatcgtacgtgagcgcgggcgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgtcccagccgtgctgcggcggcatccgcagcctgctgcagcaggccaacaacaccctcgaccgccgcaccatctgcggctgcctcaagaacgtcgccaacggcgccaacgggagcggcacctacatca

SEQ ID NO: 42333 - DNA, 429 bp, Zea mays
  unsure at all n locations
  Clone ID: LIB3062-017-Q1-K1-G9
attcctgcaaacgtcgccatgcaatatgacaggagtgcagtgtcgcctgaaagccagtttagtggttcatcccttcagagtcaagcttcaagagggtccaatacgctagcattgggcccttcacagcaacatcaaagttttgcattcccagcactcggccagtccatgcagccaacaggcctgaatccttttgaagaatggccgcagcaacaggaaaactgtggcggtgttgatgactacctgatggagatcaggatgaggagccatgagattctcgaaaacgaagaaatgcagcagatgttgcggcttctgagccgggtggtgcaggaaccaacctaactgaagatggcttcagtttcccttcgtacatgccttgaacttcaccaaaattgagctacgaggatgaccgnacccgtgcacctgggaaag

SEQ ID NO: 42334 - DNA, 308 bp, Zea mays
  Clone ID: LIB3062-017-Q1-K1-F12
ctatactcatctcctcactctacctgattcgaaaactcggccactcatgactgcccgtagctgggatatcattgctctcaggtcacacgcacatgcatcttctcttgcagcacactcttcccgtccgcctggccctgctaatctacaaaactcatgcccgccatcatcaatatcgtctattacactcatgacaattacacactctacacctcattcgacattcacaatgactccgacttacaccccaactgtcgactcatttgggaaacaggatttcacagtcctgcacctactcaactgtcctcatt

SEQ ID NO: 42335 - DNA, 410 bp, Zea mays
  Clone ID: LIB3062-017-Q1-K1-D8
ctccatctccccttctctggcctccggagccacgctgagagatggaggcgaatcccaagaacaccttcacgaggaagtgtatgacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcaggctctgcgttgcagaagctgggagtgcagccaggttcccgggtggggatctacggagcgaactgtcctcagtggataatggcaatgc

SEQ ID NO: 42336 - DNA, 435 bp, Zea mays
  Clone ID: LIB3062-017-Q1-K1-D9
cgctggaggccgcgtacagcttcgacggccagccgttcgagcgcgtgcaggtcgcggagagggcgagaagcagggcgccaggaagacggtggtgtaccacctggcctcgagctcggacgccaggggcgtggcgctgggcaacgccggcgaggccgagttcaggaaggagaacgcgacgggactgttcgaggtggaggtggcggtcaccggcaagttcaagtacacgctgcgcaagaccaagtgcaagatcgaggccacctgccccctcaaactgcagctcgccacgccgggggcggcgacgacgtcgtccgtcgtgttccagaaggttgactgcgaggtcgccaaatccgacgacaagtactgctagagatgatgatgggtttgcaaatgtcattgatttggagagatgatgtgttgggttttgctcatgcatgt

SEQ ID NO: 42337 - DNA, 434 bp, Zea mays
  Clone ID: LIB3062-017-Q1-K1-E1
ccggccgaagacactcgaaggcagcgaagcccgagccttcccttcgcttcaatcgatcgcccgctccgatccgctagcgagcgagcagcgcgatggcttgcctcaccgtgtccacgaagaccgcggcggccggcggcaacaagcagcgcgagggcgcggaggtcatcacgggcgcggaggcctgcttcgcgcactccaagcagatgctgcaggcgctgggcttcccgggcggcgtgatgccgctgcgggggctggaggagtgcggctgggtgcgcgagaccgggttcgtgtggatgcggcagaaggccccctacgagcactacttccgcggcacgggcacgcgggtgcgctacgacgccgaggtcaccgcgtacgtggaggacggccggatgaagcgcatgaccggggtgcgcaacaagcaggtcatgctctgg

SEQ ID NO: 42338 - DNA, 423 bp, Zea mays
  Clone ID: LIB3062-017-Q1-K1-E10
ctgtcacacacacacacacagacaagtggtttccaaagccaagtgtgtgtactagcaacgagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaagaggtcgctgccgcggcggccgtcggcgccggcggctacgtattccacgagcaccacgagaagaag

SEQ ID NO: 42339 - DNA, 239 bp, Zea mays
  Clone ID: LIB3062-017-Q1-K1-E2
aggaagctgaatcgacctattaagcggcgaatgtatccatttttgctgcaacatggggaatgctacgctggcatagatgggtacctgttaacttctgcttggcgatttgctagagtgatggtctagatatatagcgctactcgaatgtatgtggaatgctaccgtataacgcacatttgggtgcaatgactgttgcattgctgcatgaatgatatcgctggtacataatacagaaatac

SEQ ID NO: 42340 - DNA, 411 bp, Zea mays
  Clone ID: LIB3062-017-Q1-K1-E3
aagttccccactgactacatacctactgtgttcgacaatttcagtgcaaatgtagttgggggtggcaccacggtgaatgtgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtc

SEQ ID NO: 42341 - DNA, 367 bp, Zea mays
  Clone ID: LIB3062-017-Q1-K1-E4
acacagggcacacgcactacacgcacggcacgcagatacatatagagagagggtagggatagctagcacatctatttaactaactaactaactggctagctagctcgatccgcagagcaaagcgaaagcagcatgaagcaaagcaatggagaaccctgcgagtgtgctagctctaccagcgcagttcaccaaactcaccttcggaaacctgtacatacgccgggccgggccgggcagcagggagataaccgaggaaggcacgtgcgacctgtacaggatatacgtgagtaacttccacgtgtacgactgtcgtggccccgacgccagccttgtagcccgcgtacaagggatcaccagcgaaatccgg

SEQ ID NO: 42342 - DNA, 422 bp, Zea mays
  unsure at all n locations
  Clone ID: LIB3062-017-Q1-K1-E5
cgcgtcgcccccgccgcctgccggggcgggaggaggtcctcgccggccgcgcgggaggccgccggggtccaagaacaagccgaagccgcccgtggtggtgacgcgggagagccccaacgcgatgcgctcccacgtgctggagatcgccagcggcgccgacatcgtcgacgccatcgcgggcttctcccgccgccgccagcgcggagtctccgtcctcagcggcacgggcgcggtcaccaacgtcacgctgcgggagcccgcgggggccggcggggcagcggccgtcgcgctgcgcggccggttcgagatactgtccatgtccggggctttcctcccggcgccggcgccgccgggggccacggngctcaccgtgtacctggcgngggggcaggggcaggtggtgggcgggagcgtcatggggg

SEQ ID NO: 42343 - DNA, 429 bp, Zea mays
  Clone ID: LIB3062-017-Q1-K1-E6
aagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgct

SEQ ID NO: 42344 - DNA, 392 bp, Zea mays
  Clone ID: LIB3062-017-Q1-K1-E7
gtgcggcacgcgttctgctgccgcgaccctttctacgagtgggccatgtacctcattgtcgatgcgccatgggcgccaagatgcttgtacaggaagcccaagattgtccagcacatattgtgttgaaatgaacgaacacacggtatccatatcaccattggcacacaatgacatagtgtaagtcatgttcttatgatgtaacctaccgatgtctcgttgtaactatggacagagaaaggtccaagttcaagcatggccccatatccaaaggatgaacagccaggccctgcagatacatggtcattgttggttacctgcaacactatactgagagctatggatatgttgaacgtgtgtacagctgtgagaacatttataccgaggcatgctgc

SEQ ID NO: 42345 - DNA, 336 bp, Zea mays
  Clone ID: LIB3062-017-Q1-K1-E8
ctaagcaattaatacatacatactttgttccaaaaattctactccacacctaccggcgggtcttatcactcgccatggctccctccaccgatccccattcgctcgacaattacaacctactcacgcatctcttctaccactccacatacttctatccctctaaaatactcactcccaacatcaactacctatcaacacatctttaactaattcaataccacaccttcaacattattaacatccctaccaatctcactcacaacttacaactcccctaccattcctaaaacaccaactactagatttacattccaatattaccacctacaactactc

SEQ ID NO: 42346 - DNA, 433 bp, Zea mays
  Clone ID: LIB3062-017-Q1-K1-E9
gagaagtgatcctgttgacggatcgagcatgcaaagctctccctcctcgctcccttgcgggcttgcttgcttgctgcagcgacggaggcggcaccggcgccggcagagacaccgtcggaggcggcggtggtagaggagaagaaggaagaagagaagaaggaagaggaggataagccggctgccgaagaggcggcgccgccagcagaagcagcagctgctgctgaggagaagtgatcctgttgacggatcgagcatgcaaagctctccctcctcgctcccttgcttgcttgcttgcttgctgctggtaaattaaattaagttgccgtgatacttaagcgtagccgcacggagtgaaaagttattaagtaaaagcagacaaacacttggcatgcatggacattaatttggtattctttgtaccgtcgtcgtctcg

SEQ ID NO: 42347 - DNA, 348 bp, Zea mays
  Clone ID: LIB3062-017-Q1-K1-F1
cactcatacctacacaaccaacaacttcattgcattacttgatcacattcttcgttatgatttgtcagttttacatgccttcttgcttaacactttacattaaaacacctttaatactcatattattaattacacaaagactatctatccatatctaaaatgtaacaattttccaaccattttaacattatatactacttctaatacttactcccaaattaataccaatattatcactgatacactatccacattaacatactaacacttatccaatcttatcgctatacactctattcacattacatcttaatactcatttcaaacacattcaaattctacacttat

SEQ ID NO: 42348 - DNA, 435 bp, Zea mays
  Clone ID: LIB3062-017-Q1-K1-F10
cgagaagcagatcctgagatccggcaccggccccaagccgataaagggccagaaggtcaccgtgcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaa

SEQ ID NO: 42349 - DNA, 413 bp, Zea mays
  unsure at all n locations
  Clone ID: LIB3062-017-Q1-K1-F11
cgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaagactggcacctaccgncagctctttcaccctgagcagcttatcagtggcaaagaagatgcagccaacaacttcgcccgtggtcactaca

SEQ ID NO: 42350 - DNA, 346 bp, Zea mays
  unsure at all n locations
  Clone ID: LIB3062-017-Q1-K1-D7
cccgctccagtcgccatggcggaagccctcgtgggcctacgcgtcgctgccctcgcgggcccgcaggctaggagccaccgcagacggcttctccccgctgcgcgcctcgctgcgttccggcgcgaccggctgagcactgcccgcgcggccgtcgcagggccaccggaggtggacgaggacgattccatgagtatcgacaacttgcatcgtttcttcgacctcaacgtcggaaagtgggacggctcattctaccaattcgacgcgcacgggagggttcttcaggagattagcacgcggctgtccgtgagcacgtacggggaggacaacctnatcagccttcttcaat

SEQ ID NO: 42351 - DNA, 427 bp, Zea mays
  Clone ID: LIB3062-017-Q1-K1-C12
agcgggcgctagagcagagtgagcgtgcggttcttggtcatggagcgcggtgccgtcgtgcttgcgctccagggcgccggggttgggcgcgtcctcctccccgtgcaggtgcgggtacggtcgttcttgaggagcaggagggcgatggagcggcggcgcaggctcgcgagtaccgcggcgccggcgaggtgcagcaagatgtacgttcccggctttggggagggttcaccggagcggaaggcggcgatccaccttcagcacttctttaactacatcgctgtcagcattgtcctagcacagcttgagagttacaatagggaagcgtacatggagttgaaggagttcatcagccgcaccttcctgaatgacgccgagattttctgcgaaaaactgatgcgcgagtctccaaggctcaagggactagcct

SEQ ID NO: 42352 - DNA, 390 bp, Zea mays
  Clone ID: LIB3062-017-Q1-K1-C3
cattcggccattccttaacatccttgttgcaagcggcgccagcttgctcgcgctctcgggcagctgctacgctaaagcaagtctagtctctagaggaggaggcggagggggaggccatgggcaaggacgacgtggtccagagcggcgcgggcggcggggagttcgccgccaaggactacacggacccgccgccggcgccgctggtggacgcggcggagctgggttcgtggtcgctgtaccgcgcggtgatcgcggagttcatcgcgacgctgctgttcctgtacgtgacggtggcgacggtgatcgggtacaagcaccagacggacgcgtctgcgtcgggggccggggcggacgcggcgtgcggcggcgtgggcgtgctgggcatcgcgt

SEQ ID NO: 42353 - DNA, 418 bp, Zea mays
  Clone ID: LIB3062-017-Q1-K1-C4
ctctctcctcggtttcctctcccaccaccaacccccagatcgcagcgatctccgccgccgccctctctgggatgccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggcgttcgacctcggcggccaccagatcgcgcgccgcgtgtggaaggattactacgcaaaggttgatgctgtagta

SEQ ID NO: 42354 - DNA, 418 bp, Zea mays
  unsure at all n locations
  Clone ID: LIB3062-017-Q1-K1-C5
gtcggccgcggcctggaggcgatcgtgaggagcggagccgtggacgtggtggtgcccggggtgctcccgatcggctgcttccccatctacctcaccctctacggcacctccaacgccgccgactacgaccgcgacggctgcctcagcggctacaacggcctctcctcctaccacaacgcgctgctgcggcggagcctgtccggcctgcggaggacgtacccgcacgcccggatcatgtacgccgacttctacacccaggtcacccacatgatccgggcccctcacaacttcgggctcaagtacggcctcaaggtctgctgcggcgccggcgggcagggccagtacggctacaacaacaaggcgcggtgcggcatggccggngccagcgcctgcgccgacccgggcaactacctcatct

SEQ ID NO: 42355 - DNA, 425 bp, Zea mays
  Clone ID: LIB3062-017-Q1-K1-C7
ctttttggctgttggctagcgaatgcttttagaaaccacctcttctgtttagctattgttggcagtaagtctagcagtgctttgtattatgtaaataggcatttcaaatgtattaattgctgtcattgcattatagtatttgttttgggtgaaaaatttagtcttatctttgtcagtagatttcaagttttgttcgtctttccaatgttgtatagcattgtgaaaccagatggtggcattgtggaagtatttggtaagagttgctattgaacttcacgaatgtaacattgcacattttgtattgaagtacaaacagatgggatgattatccttctttatgttaataaatctgtatagaaacaaaatttgtcattcaataatcaatactattctcagaattacatttctgtactacaacaattatt

SEQ ID NO: 42356 - DNA, 286 bp, Zea mays
  Clone ID: LIB3062-017-Q1-K1-C8
cagcagatgagtaatcatcaagaatgagtcaggtgatcatatattgtctgttggctagttgtgaagaatagatagattctttacatgatgtattaaaatatatacactgaaatacaggttggtctatctctattccatggcaaatttcttcttgaaacttttcagtaaacatcaagtttcatgcgcagacgtgtctggatgtacaacatagactggttcctcttcaatattagtttgtgtttgcataaaaaaaaaaaatcatcgagaccctgatgttactgtacat

SEQ ID NO: 42357 - DNA, 456 bp, Zea mays
  Clone ID: LIB3062-017-Q1-K1-C9
ctgatatacctccggatgagtactcgtggaggaagtatgggcagaagccgatcaagggttcccctcatcctaggggctactacaaatgcagcagtgtgaggggctgtccagctaggaagcacgtggaacggtgtgtggatgattcggcgatgctcatcgtgacatacgagggcgagcacaaccacaccggaatgccagctcagtcagcagcagcagcagcagcacaggtgtagccgtgtagtcgtagagaactcatcatcagttcatcactgcacccccgcctccccctccttgaggacgaagtggcaccaccaacatggcctctgttggtcaccaggtcgtcgagatgtctggtcctgcttgcgcccacaagatctgtaacgagaatggaatgtgggtgtacacaagactttctaatccatttgtgggggcagctggctgtcgctcaagattatt

SEQ ID NO: 42358 - DNA, 429 bp, Zea mays
  Clone ID: LIB3062-017-Q1-K1-D1
caaagacactcgaaggcagcgaagcccgagccttcccttccctccaatcgatcacccgctccgatccgctagcgagcgagcagcgcgatggcttccctcaccgtgtccacgaagaccgcggcggccggcggcaacaagcagcgcgagggcgcggaggtcatcacgggcgcggaggcctgcttcgcgcactccaagcagatgctgcaggcgctgggcttcccgggcggcgtgatgccgctgcgggggctggaggagtgcggctgggtgcgcgagaccgggttcgtgtggatgcggcagaaggccccctacgagcactacttccggggcacgggcacgcgggtgcgctacgacgccgaggtcaccgcgtacgtggaggacggccggatgaagcgcatgaccggggtgcgcaacaagcaggtcatgctctgg

SEQ ID NO: 42359 - DNA, 431 bp, Zea mays
  unsure at all n locations
  Clone ID: LIB3062-017-Q1-K1-D11
gcctgcggcggcgccggcgccggcgaccagcggccatgcgggtggcacccagggtgctgttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatggggtcttggaactgatttcttctgaagctacctncactgagcgaactctaattgtcccatacatcacaagatcgtcaagctatcatcatggaacggaacatgcaacaaaggcatcgactggtactcatggtgctgaa

SEQ ID NO: 42360 - DNA, 391 bp, Zea mays
  unsure at all n locations
  Clone ID: LIB3062-017-Q1-K1-D12
caaatccagcacctctctcccctcccccttcctcccgtccccgtcgaccgtcgcatcggaccctatcctncccagtccccaccactccaccaccctctccccggctccgctgcgaccaccgcacccgcgaacttggcgggccgctcggcgctgcacaccaagccggggatggccgncgcgcttgcgagctcgccgcttgttcacctaactacctnccgcctncgnctncccaggccccaggcctncgcttccagttcgggtccagtctgctcgatcggcgtgtgcttgngatggaggctcaaggtcgggtggagagccctgaggcggcgcgaccggcttcgatgcttctccaacgacgggggcggcggggaagaaggggaaaagcgtggcg

SEQ ID NO: 42361 - DNA, 416 bp, Zea mays
  Clone ID: LIB3062-017-Q1-K1-D2
caaatccttcgatcgcacagcgccgcccgccctcacgcagctctctccgatggggcggacgaagcagacggcgaggaagtcgaccggcggcaaggcgccgcggaagcagctggccaccaaggcggcgcgaaagtcggccccggccaccggcggcgtgaagaagccgcacaggtttcgccccggcaccgtcgcgctccgcgagatccgcaagtaccagaagagcacggagctgctcatccggaagctgcccttccagcggctggtgcgggagatcgcgcaggacttcaagaccgacctccggttccagtcctccgccgtcgccgcgctgcatgaggccgtcgaggcgtacctggtgggtctcttcgaggacaccaacctctgcgccatccatgccaagagggtcaccatcatgccta

SEQ ID NO: 42362 - DNA, 397 bp, Zea mays
  Clone ID: LIB3062-017-Q1-K1-D3
caaccctcaagatcttcaggaaccaggggaagaacattcaggaatacaagggccctagggaggctgatggcattgtggattccttgaagaagcaggttggccctgcgtccaaggagatcaagtcagcagaaggtgtggccgcccattttgatgacaagaagatctatatcgttggaatcttcaaagaattcagtggcactgaatttacaaacttcatggagcttgctgagaagctgaggtctgattatgactttggacacactttgcacgcaaaccaccttccacgtggtgatgcatctgtggaggggccattgatcaggctgctgaagccttttgatgagcttgttgttgacagcaaggattttgatgttgctgctctggaaaaagttattgatgc

SEQ ID NO: 42363 - DNA, 418 bp, Zea mays
  Clone ID: LIB3062-017-Q1-K1-D4
gacctgtctgcagttgctatccgaggacgcagcagatgacaggattctcgccggaagggagcttggagcagcagccgacgagttcctgctccgcttgacgacgcgtcaacgggccttggcgcgcgagtactcgcgcctcgccaacctgaagaggcctcccgatctctccggcatgactgaggccgaccggggggcggaggcggagaggctgagggaggagatgttgcagaaggcgcgtcaactccaggaccagggggacatgagcggcgcccgcgagtctgaaggtctggcacgcatcatcgacttcgatgtcaagcagggtggcgaatacctcaacagtatctgctggtgtcggaacatctacaccttcgaccacacagaggagtcgcccgttggtccgatgagatttaccaacaga

SEQ ID NO: 42364 - DNA, 410 bp, Zea mays
  Clone ID: LIB3062-017-Q1-K1-D5
gaagaatacaggcgatgattggatgtacccgaaacctgtgatggatttaagtgggtggaacattcgctgcatggcttctggtaacatgcaccacattgttggtgctgatgattcttgcataagctggggtgtcgcccagaatggagagcttggttatgggcctaacgggcagaaatcatcagcaaatcccaaaaaggtggacattcttgagggcatgcatgttacaagtgtcggctgcagatttggactgtctatgattgatgtggacagagcaaatgttggtgaccgacttggtcagctggaaatttatgatggcgacaccggcgctgaagtcgacaaggtggaggtgcaagtaaccaagaaggcatctgccagcaccaactcacgtgccaacaagcgcaagaaaacca

SEQ ID NO: 42365 - DNA, 365 bp, Zea mays
  Clone ID: LIB3062-017-Q1-K1-D6
tccaacgcactcgaaggcagcgaagcccgagccttcccttacgttcaatcgatcacccgctccgatcctctagcgtacgtaacatcgcgatggcttgcctcaccgtgttcacgaagaccgcgacgcccgacggcaacaagcagcgcgagtactcggacgtcatcaccgtcacagacgcctgcttctctcactccaagcagatgctgcacgcgctgggcttcccgggcggcgtgatgccgctacggtggctggaggactgcaactggatgcgcgagaccgcattcgcgtggatgcggcataaggccctctacgagcactacttccgctgcacgggcacgcgggtgcgctacgactccgaagtcacc

SEQ ID NO: 42366 - DNA, 396 bp, Zea mays
  Clone ID: LIB3062-017-Q1-K1-C10
gatcgaggcgcacaagtccgacgtgcgcatctacgccagcctcacccgcctccacttggacgactgcttcgtccagggctgcgatggctcggtgctcctggacgccgttccgggggtggccaactccactgagaagctggcgccggccaacaacaactcggcgcgggggttcccggtggtggacaaagtgaaggcggcgctggaggacgcctgccccggcgtcgtctcctgcgccgacatcctcgccctcgccgcagagatctcggtcgagctgtccggaggaccaaagtgggcagtgcttcttgggaggctagacagcaagaaggccgacttcaagagcgcggagaacctgccgtcgccgttcgacaacctgacggtgctggagcagaagttcgc

SEQ ID NO: 42367 - DNA, 178 bp, Zea mays
  Clone ID: LIB3062-017-Q1-K1-A3
accacgccatggatttctgcagccacgcttgatatactggtgagctcgagactacatgaggtgcgcgtgcctatggtgccaaacggccaatacctgcatggcatcatcaactgacttcaaagaccgggctataggccaaagactcgatggacaagggtttcctgttgaatgcgaattg

SEQ ID NO: 42368 - DNA, 323 bp, Zea mays
  Clone ID: LIB3062-017-Q1-K1-A5
ctcgggcgtgtgcaggcagccatcatgctcggatggagaagcggccaccgggttcttgaaccaccacagcagggacgaggagcagcccgtcggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagtgaggtgcgcaccagatccggcatgttcctagagacgaagcatgatgaagtagtaacgatgatagaggagaggatatct

SEQ ID NO: 42369 - DNA, 294 bp, Zea mays
  Clone ID: LIB3062-017-Q1-K1-A6
ggaagcggcagttctcgtgattgggctgctaaggtccgatgctcctgggagttgaaggtgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttaacttgcatcgttcgctttgacactgaggtgg

SEQ ID NO: 42370 - DNA, 322 bp, Zea mays
  Clone ID: LIB3062-017-Q1-K1-A8
aatggtagagagtccagaaatgataataatagagagtccaaatatgcagccaaggttgaggatgaattggaggatcatcattccctgagatcgactcatcttgctgattcctggcaaaaaaccagaggtcggagtggttcgaatgactacagaagggcatcttttggatcagagagtgatgatgagatcaattcttatccggacgaggacattgacaaaagtcctagaaataatggaagccgtagtcagggaagtaccaacagagcttctgttaggcacaatgcacttgcctacagtgatgaatgacccattttctgatgat

SEQ ID NO: 42371 - DNA, 431 bp, Zea mays
  Clone ID: LIB3062-017-Q1-K1-A9
atttctcctaaatttcagatcaaatcctcctcctcctcctcctccccctccccctctcggaggattctgcccagcagcgcggcgatccgcctcgatccggaatggagcgcgtcttctccatggaggagatccccaacccctactgggccccgccgcaccctcaaccggcggccggcggcgctgttgctgcaccaggtggagtaggaggagcgggggacgcggcgggcgcgatgaaccggtgcccatctgagtggtacttcgagaagttccttgaggaggccgtgctcgacagtccgggtcccgtcgccggcgtgggtagaagcagcggacaagctggagttgacgcggcggatagcaagccgctgggcgccgcggcgccggcgtccgtctcgagctcggtcgttgaccccgtcgagtacaacgcgatgctc

SEQ ID NO: 42372 - DNA, 108 bp, Zea mays
  Clone ID: LIB3062-017-Q1-K1-B1
agttctataaaactcttaagatgtatgctgaaaaagcataaccaggtggtaagcattggggttgcgggtcaagattggaacaaccgggaaacagactgatgtaaggag

SEQ ID NO: 42373 - DNA, 430 bp, Zea mays
  Clone ID: LIB3062-017-Q1-K1-B10
ataaaattggatgcagaagctcaggctcacattgagaagcataggaagcttcaagaagatttgactgatgaaatggtcgagttagcacggcaactgaaggaaagtagcctaatgatgaaccaatccgtgcaggagacagagaagatccttgattctaccgagagggctgtcgagcacagcctggcaagcgcgggccacgcaacctcgcgagccgcggaggtctactcactggcttccaagactacgtgcttccagtggctgctaatgtttgtgatggcctgcatgtttgtaatggtggttctgctcataaggatcacttgatgaaggatgagggctgtagagggcactcaaatcttttgtcacccttgactttgtttcatagggaattctttgtgttgatggtattttctcgaccgagtgtctccaacag

SEQ ID NO: 42374 - DNA, 416 bp, Zea mays
  unsure at all n locations
  Clone ID: LIB3062-017-Q1-K1-B11
ggagcaggcgatcgagtacgtcaagcaggcggtccaggaggacaatgccggcaactacgtcaaggcgttccctctctacatgaacgcgctcgagtacttcaagacccatctcaagtacgagaagaaccccaagatcaaggaggccatcaccgccaagttcaccgagtacctccgccgcgccgaggagatccgggccgtcctcgacgagggcggcgcggggccgggggccaacggaggtgacgcagccgtcgccacgcgccccaagaccaagggcaaggacggcgacggnggcaacggaagggatgactccgagcagtccaagctcaaggcggggctcaactctgccatcatcaccgagaagcccaacgtcaagtggaacgacgtttgctgcctcgagagcgccaagcaagctctgc

SEQ ID NO: 42375 - DNA, 389 bp, Zea mays
  unsure at all n locations
  Clone ID: LIB3062-017-Q1-K1-B12
ctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggacatcggcgggctggaccacagcatccccgccgncacccacggccagttcctccccggcgccgacgacacctgggtgcccaacccc

SEQ ID NO: 42376 - DNA, 418 bp, Zea mays
  unsure at all n locations
  Clone ID: LIB3062-017-Q1-K1-B2
gctggtagggacctcactgattccctcatgaagatcctgactgagaggggttactctttcacaaccactgcggagcgggaaattgtgcgtgacatcaaggaaaagcttgcatatgtcgcgctcgactacgaacaagaactcgagaccgccaagagcagctcatcagttgagaagagctatgaactgcctgatggacaagtgatcacaataggcgcagagcgcttcagatgcccggaggttctcttccagccatccttcattggtatggaagctccaggaatccacgagacgacctacaactccatcatgaagtgtgacgttgatatcaggaaggacctgtatggcaacattgtcctcagtgggtgatccaccatgttccctggcatcgncgaccgcatgagcaaagagatcactgcgc

SEQ ID NO: 42377 - DNA, 401 bp, Zea mays
  Clone ID: LIB3062-017-Q1-K1-B3
agaagaaattctacatcccctgtaaaaaagcataaccagctggtaagcatcgcgaactgctgttccatgatcgatcatcatcgaccagaggactgaactgaagacgttgtcacccatcgtgcggccacaggaccccttcttagcaaggtaaataaacggtcctgtccgaggcgcttcaagcctagctctcgtaatgttatcgtcatgtatgtaaatgtgtcttatagtgagcctattttgttgttccaatccttacggtgttccattctgaggtgctgaacctcggggcaacaagaccgaagctggtagggacttcaattggagaactggggttcaagcatgtagaattttaaaatcggttcatttgtctggacaatgttcctgactagtaatgtgatcgc

SEQ ID NO: 42378 - DNA, 337 bp, Zea mays
  Clone ID: LIB3062-017-Q1-K1-B4
atctcaagggacggatttctattgctacaagccttatcctacatccaactattccaaactcactgcatcaagttataaatagaagcctctcatcaatcattccaagaaatgtacataacgcagttctagaacgattgctttctctttctagggcacaagtctcagactatatcctgaatgataaaaatcccattgggtcgttgaaactaccaagattgagaagtattctcgattaaagcaaaagtcttcatctgcagttccctgcagaggatcttggcttccagtaataccctttacaaccaaaatgttcctcataaacaaccttttctttatttct

SEQ ID NO: 42379 - DNA, 312 bp, Zea mays
  Clone ID: LIB3062-017-Q1-K1-B5
agaagaaattctacatcccctgtaaaaaagcataaccaggtggtaagcattgtgtttgctgttgagttatggatcacacgggaacagaatgattgaaggaagatctggtcaccgtgttgggcggcttaaggaccggcttttgacaatggtgatcaactgcgccgtcgccggatcctgaggccatgactactacttggacgtggatagctgcagagcggcggtaccgctggcgcatcagcagtacgtgaacggtcggctcgtccatcttcagaccttgtacgtgttcgaggcgagcatgatggtcgtcaagat

SEQ ID NO: 42380 - DNA, 405 bp, Zea mays
  unsure at all n locations
  Clone ID: LIB3062-017-Q1-K1-B6
gcgccggcctgttgcaattttcaataccgaacttagcgtggagaatttcaaggcagcgatgtctattcctacaacccttggccttgatccaactgttgcaaactcagtgcatcaagttataaatagaagcctcggatcaatcattccaagaaatgtgcagaaggcagttctagaaggattgttttctcttggtagggcacaagtctcagactatatcctgaatgagaaaaatcccattgggtcgttgagactagcaagattgagaagtattctcgatgaaggcaaaagtcttcagctgcaggtccctggcagaggatcttggctttcagtaagaccctttacaaccagaatgttcctcanaaacaaccttttcttatttctttcagcttagttgatgggacatga

SEQ ID NO: 42381 - DNA, 347 bp, Zea mays
  Clone ID: LIB3062-017-Q1-K1-B7
cacgcgtccgatgtttctcaacctcttcagatgggtgtttgtatccgactgaaccgggaggcgcccagcttggcggtccatgatcggggtgatcgacaggaggacggagctgaagccgctgccagccagcggcggcccagaggaccggcggctgcaggtggtgggcgtctccgccgccgccggatccggaggcgatgactactacttggacgtggagagcggtaacgccgctgtgccgctggtgcataagccgcactggaacgcgaagctcgtccgacttcgcaccttctcagtgttcgaggtgagcatgatggccgccaagatcgcctacgagaacgcctggtaca

SEQ ID NO: 42382 - DNA, 259 bp, Zea mays
  Clone ID: LIB3062-017-Q1-K1-B8
ccaaggagtatttgatattcctataatttatttaggagtgtcgactctagtgaggctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggtttaggtaccatggctgctgataaagattcatatcgctgcatcatatatatggact

SEQ ID NO: 42383 - DNA, 436 bp, Zea mays
  Clone ID: LIB3062-017-Q1-K1-B9
gcgcgtttctctaccccgccggcctcctccctcgtgcccccgactccgccagccactgggcccgccaggtacaatacccgagacagcggtgtgtacgaggacgagagggagaacaacggattcatcaccgccaggcgtcaggtcagagtgtgttaagaaaagatggtggcgaatggcgacgcacctgctagagggagtgcgacggtagctgcaagcctgcgcaggcgtaggaccacaagcgttgctgctgctggcagaggtggtgccagctcgatgctccagttctacaccgatgaggctgcgggccgcaaaatgtcaccaaacacttttctgatcatgagcattgggttcatagctgttgtcgctatgctccatgtttttgggaaactgtaccgcaccttcaactaggttggtactaccataaccaagaaaacag

SEQ ID NO: 42384 - DNA, 423 bp, Zea mays
  unsure at all n locations
  Clone ID: LIB3062-017-Q1-K1-A2
gcgtcatgcaatggaactacagagaatatggtgaattcgaagtcaaagaagtttgttgtagggcctgttgtgaacatgtggttagggtccagacatctaaagccagggaagaaagcgaaccgcaagagaagtaaaatgataagacgtgttgtagcctgcaaggacgcggcaaatttatcttgtttgagtgagcagctgacgtcaacatcgtccactgcatgctctgaaaccgtagaatgtacctacagccatcagaaacggtcacatgctagtgcaaggtccaaagatgacgcccagtccttngaaaaacaggcagaaggtcgacggagctcgtgtcggtgctggcacaagtgcaccttcttgcagtgccggcgttccaaagtctgatccgaactctttcacagatcctaaggttgtagcgac

SEQ ID NO: 42385 - DNA, 292 bp, Zea mays
  Clone ID: LIB3062-017-Q1-K1-C1
caacctcttaacatctgttttggttaaccagccggtccgatccgctagcgagcgagcagctcgatggctggcctgaccgtgtccacgaagaccgcggcggccgtcggcaacaagcagcgcgagggcgctgatgtcatcacgggcgcggaggcctgcttcgcgcactccaagcagatgctgcatgctctgggcttaccggtcggcgtgatgccgctgtggaggctggaagagtgcggctgggtacgcgagaccgggttcgcgtggatgcagctcaaagcccactacgagcact

SEQ ID NO: 42386 - DNA, 421 bp, Zea mays
  Clone ID: LIB3062-016-Q1-K1-G12
aacaaaggttagattaagtgatatggagaaaaacctggaaaacctcacatgtaagtgggctgacagtgagaaatcaaatagcttgagtgagacacagttgaagtgtatggctgaatcctacaagtcacttgaatcaaggaaacttgaattagaaaatgagatagaagtgctaaggtccaaaatagatgctttaacagctgaactctctgatgaaaggcaaagtcatcaggacgacttagttaaatacagagatctcgaggagaagatggaaaggtatgagatggagaggagttcaatgcttgtggatggggacccagacaccaagtcaaagcaggataaagagataggggctgcagcagagaaactggcagagtgccaggagaccatattgattcttggccgtcagctgcaagctatgcgt

SEQ ID NO: 42387 - DNA, 350 bp, Zea mays
  Clone ID: LIB3062-016-Q1-K1-G2
ggagaaggagcacaagcacaagcagcacctcggcgaggccggcgccatcgccgccggggccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctggttaattctgtactgcatgcgtgtgtaat

SEQ ID NO: 42388 - DNA, 253 bp, Zea mays
  Clone ID: LIB3062-016-Q1-K1-G4
ccggattccgggccccagttgggtggtggcggtggcaagcgctgaaagaacctaagtgtcgttccttgaccttgcaattgctcctgcatagcccaccttgttgcaccaacgccacttttgtagtacctcggttaattttgcattttctttcagagttgtttgtgggttttgagttccatctcaagagagttgagtttatttatctttatattgggtgaaatgttcatatgctttcctcagcttggatgatggt

SEQ ID NO: 42389 - DNA, 259 bp, Zea mays
  Clone ID: LIB3062-016-Q1-K1-G5
gccagccagtcgttcgttaagaagagagcgagcgagcaagagagagagagagagggagaagggggaagatcagaacgaagagagggagatgagggggcaaacgcagacagcttccgcggggggccggtggcgaggcgacggcgctgcggcgtggtgttggtggtgggtggccgtggtcctcctgcttggccatttaccgagctgcgcgcgcgcggggctgctggaatccaacccgggcctggcctacaacttctacgag

SEQ ID NO: 42390 - DNA, 416 bp, Zea mays
  Clone ID: LIB3062-016-Q1-K1-G6
ctgataaggaagttctgggtgaaggggacactgcaaagcttgagattcagattgagttggacaaagagaagaaaatcctctccattcgggataggggtattggtatgaccaaggaagatcttattaagaaccttggaacgattgctaaatctggcacttcaggaacaggagctgctcgagtctcttgtcgaagctgatacgagaaggcaggaaagagctaaaaagatggaagaaaagaaagtgtatctgcaactatacgaagcaatggaggcgttggtcaagatcaatctggagacgaacaagatcatggacttcatcaagtttgacgtcggcaacgtggtcatggtgactggcgggaggaacaccgggcgtgtaggagtcatcaagaacagggagaagcacaagggcagctttga

SEQ ID NO: 42391 - DNA, 320 bp, Zea mays
  Clone ID: LIB3062-016-Q1-K1-G8
gcgtcccacgatctgaagacaaaaagatctgctgtccataaacaacaaagtgctgcagaggctgtgttctgcgcaccagtacttgatagtgagtttcagaatgaacctataactatttccaacatcgacaagaaggatggtgaaaattttcatgatatgtataaatgtgttggcaaggctgtttcgtgtcctttgttaccttatgagcatcgtcatctgaatacacagagaacggaatctgcaggaaatttgaaagtctgcacgcttcctgatcatcaaactgcaaataaattgacagaaaagagtaatggtgagctgct

SEQ ID NO: 42392 - DNA, 301 bp, Zea mays
  Clone ID: LIB3062-016-Q1-K1-H1
cccggctcctccaaccctgcccacaccgcggccggagatgcggcggctgtcgtcgacggcggcgacttccgccaggccggcaagttcaggtccctggacaaggcgtgcatcagggacgccgcggacacggtgcctgagagcgagtggcggctgtgcacggcgggcgaagtgcggcagaccaagaccctgctggccgagctgcccatcgtggcgtgcaccgtcgtcaccaacaccgtgctggcgcagctgcagacgttctcggggcaaaagggcaaggccaaggacacgaggctggcgccgt

SEQ ID NO: 42393 - DNA, 326 bp, Zea mays
  Clone ID: LIB3062-016-Q1-K1-H10
taccctaaaaatcttaatctagcattgctttgagatctaatggtataacatgtagatatactaggacacccttgaatactaacatatatatgcacccatattacaacacactaacatgctctctgcatacttaccttaacccaaagacatacatacagatatattagtcaaattatattcacaactttccatgttcctaccatgtacgttgcaattcaagcatgtctttcactctatgccattggacttactactattattgttctcgactctggtgatagtgtgagtcacactgtacccatttattaaagatattccctttccca

SEQ ID NO: 42394 - DNA, 240 bp, Zea mays
  Clone ID: LIB3062-016-Q1-K1-H12
aaaaatcttcaagatactattgctatcttgggtatggatgatctcaatgaagatgacaagttgaccagacgctcgtgctagaaagattcatcgtttcctgatccaaccttttcatgtcgcttaagatttcacaggtgctccagggaaatatgttgagctgaaagaaagtgtcaagagttttcaaggtgttttggatggcaagtatgatgacctccctgatcagtcattctacatggttgg

SEQ ID NO: 42395 - DNA, 422 bp, Zea mays
  Clone ID: LIB3062-016-Q1-K1-H4
gcgtccgctcgctgaaccgcaaccagtgggagtcgctggtgtgcctggtgcagcccatcctgtcgaagggcaggaagaagatcgtcaagcggggctccctcaacaccttctacgccaaggagtaccgggccacgctcgagttctactgggcgcccttcctcgtcgagtccaactctgacaaccccaacttccacagcatcaaggaacggatcatcagtcccgagaggatcgaggcgcacgccaagaactggaaggacgttgattacctcatcttcgacacctacatctggtggatgaacaccgtcgacatcaaagtcaggagaccgaactcgaatgattggtctgagaacgacgaggttcccaggattgaagcgtatggtcgggtgttcaagacggggtctgattggctcaataacaacatc

SEQ ID NO: 42396 - DNA, 379 bp, Zea mays
  Clone ID: LIB3062-016-Q1-K1-H6
gaagaacagcagcaggcgaagcatcgccagattggtatatcgatcgattgatcggtggcggaggaaggggaggacggggggcagatggcggcgtgccggggcttcttcgagtgcctgctcaggctgctcaacttcatcctcaccgtcgccggcctcgctatggttggctacgggatctacctgctcgtcgagtggatgaagatatccgaagacggcatcggcggggcatcgacggcggaagtgctcgtctccggccggccgttgttgggggctatcgttctcggtgacagcttcctcgacaatctacccaaagcatggtttatttatttggttattggtattggcaccatcgtcttcttcgtgtctctggttggctgca

SEQ ID NO: 42397 - DNA, 193 bp, Zea mays
  Clone ID: LIB3062-016-Q1-K1-H7
gaaggcagaagatctggaatccaagatcaagaagctaagagtagcacaggcaaaggcggaggtccgtcaagggaccataaaaaaggaggttctaaattggatgctaagctaattggactaacctttctgaataaatgtgatggccggatagaaaattggatcaccaaaaggtgatgtgtgtggaattaatgga

SEQ ID NO: 42398 - DNA, 420 bp, Zea mays
  Clone ID: LIB3062-016-Q1-K1-H9
agcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcatgccggattgtcatggggctttttgggaagactgttcctaagacggcagagaacttccgagctctttgcacaggagagaaaggggttggcaagagtggcaaagccctccactacaaggggaggaagttccacagaatcatccccagcttcatgctccaaggaggtgacttcactctcggggacgggagggg

SEQ ID NO: 42399 - DNA, 401 bp, Zea mays
  Clone ID: LIB3062-017-Q1-K1-A1
acgcgtccggcttcatgcaatggaactacagagaataaggtgaattcgaagtcaaagaagtttgtgaggtatcctgttgtgaacatgtggttagggtccagacatctaaagccagggaagaaagcgaaccgcaagaaagtaaaatgataagacgtgttgtagcctgcaaggacgcggcaaatttatcttgtttgagtgagcagctgacgtcaacatcgtccactgcatgctctgaaaccgtagaatgtacctccagccatcagaaacggtcacatgctagtgcaaggtccaaagatgacgcccagtcctcgcaaaacaagcagaaggtcgacggagctcgtgtcggtgctggcacaagtgcaccttcttgcagtgccggcgttccaaagtctgatccgaac

SEQ ID NO: 42400 - DNA, 430 bp, Zea mays
  Clone ID: LIB3062-017-Q1-K1-A10
ccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaagctggtgcccgtgtcattgtgaccgagatcgaccccatctgtgccctccaggctctgatggaaggtctttaagtccttcccttggaggacgttgtctctgaagctgacatcttcgt

SEQ ID NO: 42401 - DNA, 408 bp, Zea mays
  Clone ID: LIB3062-017-Q1-K1-A11
ctatagaccacagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgcttaaagtgacttcggccaaagccggaggcgaaggcggcgccgtcgtcagctggg

SEQ ID NO: 42402 - DNA, 366 bp, Zea mays
  unsure at all n locations
  Clone ID: LIB3062-017-Q1-K1-A12
ctgaagatgatgctgtcccactcgtggtctaatattcggccattgtgctctggaggtgttgttcccaatcgagacatcctaggatggaatgtgacacactgggattcacgaccttgtatctcctgaatgagttccaaagccagaggtcttagacatcttgtataaggacacattatgttttcaccgtgctattgaacatcatgatggcatcatgcatcaaacagaaatgtaagccccagacagtgttcatcaaaggagatcctccagattatcaaatacatgttgcatctgctgtcagctgtcgcttaacttgtctatatactanggtcgatccatgacatgacatgaggttactcatctgggatc

SEQ ID NO: 42403 - DNA, 401 bp, Zea mays
  Clone ID: LIB3062-016-Q1-K1-G11
acgctcggcgtcttcacaaacgccggcgcaaactgtcgcccgagcccgacagatgttcaaggtgccattccgcccaccgatcgaccttgacgccaatctcggtctcttgcaaaagcgttacacgcggttgtttgacaggagaggacgaagatgacggattgcatctctctctcacatcgtgcagctcgccatccaagtcggcaacgcgagctgggaactctactgcctcgagcacagcatgcagcctgatggccaagagcctggagataacaccgacagacatcacgatgatgccttcagcaccttcttcagccagactggtgctgggaagcacgttccccgtgcaatctgagctgatctagaacccactgcgatcgatgaggtacgcactgacacgtacc

SEQ ID NO: 42404 - DNA, 292 bp, Zea mays
  Clone ID: LIB3062-016-Q1-K1-E5
gaactccatataccagctcgatatgataaagtttgcgaagaagatgtatccggaggtggatttgatcggtggtaatgtggtgacaattgcacaggcccagaatttgattcaagctggtgtggatggattgcgtgttggaatgggatcgggctcaatttgtaccacccaagaggtttgtgctgttggaagaggacaggcaacagcagtgtataaggtttcatcttatgccaaggatcacaatgtaccggttattggctgatggtgggaatttcaaaactctgggcattattgt

SEQ ID NO: 42405 - DNA, 424 bp, Zea mays
  Clone ID: LIB3062-016-Q1-K1-E6
gcctttctgtgtgtatactgcaattccgatggtctgcaacgtctaccttcagaaaatgcccactattcagctctggaaggacggagagtggaaagcagaagtaataggtggtcacaaagcttggcttgtgatggatgaggtcagagaaatgatccagaagaacaagtgacttagcacccatgttatgcaatggccaatggatattgtaccgtgttcaatgtaaatagagatatcagacgatctcttcatatactaagctgaaatcaaacacaaatagagcaaccatgttggaaataaccaaccaaataatactgctccctactccctacgttcaattctctttgtatatgtatgttggaacaagatggatttttatgccagcacaaggaaacaaggagcacattcatattcagttacgcaacta

SEQ ID NO: 42406 - DNA, 450 bp, Zea mays
  Clone ID: LIB3062-016-Q1-K1-E8
ctcggcgcggtcgcgggagttctcgctgccggactacgtcacctacctgctgtcggagtacgcgcaggtgctggaccgcctctacgacctcggcgcgcggcgggtgctggtgcagggggtggggcccatcggctgcgtccccgcggagctggcgctgcacagcctcgacggcacctgcgacgccgagctgcagcgcgccgccgagatgtacaacccgcggctcatggcgctgctggaggagctcaacgcgcgccacggcggcggcgaccccgtgttcgtcggcgtcaacatgcagcgcatccacaacgacttcatcgacgaccccaaggcgtacggcttccagaccgccacctacgcgtgctgcggccagggccgcttcaacggcatggggctctgcaccatggtgtccagcctctgcgccgaccgcgacacctacgtgttctgggacgc

SEQ ID NO: 42407 - DNA, 404 bp, Zea mays
  Clone ID: LIB3062-016-Q1-K1-E9
aaaaagaaagagagggggagagacacagaggcctcactccacacactgtctggtctctgagtcccagagctttgttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctccgaatttcactcgatcgaacacgacatgaagcggccacgcggcgccagtccccctctggctgcgatgaccaatccgaacgatgatggttacggcgtggtctggatggaagcggacgcagacgcggacgcggactaggagatgatggcgtgcggc

SEQ ID NO: 42408 - DNA, 313 bp, Zea mays
  Clone ID: LIB3062-016-Q1-K1-F1
accctgcaatgatgcagatgatgcagagcattatgtctgacccacagaccatgaaccagttgcttagcttcaacgcaaatgcacgcaacctgatggaatcaaaccctcagatgagggaaatatttcaaaatccagaatttcttcgccagctgacatcgcctgagactttgcagcaattactcttatttcagcagtctttattaggacagcttggtcaacatcaacctaaccagggtagagacaattcaggcagtgccacaggtacgcctggaaaccctagccttgacaccttgatgagcatgctcagtgggct

SEQ ID NO: 42409 - DNA, 343 bp, Zea mays
  Clone ID: LIB3062-016-Q1-K1-F10
caactgactagtactcagccgccgcaatcagggacaggtagctcgagcgcgcgctccacctgctcgcagcgcgaggcatgccaagtggaagaagaagaggatgcggaggctcaagaggaagcgccggaaaatgaggcagagatctaagtaggcgcatcttgtgacgaggatggcgagcttctcctgcatcatggctgaggctcgttgggatgatggtctccctttgcagacgtcctttgctgtagacgtaggcgatgtaaaccgtgctttttgattcattctagcatgttctgagactgggtttatattggaattcgaggataattatatgatgctctaagtt

SEQ ID NO: 42410 - DNA, 370 bp, Zea mays
  Clone ID: LIB3062-016-Q1-K1-F11
gcacagtactaccagctgatcctccttgtctatgaaggttacaagaacatcgtggaaagctgacaatataacgcgaccgctctgaatcaaggtctggacaagacggacaagttcaacatcgagtccaaagacaacggcgtgccgctgctgggcttgtctctgaaggacagaagccggcacagcgagttcgagatcttagacttgctgcgccgattcggatggatcgtgccaggctacacgaagccccccgacgcgcatcacgtgaccgtgctccgactattcatccgcgaggacttcagccgcacactcacggagcgcctggtgctagacatcgagaaggtgctgcacgagctagacgcgctgcacgccc

SEQ ID NO: 42411 - DNA, 387 bp, Zea mays
  Clone ID: LIB3062-016-Q1-K1-F12
gcccgctcacacaagacaccatctccctgcctgcgatccgatgcgtccaaggttttgggccgccgtacggtcctaccaccgctgtgcctaataattggcggctagctagctagctagctgcagctgctgcgatcctggatcggcacagccggttcttgatgtggagggagcggcggcggacgctgctcctgctggtggccggcgcggcgctgggactgatcggtgccacgctcgcgagcgcgccaccggaggccgagctgaaggtcgggttctaccatgcgacgtgccccatcgcggtagacgtggtcctcgcccagatgaggctcatcctcatggaggacgccacggtcgagccgtccctgctccggatgcactaccacgactgct

SEQ ID NO: 42412 - DNA, 444 bp, Zea mays
  Clone ID: LIB3062-016-Q1-K1-F2
gacggctccttgtcagatctctggtcttgtggggtcatcctctacgtgatgcttgttggctgccttcccttcgacgacaggaacctcgtcgttctttatcagaagattttcaagggagactgccagatccccaagtggctttcgcctgccgcgcaggaccttctcaagaggatcctccaaccgaatccgatgaagaggatcaacgtcgcggggatcagggagcacgagtggttcaagaaggactacgtgcctgctgttccgcacgatgatgacgaagacgtccttcctagtccagctccctcgataaaggagccaatcgatgagccggcgcaggacaagtgtactcctatcaacgcttttcagttgatcgggatggcctcttcccttgatctttctggtttcttcgaagaaaaggattcagcgcaaagaaaggattcggtcact

SEQ ID NO: 42413 - DNA, 248 bp, Zea mays
  Clone ID: LIB3062-016-Q1-K1-F3
caacatctcgaagacaatgatgttgccaaaaaggaaatcataccattacaatctctgcgccctttaccagtacccaaatcaccttcagagtcgtggctttctcgcactttgccatccgtgacaaataggtcacctctgccatcttttcttggaattcaagtacactcaaagaaacaggctccctgggtcataacgcaaccaaaggagaatgatcataaaccttccaggccacaacagataagaattgc

SEQ ID NO: 42414 - DNA, 369 bp, Zea mays
  Clone ID: LIB3062-016-Q1-K1-F4
aaacttacgaggattcccctagtaacgaggctgaactgatgcggggaaacccgttgattaatatcagaatgctggctccttcagtgttaagagaaggtgggacgacgacgtggtattcaagaatcaagcacgaggagagaccaagacaccgaaacggttcatcaccgacaccatcaggagtgatttcaacggtaaatttcttcaaaggtccatgaagtgacccttccgtcgttcacaattcagcctgaagcccctaatcgttataaggttggcgtataaccgaagaatcattattgggttgcggaatgaaacaagagggtaaccctatgcaaactacttaccaaagttttgcttaacaatgcatatcct

SEQ ID NO: 42415 - DNA, 305 bp, Zea mays
  Clone ID: LIB3062-016-Q1-K1-F6
gtataaaaaaatttaggctgggttaaaaaatctcctgatttgtcccatgacaaagcattgttctaagcctcgaccccggtaatgtcttggtcattctcaaatgggctacgatgtcgctgctacgccaaagcataggtctaagactcgaccctggtgcggtattttagcatcccctttttagtttcaatagtgtattgttgttgtccctcaagtgttgtttattatttactttgtttgttgcagctgtcggccttccagttgttcaaaagcaacaccagcttcatgtcaccctattgttgtgtaat

SEQ ID NO: 42416 - DNA, 374 bp, Zea mays
  Clone ID: LIB3062-016-Q1-K1-F7
gagagggcgagagtcctcccatccacaagttcttagcttttgcgagattgagatccggctggggacagaccgacagaggaaggtgaattgtgggaaagaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaggtatcaggatgctgggcatcatcccggggattctgttgatcatccttgtggcactgctcacagagg

SEQ ID NO: 42417 - DNA, 318 bp, Zea mays
  Clone ID: LIB3062-016-Q1-K1-G1
cggacgcgtgggcttgtggtttcccaagatgtcttctccaagcaagcgccgggagatggacctcatgaagctgatgatgagcgactacaaggtggatatggtgaacgatgggatgcaggagttctttgttgaatttcgtgggcctaacgaaagcatttatcaaggaggtatatggagggttagagtagaactgccagatgcgtatccttacaaatccccatcgattggtttcatcaataagatatatcacccaaatgtcgatgaaatgtctggttcagtctgtttggatgtcatcaaccagacatggaccccaatgtt

SEQ ID NO: 42418 - DNA, 333 bp, Zea mays
  unsure at all n locations
  Clone ID: LIB3062-016-Q1-K1-G10
cttgtagaagggccatgaactaagttcnatcaactcagctctcgcaaagaaatctcctgaaaagcgaaaggagcatgtaattaattgtgatcgaacagattcagatctgtttcctgtttctctaccaccaccacctcctccaccttcattacccccaattgaaagagctattgcaaatcccattgctccaccagaaaagcgatatagtccttcaccaaagacaagtagctctacttctgccacatcattctctattgcatctgttcagcaatatacaaatagcttcagagaggacaatgtgatcagagagagtcgattaggaaaggcttacct

SEQ ID NO: 42419 - DNA, 253 bp, Zea mays
  Clone ID: LIB3062-016-Q1-K1-C3
gactccgctctgttcatgccgcggaggtagagtccgcgggccggcggtggccacggcgagcctcctcggccgtcgggatgaagccgcggaggttcggctacggctacggctacggctacggctacggccgggtcaggcgcgcggcggcgctgctgctgctgctgctctgcctctgcctcagcagcctgttcctcctgcttctccatggctcctccacgccgctggagcccgcggcggcggcggcggaagcaag

SEQ ID NO: 42420 - DNA, 369 bp, Zea mays
  Clone ID: LIB3062-016-Q1-K1-C5
gcaatctcgatagtagaaggtttcttgtaaagtgtttgcttgataagatgtttcgaggtctggcctggattcccttttgcttggtaggatttgaacatatacggggaactgagagattcaattgccagaggctgcatatacagaaatccgattttttgatctctttgatggttcaaaacactctgctgtatgtatacaacaagtaggcaattagcgcattcttttggaagctgtaacaactactactcgccagccgatgttgatgcaacctcttgtaaaagtaatcctgtagaaccgaaccgtgtagggtagtcccataggtagttgggggctgtccaaaaaccgacgggcttttcctcttccttgaaa

SEQ ID NO: 42421 - DNA, 311 bp, Zea mays
  Clone ID: LIB3062-016-Q1-K1-C7
gtccttcctgatcccaccgcggtctccttccgcgacacgcgcacacgccacagcgcattcgcgtacgtcaacggacgtcgaacccatcgcccatgggaggagggcacgaggagcaggagggtggcggcgcaaaggccgggggctactcctccggtctcccgccgtcggagccgccgcacctgcagggccagccgccgcaggagtaccggtacggcacgttccagggccctcggcatcctccggtggggttcccgcagcctgcccggcctcccgggttcggcggcggcggcggttacaacaaccagaaccag

SEQ ID NO: 42422 - DNA, 325 bp, Zea mays
  Clone ID: LIB3062-016-Q1-K1-D10
cagaatccccggcaaataccatgcagagacttgtaccccagcctgcagctggggtcacggatcctgttgatccccagtcagctgttaaggtgccagttggaagatcgggcctacctgtgaagtcttcaagaagtgtggacccttcgcctgcttgagttatgacaagatctgatcctccacctgttaagatgatgtcacagagagctcaccatccagcttccatggtgtcgcagaaagttgatcctccgtttccgaaggcattacataaggaaaccggatctgttgttcgcctaccactagctacgctggctactgttcttcaaaa

SEQ ID NO: 42423 - DNA, 337 bp, Zea mays
  Clone ID: LIB3062-016-Q1-K1-D12
gccaacagcaatctcccgcgccgaatcatcaaggagacgcagcggctcctgggcgaaggagcaccggggattagcgcgtcgccgtcggaggagaatatgcggtacttcaatgtcatgatccttggccccgcgcagtcaccctatgaaggtggagttttcaagcttgaactattcttgcctgaggaatatccaatggctgccccaaaagttagatttctgaccaaaatttaccatcctaatattgacaagcttggtaggatatgcctcgacattcttaaggacaaatggagcccagctcttcagatacgtacagttctactgagcattcatgcacttc

SEQ ID NO: 42424 - DNA, 402 bp, Zea mays
  Clone ID: LIB3062-016-Q1-K1-D2
atttcaaaggcaatggcagcagattcgtaaatatgcacaaaagctgggtatcagcatcatgggtgacatgcctatatatgttggctaccatagcgcagatgtttgggcgaacaggaaatcatttttgctggacaaaaacggtttccccactttcgttagtggcgttccacctgatgcatttagtgaaacgggtcaactatggaacagtccattgtacgactggaaagctatggaagcagatggtttttcatggtggataaagaggattaaacgtgcccttgatttgtatgatgaattccgtattgaccattttcggggacttgcgggtttttgggcagtcccttctgatgcaaaagtagcactggttggaagctggaaggcttgaccaaggaatagcttttt

SEQ ID NO: 42425 - DNA, 361 bp, Zea mays
  Clone ID: LIB3062-016-Q1-K1-D4
gacacatcccggtgatcgacggcacggggatgctggggatggtctccatcggcgacgtggtgcgcgcggtggtggccgagcacaaggaggagctgaaccggctcaatgactaccttcaaggaagcttctaagaccgggttttccacgaccaacaacccttcgaatccggcaggcaatggaattccgcttttgaaatccattacttggaaccaagattatgaccaaataaggcctggttttttgggacaatgatggtaagttcggcaaggtttgcctttctctttttttttttctactgcgtggtctatgggtatattgccaaaggcatgcgtgagccatgcgcccggggctgcgctggggc

SEQ ID NO: 42426 - DNA, 296 bp, Zea mays
  Clone ID: LIB3062-016-Q1-K1-D5
cgtgcgctctccgtgggagcgaggactcgcggccggcggcagcggcaggttctcctagatctccggcatcatcagtaacaaatggctgacggtgaggacattcagccccttgtttgtgacaatggaactggcatggtcaaggctggttttgctggtgacgatgcgccaagggctgttttcccaagcattgtcggacgcccccgtcacactggtgtgatggttggcatggggcagaaggatgcgtatgttggtgacgaggcccagtccagaaggggtatcctgactttgaagtaccc

SEQ ID NO: 42427 - DNA, 431 bp, Zea mays
  Clone ID: LIB3062-016-Q1-K1-D6
cccacgcgtccgctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggctcgtgaatcctttcaccgggcaccgtcttcagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaagtgattgaagacgacacccc

SEQ ID NO: 42428 - DNA, 376 bp, Zea mays
  Clone ID: LIB3062-016-Q1-K1-D7
catttgcatatcacacatacttctctgtctctgacataagcgaggtgcgtgtcgaagggctggaaacaatggactaccttgacaacttgaaggcaaaggagcgtttcacggagcaaggcgatgctattgtttttgaatcagaagttgataaagtttatcttgccgcaccctctaaaattgccatcattgatcatgagaggaaaggaccatttgtcgtgacaaaagaaggccttcctgatgctgttgtttggaacccttgggacagaagggaaaagcaatgcaagattttggggaatccgaatacaagaacctgccgtgtgtggaacctgcaacttgtgaaaagcctattactttgaaacctggggaaaaatggaaa

SEQ ID NO: 42429 - DNA, 300 bp, Zea mays
  Clone ID: LIB3062-016-Q1-K1-D8
cgcacgtgagcgggctcgccgcgctgctccgcgcggcgcacccggagtggagcgcggcagccatccggtcggcgctgatgacgacggcgtacaacgagtaccccggcggcggcaacggcatcctggacgtggccacggggcggccggccacgccgctggacgtgggcgccggccacgtcgaccccgcgaaggccgtcgacccggggctggtgtacgacatcgcggcggcagactacgtggactttctctgcgccaacaactacgaggcggcgcagatcgcggggctcaccaagcagcacg

SEQ ID NO: 42430 - DNA, 346 bp, Zea mays
  Clone ID: LIB3062-016-Q1-K1-D9
caagcacgccttccgttttgggaaggcgaggagaggggaaccccggcccagggagaggggcggcgaggggatcggcggctgaagagatggaggagcgggagaagctcgcgtgcctggccaagcttgccgagcaggcggagcggtacgactatatggtggaattcatgaagaatcttgctaggatggacgtggatatgagtgctgaagaaaggcatttgttctcagctggtttcaagaacactattggagcacagagagcatcatggagaatcatttgttcacatgaccaaaaggtcgcagctgatcggcagactggtgtgatgatagatgcctataagaagaaagt

SEQ ID NO: 42431 - DNA, 358 bp, Zea mays
  Clone ID: LIB3062-016-Q1-K1-E10
cagcgccccacccccagccagctagtggtgttctctcagcagcgcgcccgagcgtgtggtccctgctaagctctgcgcctcggtaggcaaggaaaatcaaacagatcgtaaatggccggtagcagcgcggagcagctcctctccaggatcgccgccggcgatggccacggcgagaactcgtcctacttcgacgggtggaaggcctacgacacgaaccctttcgacctgcgccacaaccgcgacagcgtcatccagatgggactcgccgagaaccaactgtcgctggacctgatcgagcaatggagcgtggaccacccggaggcgtccatctgcacggcgcatggcgcgccgcagttcc

SEQ ID NO: 42432 - DNA, 423 bp, Zea mays
  Clone ID: LIB3062-016-Q1-K1-E11
agaaaagcagttcttcagctaggcaggatggcacatgaaggaggagatcgggggataggaggattcataaggagctcaaggatctgcaaaaggaccctcccacctagtgcagtgcaggtcctgttggtgaagacatgttccactggctagcaacaataatgggtccatctgatagcccatattctggtggagctttcctagttacaatccattttcctcctgattatcctttcaaaccaccaaaggtggcatttcgcactaacgtgttccatccaaacatcaacagcaacgggagcatttgcctcgacatcttgaaggaccagtggagtccggcactaaccatctccaaagtgctgctgtccatctgttccctgctgactgatccgaaccccgacgaccctttggtccccgagatagctcaca

SEQ ID NO: 42433 - DNA, 415 bp, Zea mays
  Clone ID: LIB3062-016-Q1-K1-E12
actacgtgatcggctcggctgccgacccgatgacacacgggtacctaaacgcgctaagcgccaaggccggcgtcctcagcggtcgcgctcgagtaccgcctcgcgccggagcacccgctcccggacgcctacaaggactcatgggagggactcaagtgggtggacacccacgcctccgccgccacgggaggaggaccggccgccgagccgtggctaacccagcacggcgacttatcccgcgtgttcctggccggggccagcgctggggccaccatcgcgcacttcgtagccgtacgtgccggcgagcacaagagcggaggcctcgggatgcggatcaagggcctcctgatagtgcacccctacttcagcggctgcggagacatcggatacgaggggacgactgggaatgcgcgca

SEQ ID NO: 42434 - DNA, 359 bp, Zea mays
  Clone ID: LIB3062-016-Q1-K1-E2
cttgtgctttcaaacaagttggttgtctatgacttggaaaatcaagtcatcgggtggagtgactataactgttcgtcgagcattaaaattaaggacgacaagacaggcacaacctatactgtcgaatcacatgacatatcctccggatggaaattccactggcacaagtccctggttctgttgttggtaacaatggtgtggagctatttatagtacgctaactctattggacaacacgaacacgcacttaccgaaattcatttgattcgtattcttttcacaaaaaagaatatctaaggttttaacttgtgttctctgaccacggaaaacgatgaaaacaaaaacgttgtgtgccatac

SEQ ID NO: 42435 - DNA, 298 bp, Zea mays
  Clone ID: LIB3062-016-Q1-K1-E3
gctgtcgcaggacgcacctgcacgcgttcaccaagccccccgacttcccgacccgagggcccgacctgcgcaccgacgggatccctacctatccggccgtcacccctccccctgcccctcccgagttggattgttcgcggaattggcggaggggcagccggatatgtcgtcgtcggttgggggcggcagcgcgggcggcggcggagtggacatggtcagcctgctggagaaggccaaggagttggaccagctaatgaatgaacaggacgaaatcgttgccgatatcaacaagattcac

SEQ ID NO: 42436 - DNA, 384 bp, Zea mays
  Clone ID: LIB3062-016-Q1-K1-C2
gctgctagtgtgtcgtccctgatgaccaccacggaatccataattgtagagatccccgaggaagaggcaccggctccagcaatgggtggcatgggtggaatggattactaagtgtcaagcacacccacgatacaacaacatcaaagcagagatgacgaggtggttgtcaggaggatacaattttgaggctgcggacgtaggacctctcaatatctccaagcaatagtggggggataataaacatgagcagtagttgtttgagatctgatgctgtagatcaagattggattctgacaccttgtgctgaaccaactgtaatctgattattacacattttttggcaaaagtaaatcggattgcccttctgttttgcggcttttgccc

SEQ ID NO: 42437 - DNA, 116 bp, Zea mays
  Clone ID: LIB3062-016-Q1-K1-A2
ggagagtagtagtgatccgcagtgtcgacggtaggaggctgttgtggctgaggtcccggtgacggaggtgccagcggaagtcccggcggcccatgtggcacgagcgcccaaggcga

SEQ ID NO: 42438 - DNA, 133 bp, Zea mays
  Clone ID: LIB3062-016-Q1-K1-A3
agctgattgaagatatttttgttcaatctgatcatgcagttgctgctgacaacctacgggagcaagtgagagattgtggaattaccatggagaccacttaactgatagttgatgagaaccaccggatcttggt

SEQ ID NO: 42439 - DNA, 246 bp, Zea mays
  Clone ID: LIB3062-016-Q1-K1-A4
cggaattccggctgtgggtttcaaaacgtgaaggagatacgacgctatccttggagcacaattgttatctcatgatgctcggcgggtgcgattccttccattaagaccgttctatagtggtgaaattgtggccttgaagacaggccaagacggggaaaagctcaagtcttgtagggtccctggatatgtaagaaccttagctgggcaagcactttacagaatttcagtggagacaggttctggcga

SEQ ID NO: 42440 - DNA, 366 bp, Zea mays
  Clone ID: LIB3062-016-Q1-K1-A7
ccagccgccgtcatgtcgaagcgaggtaggggaggttcggctgggaacaagttgggcgtgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccggcagcgcaagccgtggcgtcgcaaggacggtgtctacatgtacttcgaagataatgctggagtgattgtgaatcccaaaggtgagatgaaaggttctgcaatcact

SEQ ID NO: 42441 - DNA, 317 bp, Zea mays
  Clone ID: LIB3062-016-Q1-K1-A8
ctgcagccaactcgtcccctcggaccaacgcgaggccaaaaccaatctcacatctcctccccctcccaccagcgaggacccttccccaagaactgctccgagtcctggagcgggagagaggtcgagggaggagcccaataagagtttctcctcgcctctctctctttctgctcgaaaaattattgtcgcattggtttggttcccttgccaaaggaggctgcttttctgtcctccctgatctaacatgatggcgagcaccgcgtcagcgactgccgccgtcgtggcattcggggcagccgtcaagccgcggggaccgg

SEQ ID NO: 42442 - DNA, 307 bp, Zea mays
  Clone ID: LIB3062-016-Q1-K1-A9
ccgcattcgttccaactcctgagcactttgtcctagtcccagacaagccaagcgaaggggagatacgaccatggactccaccggcaccggagcagggggtaaggggaagaagggagcggccgggcgcaaggtcggcgggccaaggaagaagtcggtgtcgaggaccgtgaaggccggtctccagttccccgtcggccgcatcgggcgctacttgaacaagggccgctacgcgcagcgtgtcggcaccggcgcccacgtctacctcgacgatgacctcgaatacctcgccgctgaggttctggagctc

SEQ ID NO: 42443 - DNA, 206 bp, Zea mays
  Clone ID: LIB3062-016-Q1-K1-B1
ccctgacctcccccctccccctaccagaaaagacccctcgaaaaacggccgagctgcggcatggctgagatcgagggtggagctactgcggacgacgctacagctgctgcggaagcgacgacgacccctgaggtggcagtgcccgaagccggagccgctactgaggctaaagccccgcacaagcttcaccgtcaacggaccttctg

SEQ ID NO: 42444 - DNA, 348 bp, Zea mays
  Clone ID: LIB3062-016-Q1-K1-B10
gcgcaacacaagctcgacgtcgatatcgcggtgggctgcggagctggcgctgggggctgagactgacataggcgtggcgtacgtggcggacgacgacatgaacgcggacaagacggagtgcgcggaccagctggtgggcctggcgccgtgcctgcagtacgtgcatgggcacgcccacgcgccgccggccaactgctgccgcgggctgcgccaggcgctgaggaagagcaccaagtggatgtccgtgctcgtgaaggacaaggacaaccccaacctgggcatcaacatcaacgccaccctcttgctcgcgctgagcaacctctgcagcaccaccctggccaacgactt

SEQ ID NO: 42445 - DNA, 308 bp, Zea mays
  unsure at all n locations
  Clone ID: LIB3062-016-Q1-K1-B11
actgattaaaagactgacaagttcatctaagggtgtgaagactgattactcggtaaaggtccaagagttacagagacaacttgcacttgacagagaagaagcagacaaaatacaggatgatcgcgataatttcttaaatctagcacttcaaggctaacaacgttccattgntgttggtggcaaatatgacctacaagtgggtttttcggttgtctcagtgtgatttagtcttttctcaaggcatcaagttgtgaaagcaatgttgaaaaccacaaaaagacgtcccaaaactacaaatgtcataccac

SEQ ID NO: 42446 - DNA, 411 bp, Zea mays
  Clone ID: LIB3062-016-Q1-K1-B12
agggctcatgggcgtacgcatttgcggtacgcgtgggcggactcgtgtatcgagcccgggcaaacattggcggacgcagagccggctgcagagcggagatggcggagaagaagcgaagcgccggcactctcaaggatgaggtggtgacacgcgagtacaccatcaacctgcacaaacgcctccacagatgctccttcaagaagaatgcaccaaatgccatcaaggagatcaggaagttcgctcataaagccatgggtactactgatgtccggattgacgtgaagctcaactagcacatctggagcagtggtattctcagtgtgccgaggcgtgtccgcgtcagaattgcccgcatccggaacgatgaggatgacgcgatggaggaactctactccctggtcacagttgctg

SEQ ID NO: 42447 - DNA, 314 bp, Zea mays
  Clone ID: LIB3062-016-Q1-K1-B3
tccggattcccgggcagatgtatgggcatgacacgcctccgatgtatgtctgcatgtatgcagcattgatgccgattgccaatggccggtgtttgatgaggtcagcctcaagccttgcgcctcactggcaccacaagctcctctgtggcgcgcggagtcggatgccgcggggggtggtgccggcgccggcgatgtcatgggcctcctcctccgggagcgcatagtcttcctcggcaacgagatcgaggacttcctcgcggacgccgtcgtaagccagctccttctacttgacgccatcgacccggactctgaca

SEQ ID NO: 42448 - DNA, 440 bp, Zea mays
  Clone ID: LIB3062-016-Q1-K1-B4
gttgacgagaagcacttaagttctttttatcagagtgggtgtttctttacatcaaaactactctttgttgaagtggaatgatttgtgggagactgagttctgggacaaagttgaaggtggcctcatgattcatgaacgagccaagggcattagggtaatcggtagcttttgacaacttgattaagagatttttatccttcttggccgatagttagtcttaattgtttcgtggatcattaaggacgatcaaattttcgtgcttaaagtcagctcagacctgctagcctgctctgttggctagattctcatcatcggttccttgtatatttttgcatattgcagttttggatgctagcaattgcgactggcttctcctattactatctgaagcttcgaacttggaagataactctctcggccttagcggtttggtgctgact

SEQ ID NO: 42449 - DNA, 349 bp, Zea mays
  Clone ID: LIB3062-016-Q1-K1-B5
cggacgcgtgggtggagattgccccagcagtgtatggagatatttatggatatgggtatgctccttacggggcatactctccggccacttccccagttccaacggttgatggtcagatgtttggcgcacagcattaccagtatccaaccacgtattttcagcctcctacaccaattccttctaccactcaaagcaacctccagtcttccaacaatcctgaaaagccagcagctaaagcagatcctgccaaggcaaccggtaatggtgttccaaatggtactggtcacactcacagttacagtggaactgtaccaagccaacagagttcagcactgacgcctgatggaac

SEQ ID NO: 42450 - DNA, 425 bp, Zea mays
  unsure at all n locations
  Clone ID: LIB3062-016-Q1-K1-B6
cttcaacctgaagagttaaaatttgtgcatgatgctttgaagttggcatatgaagcagacagtggacaaaaacggcgaagtggagaaccattcattattcatcctgttgaagttgctcgtattcttggagagcatgaacttgactgggaatccatcgctgctggtttattgcatgacactgttgaagatacgaatgtggttacttttgaaagaatagaaaatgagttagggccaactgtgcgacgtattgttgaaggggagacaaaggtgtctaagttggggaaacttcagtgtaaaagtgagggtagcacnaaacaagatattaaagcagatgacctaaggcagatgtttcttgccatgacagaagaggttcgtgtgattattgtcaaactggcatacaggttggataacatgcgcactctcac

SEQ ID NO: 42451 - DNA, 427 bp, Zea mays
  Clone ID: LIB3062-016-Q1-K1-B7
gaagaagtctgccttcttcgggattgccctgaaccagatggggctggcatgtgttcagaggtattcgataaacgaagcagcagaattgttcgaggaagctagaactgttctggaacaagaatacgggccataccatccggatactttaggagtctacagtaatcttgctggaacttatgacgcgatgggaaggctggatgaggccatcgagatcttggaatatgtggttggaatgcgcgaggagaagctaggtacggcaaacccagacgttgacgacgagaagcggaagcttggggagctattgaaggaggctggccgtgtgcgaagcagaaaggcgaaatccctggagaatctgctcgagaccaacccgtatatcgccaccaaaagaaatggccgtgctgcatgagtcactgtcctcagatgacac

SEQ ID NO: 42452 - DNA, 324 bp, Zea mays
  Clone ID: LIB3062-016-Q1-K1-B9
cggacgcgtgggggctgccgcctgccgcatcctcccctcgcccaccgtcggggactgggtcccctcccaccgttgaggccgcctcctcacggcagcgagccagcgactcctctcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattcgactacgacgagagggatgtagcgttgtacgcgctcg

SEQ ID NO: 42453 - DNA, 366 bp, Zea mays
  Clone ID: LIB3062-016-Q1-K1-C1
gtatggctctgtagtggatgcaaatgatcgtcatcaccgcctccctggtcatttctcggaggaaaactttgttcaacaaggatttgatatgaaccttgctttctgcaatcaagagaagcagagaaatgaggagagttcggtggagtcatcacaatggagaaacatcaagcagcatgtgctaccttatggttcttcgaggccactcacacgaaagctttcatttgatgcctgctcaagtgaatcaaggggcacagaaccctcaacaagtatgtcaacagagaacacacctgtgtccatcaacgtcccaaagttggcagagggcattgaatttgggaagcaaccaatggtcacatccttcactttggt

SEQ ID NO: 42454 - DNA, 397 bp, Zea mays
  Clone ID: LIB3062-016-Q1-K1-C11
ggtgctgtctacgacaatatcgtgctcttataatatatatagagttctagaacatttcaaacacgacatggattattgtaactggccaagtacatctaaactcaagcgtaattagacacggtcatcctcatcctggtacatcttgaggatctgcgcgcatctaggaagggcaacgtccttctggaaccccagagcatttgccaaacgaacgtagcatgcaacaccgttgctgctggtaaggaagacgggggccctgtcacgaccagccacaacattggcacaccccttgtccgggctgctcacaaggacggactcgcatagctcatgctcatgctcatcaatgacaaggatgtcgtaggtgccgatgcggtcagtatgcccatcgaagctgcatgta

SEQ ID NO: 42455 - DNA, 422 bp, Zea mays
  Clone ID: LIB3062-016-Q1-K1-A12
cttactctcccttcccctcccgctaccacacgagcagcttcctgccgccgcagcgtacgcatggcctcgtcggacggctctgccgcggccctgcccagcgctaccgtcgatgtgcccggcgccggggcccctgtcctcgtcgagggcgcgccggggctccccgaggctgacttcaggaacgcggtggagtcgtcgctgttcaagcagtggctgcggaacctgcagtcggagaagggcgtcctcacctacgggaggctgagcctgacgcgggttctcatccagggcgttgacatgttcgggaaacgggtgggctttctcaagttcaaggctgatatcgtggacgaggaaaccaaaaccaaggaattgtctttgcaagagggcccgcagttgctgtgttgattcttttggagtcgaatggagaa

SEQ ID NO: 42456 - DNA, 331 bp, Zea mays
  Clone ID: LIB3062-016-Q1-K1-C12
ccatactctcccttgtggttctagatccactcctccccgtgctcactgctgagcctcggacaggttgagcggggacgccgtggaggggcgagggggagccagattgagccatggcctcctactgggttcttgccctggttcttgcgctgtcggcaggcgcaagcctggcgcgtggctcctagccgtggtggaacgagacgcaagtgtacgccaccaccgccaactgcggtggcggcaacagcgtcttcgtcagcctcacgctcatccagtcggcggcggccaatggagcggtgtgcttggatggaagcttaccaggttaccaccttcacag

SEQ ID NO: 42457 - DNA, 418 bp, Zea mays
  Clone ID: LIB3062-015-Q1-K1-G4
cacggaggaggcgatgcggaacgccatcgagggcatgaacggcaaggagctggacgggcgcgacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacagtggtggtggcggcggctacggcggtggcaaccgtggcggcggctacggcaactccgacgggaactggaggaactgagcggtggggcccgcgcggtcaagttatcctgttcgctaccgtgttgtttaccctagtccagagtgtttatctttcgtcgtctcgtgttttgtgttgcccatctgtgtttttgat

SEQ ID NO: 42458 - DNA, 236 bp, Zea mays
  Clone ID: LIB3062-015-Q1-K1-G5
cagggaaggcatcaacaacgcgacgaactcggtgaccgtcgtggcggtgctgtgcgcgacggtggcgttcgcggcgatgttcacggtgcccggcggcaacgccaacgacggcgtggcggtggccgtgcacgcgacggccttcaaggtgttcttcatcttcaacgccgtcgcgctgttcacgtcgctggcggtggtggtggtccagataacgctggtccggggcgagaccaaagcgg

SEQ ID NO: 42459 - DNA, 419 bp, Zea mays
  Clone ID: LIB3062-015-Q1-K1-G6
cgtggaaaccatagctattgggggcgaagggcttatgagcgtcatttcaaggaatggcgtcatcagcatgggaggcgatgccttggcattcccaatactaagaatttcaatgaaattacatccatcgaggaggcgaaagcgctctgggagaaaattcaagcacgacaaggggtgaacaagtggcggccagacctagaagaagagtatgaagatcaggaaggcaacatctacaacaagaagacctacactgacctgcagcgtcaaggcctgatctagggctcctgctggttaaagttgtcgggatttgttcagaacttatctcatgtagttgtaactctgaaaatattggcccatctggcatacattttatgtaataagatgattttccggaactcgtgcttttcctggttggcatgggt

SEQ ID NO: 42460 - DNA, 217 bp, Zea mays
  Clone ID: LIB3062-015-Q1-K1-G7
acccgttcctctccggcggcgtcaccgtgcccgacgccaccgtctccaccgccggggggttcttcaccgagttcatcatctccttcaacctcctcttcgtcgtcaccgccgtcgccaccgacacccgcgcagtgggtgaactcgccgggatcgcggtgggagcggtcgtaacgctgaacatcctcgtcgccgggccgacgaccggcgggttcatgaa

SEQ ID NO: 42461 - DNA, 418 bp, Zea mays
  Clone ID: LIB3062-015-Q1-K1-G8
gttcgatgatatgctcgaactggtggccgtcttcgttcttgctgaaatcgagtcggagcatgatgtggtacgttaattgatcacgtgctatggaagacgagtggaattgatctccaagtgatgctgatggacgaagctaaaatggatgaatcaaccaagtgccaggatggaagatgctcaccaagtggtcgtcaattaacaacactaacgtagtgtttatcccaggttgtaattttgttctgttgtggatggtgctaagtgccggtgggctcggccttcttatataagtatatcccatctttagcttctttattgaggattgtcacttaagctagcatgtattttaaaacttataaatgttttatacattcaaattgtaatatttttgaatcaaattctcttataatcactccgatga

SEQ ID NO: 42462 - DNA, 409 bp, Zea mays
  Clone ID: LIB3062-015-Q1-K1-H10
agagatacaagcaaagacacccaactcgtacatccttcaacaatttgaaaatccagctgacccagagattcactatgagactactgggcctgaaatctggaaagctacagcaggaaaaattgctggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcctggatgttgatctccttgatgagactctacaggtttcaagtgatgaagctattgaaactgccaaagctcttgctctgaaagaacggttggtggttggaatctct

SEQ ID NO: 42463 - DNA, 434 bp, Zea mays
  unsure at all n locations
  Clone ID: LIB3062-015-Q1-K1-H11
ctaaattagacgtcacaaccagtggcggttggcagcatgatatacttcatgtgcgcagaaccagatggtgtttggtcatatgatgtaagcaccgggatttggaggcaatttgccatcccactgccactgcatctgactgatcacacacttgccgagttccagggaagggttatgctggtgggtctgctgtgcaaaaatgcagcgacctgcatctgcatatgggagttgcagaagatgactctcctctggaaggaggtggacagaatgccaaatctctggtgcttagagttctacggtaagcacatgaagatgaaatgcctgggcaacagtggtttgctcatgctctccttgaaggcgaagcatatgaaccgncttgttacatacaaccttttgaaaagggagtggcacaaggtcctgattgcatgctaccatgg

SEQ ID NO: 42464 - DNA, 437 bp, Zea mays
  Clone ID: LIB3062-015-Q1-K1-H12
cctagccacactggtgttatggtagggatgggacagaaggatgcgtatgttggcgacgaggcacagtccaagagaggtatggtcacgctcaagtatccgatcgagcatggtattgtgagcaactgggatgacatggagaaaatctggcatcacactttctacaacgagcttcgtgttgccccagatgagcaccctgtgttgctcactgaggctcctttgaacccaaaggccaacagggagaagatgacccagattatgttcgagactttcaatgttcctgccatgtacgttgcaattcaagcagtgctgtcactctatgccagtggacgtactactggtattgttctcgactctggtgatggtgtgagtcacactgtgcccatttatgaaagatatgcccttccccatgccattcttcgtctggatcttgctggtcg

SEQ ID NO: 42465 - DNA, 271 bp, Zea mays
  unsure at all n locations
  Clone ID: LIB3062-015-Q1-K1-H2
tcgcgctcctgtccaccctgccaccgncgactcctctccgncgcagcaactggcaacctccgtatggcccctattaaggggcgccaagctccgggggaaaagcaagacggacctgcaggcgcagttcaaggagctgaagtctgagctctccctcctccgcgtagccaaggtcaccggcggggcacccaacaggttttccagatcaaagtggtgcgcacctctattgcgcgcgtgctcacagtgatctcgcacaaacagaaatctgcgtttc

SEQ ID NO: 42466 - DNA, 225 bp, Zea mays
  Clone ID: LIB3062-015-Q1-K1-H3
gtaaaggattacacagacttcgctaaggtgtgctttgagaacttcggtgacaaggtggagaattggttgacctttaacgagccacagacatttacaaccttttcgtacggaacgggagtttttgcccctggacggtgctcaccaggagaaaaatgtgctcagcctattgctaactcactcaccgaaccatacattgctggccacaacatccttcgagcccacgct

SEQ ID NO: 42467 - DNA, 379 bp, Zea mays
  Clone ID: LIB3062-015-Q1-K1-H4
ggccgctctcacttccgctctcctcttcgccgccctcctcgtggccgcccagtacgtgctgcgcttgctccactccttgctgtgggtcccgttccgcctggaacgccgcttccggcggcagggaatccggtggccaccacgaagcctggtctccggtaacgcagccgactaccgcgacctgctagccgccgccaggtccgcgcccctctcctccttccgccacaacggcgtcgtcgcccgcgccacgccgcagtacgcggtctggctggcgcggtacggccggccgttcgtgtactggttcgggccccggccgcggctggtgatctccgacacggagctcgtgaaggccgtgatgaccgacttcacggggggctttgat

SEQ ID NO: 42468 - DNA, 342 bp, Zea mays
  Clone ID: LIB3062-015-Q1-K1-H6
cctcgtcgacacaactccgttcattgtccactactggaacagcaccaagttcgattggagaggcgtcgctcctcgagacacctacatcgcgaatctcctcaaggacttgaagtgtgcactgacagcgtccaaggctccctggaaaatcgtcgtgggtcaccaccccatcagcagcgcctgcgggcatgggaacaacactgagctggaggagttgcttctcccggtcctcaggacacacggggttgacatgtacttgaatggccatgaccactgccttaagcgcgtcagcagcagagacagtcgtcttcagctactaaccagcggcggcgggttccaaggcat

SEQ ID NO: 42469 - DNA, 239 bp, Zea mays
  Clone ID: LIB3062-015-Q1-K1-H7
agactttccgctctagattgctcatacttccattgtggttattagtggaacttttctcactggtcggagagggtcaagaccgtggacgtgcaccccacataggcatgtcaatttgtcggagagaggaccccatacatcaaacatgactaaagaagaagaagatgaacaataccttatagatgaataatatgcccttgcttgcgcaggtgggaacacatttagtttcacaacctttatgc

SEQ ID NO: 42470 - DNA, 429 bp, Zea mays
  Clone ID: LIB3062-015-Q1-K1-H9
catgagcgtgttcgtggcggagcgggacgtgccgcgcctcgactccatcctcacctacgtcccggtgcccgacatcctgcggaggcagcgcctgctggcgagggactccgtcaagcgggcgctgctgttccaccagcccgccaggcccggggacgccttccaccaggtgctcaacgggctggcgcgcaagctgccgcacggcgagggcgtgttcctgcagcccggggagaaggcgctcgactgggacgccggactcgagagcgacctcaagccgtggtagtgggccagtacctagcggttgacttcttcatgttccttctttcttttggtctctcttatttgattggcattggcatcgatggatggatcacacattagtttttgtatactacggcccgtttacatgcagcagcgctatactgtatactc

SEQ ID NO: 42471 - DNA, 409 bp, Zea mays
  Clone ID: LIB3062-016-Q1-K1-A1
cacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaggccggcgccatcgccgccggcgccttagcactctacgagaagcacgaggcgaagaaggaccccgagcacgcgcacaggcacaagatcacggaagaggtcgctgccgcggcggccgtcggcgccggcggctacgtattccacgagcaccacgag

SEQ ID NO: 42472 - DNA, 337 bp, Zea mays
  Clone ID: LIB3062-016-Q1-K1-A10
agcgaacagagcactgaagcatatcgagcgagctgtccggccaaaccctcagggtcgggtgcacaatgccgagccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggcccgcgc

SEQ ID NO: 42473 - DNA, 359 bp, Zea mays
  Clone ID: LIB3062-016-Q1-K1-A11
aagaagcagagcagcaacggcacagttagagagagagagagagaggcgcggagccagggaagcggagcagagcaacagcagcaggtcgaggaagaggagaagagaaggtccaggagacagcacagcagccaggaagagcaagagcaagatgctgcgcggtggcacgggcatgctgggggtggtgaacttcataaccttcctgatctcgatccctatccttggcggcggcatctggctggcgttgcgggccaactacaccgactgcatccgcttcctgcagtggcccatcatcgcggtggggctcggcctcatggtcggctgcctcatgggcttcgccggcgcctgctaccgccagacct

SEQ ID NO: 42474 - DNA, 280 bp, Zea mays
  Clone ID: LIB3062-015-Q1-K1-G3
cgcactgtcagcggtgttcaaggtgggtgcagcatccagtgaggtgttcatggctgacgctgaggaggcttggtaacggtggtggcgttggattggagccatgggtgtgcattggcgatggacagaaggcggctgcagccgcatcatctggaaggaaagagaggaatggttgtagaattgagtgctactgcagttgggtgtttgtggcacggtgcgcggacgtcgaggtgtggagtcaggtgggattggcaccagaagccggtgggaaagaaagtgatga

SEQ ID NO: 42475 - DNA, 405 bp, Zea mays
  Clone ID: LIB3062-015-Q1-K1-E8
cagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggatgaggtcgctgccgcggcggccgttcggcgccggcggctacgtattccacgagcaccacgagaagaa

SEQ ID NO: 42476 - DNA, 358 bp, Zea mays
  Clone ID: LIB3062-015-Q1-K1-E9
tcccacccgttgatggccttgattgtcaccaccttcgatcccttccagaagtctcaagtacaccgccaaccgtgcccatagcccaccactcctccagaatcctcggcaacatcatcaacggcagaacgatcccgctcatacatgtatagccggcctaccgcaacaagaagttcgagacactttcatacctgccaccgctttccaccgacgacctgctgaatcatagtcactacctgctgctcaacgactggatacaccttactctaactaaaacaggtcggattcgtgtaccgtgaaaactccacctacccttgctactacaaccgccagtactggaccatgtctgaatctgcccata

SEQ ID NO: 42477 - DNA, 93 bp, Zea mays
  Clone ID: LIB3062-015-Q1-K1-F1
aatcgttgtactgagtagaccttctggataccggattctgagtagacctttgaatccgtgagggatcagccaatctcggaaaggaagtttcgt

SEQ ID NO: 42478 - DNA, 392 bp, Zea mays
  Clone ID: LIB3062-015-Q1-K1-F10
cgccatctccatttccagcatagaagactcgatacagctcaaggacagcgctccgcaggcgcacgcaagccagaccggaccgaatcgaagcagcagcagcgtacagaagatcacaccctactgccgcgctgcactgcacaatgggcatctgcgtgtcgtgcgacgcggcggacgagggcgccgcgacggcggcgcgggtggtgctccccagcggagagctccgggagtacgcgccaccggccaccgccgcggaagcgctgcaagcggcgggcgagggctcgtcgtggctcctctgcgacgccgacgggatggcgttcgatggccccgtcgcagtcgcggcggtcgcgccggggtccgagctccaggcggtgcaaatctacttcgtgctcccc

SEQ ID NO: 42479 - DNA, 400 bp, Zea mays
  unsure at all n locations
  Clone ID: LIB3062-015-Q1-K1-F11
gagctcgcacgcttggggcccggcggccgtgccgctggaggcacctggcgcggcggtgctggacgcgaacgacttccgcaagtaccgcggcgtgcggcagcggccctggggcaagttcgcggcggagatccgcgaccccaagaagcgggggtcccgcgtgtggctcggcacctacgacaccgccatcgaggccgcgcgcgcctacgaccgcgccgcgttccgcatgcgcggcgccaaggccatcctgaacttccccaacgaggtgggcacccgcggcgcggacttcctcgcgccgccgccgccgccgccgcatgccgcggcaacgtcccagaacaaacggaagctgatgcacgacgccgaggccacggncacggccggggccggagccggagccgagcca

SEQ ID NO: 42480 - DNA, 398 bp, Zea mays
  Clone ID: LIB3062-015-Q1-K1-F12
acaccacctgcgcatcttctttccgagcagtacgtacgtagctgaattgctgaaaagagaggcagagatccgatccggaccgcgaagagacgatgactcacccgaggccggatcatgaaccgtcgggcgaggtgtcgctggcgctggcgctgagcacggactcgtccggctccgcgggtgccccggcggcgaagcgggcgcggcggatgggcgccgcggcggccacgtcgggggagggggagttcgtgtgcaggacctgcagccgcgccttcacctcgttccaggcgctcggcggccaccggaccagccacctgcggggccgccacggcctcgagctcggcgtcggcgccagggcgctcagccggcagcagcacaagcatcatcagcaggccggcggc

SEQ ID NO: 42481 - DNA, 387 bp, Zea mays
  Clone ID: LIB3062-015-Q1-K1-F2
cggaattcccggcgggacgcacgcattcgtcgcgtgcgaaccaagcagaccacaacatgaagaagcgtagtcgtcgccggaaggaggggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcacttggggcattactatcaagaa

SEQ ID NO: 42482 - DNA, 372 bp, Zea mays
  Clone ID: LIB3062-015-Q1-K1-F3
caagtgggcatggagcgctgaaagagaaccactggcttgatgatggagcataccttagggtgaaacttttgaataaacttgctgctgctagaacactgggttcaagtattggtagtaaagttttgactgatttggttgagggccttgaagaagctgatgtgacagttgaaataaggttaaagattgatcagaatcatgcagatttgaaaggagggtccttccgtgactatggagaatccgtcttgagacatttagagaatgcaatcagcaaagacccaaatctccataaagcccaggtgaaccatgatggcgtaagggtttcaggatatggtgggtggttcttgctgaagctctctctgcatgatcctgttc

SEQ ID NO: 42483 - DNA, 402 bp, Zea mays
  Clone ID: LIB3062-015-Q1-K1-F4
gacgacggcaccgtcaccgagaactactgggagcccgcgagcgacgacgccaccgaggaacccccgcggaggccctaccgcatcgaggtggtcggggtcgtctgcgacgcctacctcgccgtggcgaggggcatccggagggccatcatcacccggcgggccgtcagggtcaggtcccagctgcagtcgcacaagcgcttcgccgccgcgttccagcggtacagccgcctcgtggacggcgccaggctctacagcaccaactccatgggctctgccaagctcatcgcgtggaaggacgggatcggaaacagcctgctggtggagccccgggagttcgactgcctggagaaggtgagcgggctcaacgagcacgccacctccggtcacgacctctaccccgac

SEQ ID NO: 42484 - DNA, 264 bp, Zea mays
  Clone ID: LIB3062-015-Q1-K1-F5
gcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaagtgaacgagactaaagcaacccg

SEQ ID NO: 42485 - DNA, 337 bp, Zea mays
  Clone ID: LIB3062-015-Q1-K1-F6
atcatctcaagcagaagtgctgacctgtagagtgaagaaggaatatcagcttcaatggccgcactttgttggaatgcagtagcttacaatagtgacgatgtcagcgaggctggagtaaagatatttcagcgaccagtctcaaatgaggtatatgatctgagagcaaaaaaggatcctccattttgcaaggaagagcagaacaaagctagtgcatggtatactaatatcaaacattgcctgcacaaagcacctgttggtatcgaagaaagaggcagtgactggcctgaggagtggcccaagaggctcgagagtttccctgagtggcttgaggaaacag

SEQ ID NO: 42486 - DNA, 317 bp, Zea mays
  Clone ID: LIB3062-015-Q1-K1-F7
cccattcctcgcgcggcgaccacccgattcgaagcgtgcggagagaccgaacaagcgggagagatggctcgtaccaagcagactgctcgcaagtccacgggagggaaggctcccaggaagcaacttgccaccaaggctgcccgtaagtctgcccccaccactggtggagtgaagaatcttcaccgttaccgtcttgcaactgttgccctccgtgagatccgcaagtatcagaagagcactgagctgctgatcaagaagctgccctttcataagctcgtcagggaaattgcacaggacttcaaaactgatttgcgttt

SEQ ID NO: 42487 - DNA, 384 bp, Zea mays
  unsure at all n locations
  Clone ID: LIB3062-015-Q1-K1-F8
aggagctcgacggccgtaacatcaccgttaaccaggcccagtcccgtggcggtggcgggggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattangtgttggtacccctgttg

SEQ ID NO: 42488 - DNA, 391 bp, Zea mays
  Clone ID: LIB3062-015-Q1-K1-F9
gccgtgagatccgcccgactctcgctccgttccggcgctctcggtcgggcgaaggctggaccttggtacgacaagatggcggcgaagggagccaaggccacggccgacaagtcggcggacaaggacaaggggaagaagaccggcggccccgtctcgcgctcctcccgcgccgcaccccaggagaagtcagctccgaagaaagatgtttatcaattgttcgctgagaaggtcagggataacaaacaactggaatcaagatgggcgatcatgcaagaaacccgcgtggagtatttccgtggaaaagatttcaataccttcgtcaagaatcatccagaagtcacggaaattttggagccagataaggatttagaggtggaagacattgttaaca

SEQ ID NO: 42489 - DNA, 300 bp, Zea mays
  Clone ID: LIB3062-015-Q1-K1-G1
gctagctagcatacagacgaataatctcttcttcacctcactaacaccagctagcaagtctgtctctactgcaatgaatggccgctcgctcctcctcctcccagccgcagctggtcgcggcggcggcggtcctggcagcggcgctgctgctgctggcggcagaggccgggacggcgtcagcggcggtgagctgcggcgaggtgacgtcgtcggtggcgccgtgcctcgggtacgcgatgggcagcgcggcgtctccctccgctgcgtgcttcagcggggtgcgctcgctcaacagccggg

SEQ ID NO: 42490 - DNA, 423 bp, Zea mays
  Clone ID: LIB3062-015-Q1-K1-G10
ccttttagaccgcaacctcaaaaccctagcttgtccctcctgctcccagatctcttcgactcagggactccctagcacatcaaaccctagctccgcccagccccccaaccatgtcggcgatgatgcaaccgcagatcatcctgctcaaggagggcacggacacgtcgcaggggcgcgctcaggtggtgagcaacatcaacgcgtgcacggcggtgggcgacaccgtgcggaccacgctggggcctcgggggatggacaagctcatccacgacgacaagggcggagtcaccatctccaacgacggcgccaccatcatgcgcctcctcgacatcgtgcaccccgccgccaagatccttgtcgacatcgccaagtcgcaggactccgaggtcggcgatgggacaactactgtggtgcttctagctg

SEQ ID NO: 42491 - DNA, 391 bp, Zea mays
  unsure at all n locations
  Clone ID: LIB3062-015-Q1-K1-G11
cgggatgctggtgcagaagaggggcggcggtggcggcggcgacgacgagccgtcgccgagcgtgaagcccgtgcccaccatccgggtcaaggccaagcacgccggcgtcacgcacgagatctacatcagttccgaggcctccttcggtcagtccagccgtctgctctctctctctcgctcgctcgcgctgacggatgctgctgcgcaggggagctgaagaagctggtggccgccaagacggggctgcaccccgacgaccagaaggtgctgtacaaggacagggagcgtgactccaaggcgttcctggacacggccggcgtcagggaccgctccaaggtggtggtgctggaggatcccgaggcccgcgcgcgccgactcatcggngagcgcc

SEQ ID NO: 42492 - DNA, 284 bp, Zea mays
  Clone ID: LIB3062-015-Q1-K1-E7
ttcccgccgttgttatcatacttttttattttttttttttttttttttttttttctttctatttttttttctttggctgtttacattcaaagtcgtgacgccattttttttttttttaacacaaacaacaaaccccccatactcatttaaactcaccaaccccaccaaccccaactctcaaacacctacatctcaccccaaatcaattaaaacatccaccaaatacaccatcttacctacaaaaaccctcaacttacccacaaaaaacaccccctaccacaaaa

SEQ ID NO: 42493 - DNA, 401 bp, Zea mays
  unsure at all n locations
  Clone ID: LIB3062-015-Q1-K1-G2
cgacccatcataacaaatcaaaccatcacccgatttgtttacccccgaaaatttgccggcggctcgtctcgctcccctgtttgcgccgcccccagatccggcaccgcccgctgctcgaacccgcaccccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactntaagatacggacaatagaattggatggtaagcgtataaagctacagatttgggata

SEQ ID NO: 42494 - DNA, 425 bp, Zea mays
  Clone ID: LIB3062-015-Q1-K1-D10
gaacacagggcacacgcactacacgcacggcacgcagatacatatagagagaggttaggtataggttgcacatctattgaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggatcaccagcgaaatcgggaacgcgcaccaactgttcgtcgttgtgttcgacaccgacaggctcaaggggctcac

SEQ ID NO: 42495 - DNA, 392 bp, Zea mays
  Clone ID: LIB3062-015-Q1-K1-D11
agccaccatcgatctgcaagtctcgctacgtagcagtgcaataaaaaaaagcagccggggtggcgggcagcaccatgggcctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctc

SEQ ID NO: 42496 - DNA, 386 bp, Zea mays
  Clone ID: LIB3062-015-Q1-K1-D12
agcaagccttccgaaataatcttaatcccctttcctttttctcgtcctggttcccggccgtccttcccaagaggatagttctttagccaagccatatcacacttctctctctaccgagccacacagaccagagcgagctctcatggcgatactgctccgcaaggtgtggggctccgtgctggcgcgcgccgcatcgccgggggccgacccgcgggcccgccgcgcgcacgcgcatctcgcggagcagtaccagtaccacagctcgctatcatctggtcgcgctcgacgacgtccccaccaacgtgctgctccagatcatgctgctgctggtcccgctcgtcgacgcgcgctgcagcaccgtctgccgcgcctggcgcgtcctcctc

SEQ ID NO: 42497 - DNA, 356 bp, Zea mays
  Clone ID: LIB3062-015-Q1-K1-D2
ctgaagactgtgaagctgacactaaaagggaaaaatcctgttacccttgatcaccttggtgggaggggaaacaacatgggctattatatccttcctgacagcctaaacctggagactttgctggttgaggaaacaccaagggtcaagcctaagaagcctacttctgggaagcccttgggacgtgggcgtggccgtggtcgtgggcgcggtcggggtcggggacgttgagcatgctagctgcttttggaaattgcattgcgtgcatctgcagtgtaacctacattcctatcaattgtacgaagtatgcctttgattatgccaccatgtatcaattgcttttaaaaaaaagtaaaaca

SEQ ID NO: 42498 - DNA, 352 bp, Zea mays
  Clone ID: LIB3062-015-Q1-K1-D3
ggagttcccttcgaggaaattcgcgccatcactccgagtgttgttgcgaaaatttctgctagaatcagcgaattgatgcgagctaggagccaagactcttgtggttccaggaaacctccctattggatgtgtcccaaaatatctgatgatattcaagagcaataagaaagaggattatgatccacagacaggttgtcttagatggatgaacgagttctcacagtaccacaacaagcttcttgtggagcagctcaagaagcttcgcaggctccatcctggagtaaccatcatctattgctgattactaatggactgctatgggaaatattcctttccctggaacatatgggat

SEQ ID NO: 42499 - DNA, 227 bp, Zea mays
  Clone ID: LIB3062-015-Q1-K1-D5
cgcagtatgcctatctaaagggttatgcgcacccatcggatcagttgttgttggttgagaggccttcatcgacgagagggcctcacgaaaattaaacagttcacggtggattcatcttcggtcgagaccaatatggtgttcttcgatatcgtggatccacacatttcaccgagcaagctatgccaagtcttggaacaacgcaatgttcttgcaatgccagcaagttc

SEQ ID NO: 42500 - DNA, 287 bp, Zea mays
  Clone ID: LIB3062-015-Q1-K1-D6
gcgtcttggaatatttgataagcccagcaacaaccaatggttctctcaactagggccgaacagtgtgtgcacgaaagagcatagagagcttgcagcagaagctgtaaggcagggtgctgtccttctgaagaatgaccataattttttgcctctgaagagaagcgaagttagacatgttgccatcattggaccatctgcaaatgacgcgtatgcgatgggcggagactatacaggtgttccctgcaatcctacgaccttccttaagggcattcaagcatatgctacac

SEQ ID NO: 42501 - DNA, 306 bp, Zea mays
  Clone ID: LIB3062-015-Q1-K1-D7
catccaactcccatggcggagatgtaaacttgagctattttcttgtttcatcggccagaacagtggggtttggaggtgtatactgatgctctcatgtccagctacatctacaatgtaccttgcactcttgtttgcttttagctgtgcttattcctgagtcgttgaatgttttatattttctttccacaagtctgtctcatgtagggaactgtctcatctaggaatataacttcctttacttgctacccgtgcgattgagtttggaacccccattgaatttggaaaccccaaacctgggcttgggtt

SEQ ID NO: 42502 - DNA, 260 bp, Zea mays
  Clone ID: LIB3062-015-Q1-K1-D8
gggggaagtttgagaatctacaaaagtgtatgtacaacaaagaatttttgagatcattggtatctcgcctgaacaggcagaggagaaatttggctaccttttagaatgcttcgacatgggtgctcctccacatggaggcattgcctatggattggatcggttggtgatgcttttggcgggtgagagctcgatccgagatgtgattgctttccccaagaccacgactgctcagtgtgcactcaccaaagcaccatcagctg

SEQ ID NO: 42503 - DNA, 425 bp, Zea mays
  Clone ID: LIB3062-015-Q1-K1-D9
gggcggaccgggcaagcgcggctgccagcgcgcagccggtcggtgcggtgcctggcggggctgagcccggagatgcgggagacactggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctcaaggagtactccagctggcccaccttcccgcagctctacatcgacggcgagttcttcggcggatgtgacatcaccgtcgaggcatacaagagtggagaactgcaggaaactctagagaaagcaatgtgttcgtagaaaaaaatgaacaataagcagatggcatacaattaatcaaa

SEQ ID NO: 42504 - DNA, 297 bp, Zea mays
  Clone ID: LIB3062-015-Q1-K1-E1
aatgggttgagatctatagtgtcgcacttgcccacattgctcaagcaattgcaagtaaaaggccacaattcatgatgagggcagatgaactcttcgaacaacttcagaagttcaatataggttctcaatatccttatgaaaacgagatggacctcgcattagaaagggcactctgctcgttacttgtgggggatatttgcaattgcagaatgtggcttggaattgataatgagtcctcgtcatatagggaccccaaaattatcgagtttgtggtgaataactctagcatgaacgaag

SEQ ID NO: 42505 - DNA, 315 bp, Zea mays
  Clone ID: LIB3062-015-Q1-K1-E10
ctgtcacgtcctcatccatccaaccaggcgagccaacaagcaagcaaaagtaaacggggcgaggagctggagagacgccggcgacgtgaagcaaccgcccgatcggagccgcggctgagcaggaggagggagccggagatggtgggtctcgtcggcggcagcacggcgcgggcggaacacgtcgtcgccaacgccggaagggaagcagaatacgtgcgccggatgcaccggcacgcgccggccgatcaccagtgcaccttcacccttgtcaagcacattaaggcgcccgtccaccttgtgtggcaactcgtgcgg

SEQ ID NO: 42506 - DNA, 417 bp, Zea mays
  Clone ID: LIB3062-015-Q1-K1-E11
gtcggccatggggaggtacccagagaaggctctcaacgtccttaggagtgttagcctggggatcgaaaggtggtggagagaggagaagcgccaagaggcactggagcttcaaggtgtctcgtcttccttttctgacaagatatcagaggaaatatgcaattcagcagctaaaatggccaacaacttaggagtcgacgccgttttcgtttacacgaaggacggatacatggcctccctgctctcacgatgccgccccgactgcccgatcttcgccttcacgtcttcgacgtctgtcaggagacggctgaacctccagtggggcctcatcccgttccggctcagcgagtccgacgacatggagagcaacctcaaccgcaccttcttcctgctgaaggccaggggcatggtgcagtctgg

SEQ ID NO: 42507 - DNA, 394 bp, Zea mays
  Clone ID: LIB3062-015-Q1-K1-E12
ccggtgtggccgggcatccaggccaactccgggcacgacgtcctggagggcggcggcttcttcctcccgccgagctcccagaagtccttcccggcgccggcccacccctggtccggccgcatctgggcgcgcacgggctgcgcgggcgccggcgcgcatctccactgcgccacgggcgactgcggcgggcggctccagtgcggcgggctcggcggcgcggcgcccgcgacgctggcgcaggtgaacctccaccacggcaacgaccagacctcgtacggcgtgagcgtggtggacggcttcaacgtgggcctgtccgtgaccccgcacgatggccgcggcaactgccccgtcctcgcctgccgcaagaacctcaccgagacctgccccggcgagc

SEQ ID NO: 42508 - DNA, 446 bp, Zea mays
  Clone ID: LIB3062-015-Q1-K1-E2
ggaatcccggctggacgccacgcgttcgatcccgtcccaagaggagaaactccggttcgtgacgcgggggaaaatggggaagactgcggggcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcaccttttcatatgcatatacggtatctgtgcctggcaaacatatt

SEQ ID NO: 42509 - DNA, 358 bp, Zea mays
  unsure at all n locations
  Clone ID: LIB3062-015-Q1-K1-E4
gccggccgacgagcgtagcgctccgtggtccgtgcggcgctcgaggacgtacggtacgagatcgacgacgcgggtgggtccgactcggtcgtcatggggctgacggagagcttgttcgggtgcttcggggccgccgccgccggcgggcaggagcccgcggcggcggtgccggcgagcaggcgccccggcggcgttgggaagcggacgctgcggcggctgagcacggccaacctgcggtcgctgtcgctgcaggacctgtcgcggaagctggagacgacgaagctgcacaccttcacgctggacgagctcaaggccgncacgaagaacttcttcaccaccaacttcctcggcgagggcg

SEQ ID NO: 42510 - DNA, 256 bp, Zea mays
  Clone ID: LIB3062-015-Q1-K1-E5
ggaggatttcacaaaaagccgaaaaggtatggtggcgggaaagctgctactgctgcgggtaacagcctcaaccgagagttcagattaaaaattaaagagcacatgcagcattgtgtggatcaccctgaagaggttagcaagctggccaaagtgaaggcacaggtttctgaagtcaagggtgttatgatggaaaacattgaaaaggtcctagatcgtggagagaagattgagctgcttgttgacaagactgagaatc

SEQ ID NO: 42511 - DNA, 246 bp, Zea mays
  Clone ID: LIB3062-015-Q1-K1-D1
catgaaggcccagcatcctcggctccgtttcctcttctctcccgatccgcggttcctgttcgcttcgcttccttgcctgatctttgcttcccagacggccagatcaggcgaaaggcgtgacgggggccaccgctgcggcgccgcccctcgaccctccgctgctccgcctgcgctggagaccatccatctggaagagatctctgatttacgggatggacggagccaagccagtggcggccgtgaagc

SEQ ID NO: 42512 - DNA, 264 bp, Zea mays
  Clone ID: LIB3062-015-Q1-K1-E6
gagccgtacaagggtattgttgactgcttcaaacgtaccattaaggatgaaggggtggcttccttgtggaggggtgacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttagtttttgtgtactccctggactacgcg

SEQ ID NO: 42513 - DNA, 271 bp, Zea mays
  Clone ID: LIB3062-015-Q1-K1-B1
gagcgagcagagcactgaagcacagcgtagcgagctgtccggccaaaccctcacagcggccggcacaatgccgagccaggtcgcgctgctcctgcccctgctactgctggcctcgccggcggccacgcgcctggcgtccgccgcctgcgcgtgcgagaagatcccggcggggcgtgcgtacgcgtcgtgcgaggacctgccgaagctgggcgcgtcgctgcactggacgtaccacgcgtccaaaagctccctgtcggcggcgttcgtggcg

SEQ ID NO: 42514 - DNA, 385 bp, Zea mays
  Clone ID: LIB3062-015-Q1-K1-B10
ccttcaaggatgagaagctttccttttatcaaggttttgatcctgctaatgccaacagtgcaaacatgctgctttggccaggcccaaagggtgcagtcaatcaaagagatgctgatcttctcttcatgtggaagaggtacgagcagttaaatggggggaccgaagagaagctgagggctctcatagagattaaagaaactgttcagcacaggaagcatcttgacagcagtatcgatttcgttgggaggctcgtcttcggatttgagaaagggccttcgatgcttgaggctgttagaacctctggtcaaccattagtcgatgactgggactgtttgaagaggatggtgcggattttcgagtcccagtgtggttcacttactcagta

SEQ ID NO: 42515 - DNA, 301 bp, Zea mays
  unsure at all n locations
  Clone ID: LIB3062-015-Q1-K1-B11
gcgcgcctgtccactttccccgtgcttctccgccgtcgaggccgcgtcccagtgcgaagagagtccgggtcaaatggccaggcgctgggtccggcccgaggtgtacccgctgttcgcggcgacgggcgttgccgtcggcatctgcgggtttcagctcttccggaacatcactggcaacccggaagtcagggtaaacaaagcaaggagggcagctggtgtgcttgagaaccatgangaggggagacgttacgccatgcatggcctaagaagctttgtgcacgacaagacttctgagatcatg

SEQ ID NO: 42516 - DNA, 333 bp, Zea mays
  Clone ID: LIB3062-015-Q1-K1-B12
acggctagtgacagatgctctagatccgctcatcctggcgggctagtgaggtcgtaagcggggatcgaatcaaaagatgctggacaagctgtgggacgacgtggtggccagtcctcaaccggagacgggcctcgagaagctccgcaaggccaccaccgcccgtccgctcgttatcaacatagacgcgaacggcggcagctacaagctggcgcagtcgatgccatcgaccccgacgactccgatgacgccttcatcgtcgtattcatcgacgacgccgcgcggcgcccgcaacatgtggcgcatagtcttgcacacggggatcaacctggccac

SEQ ID NO: 42517 - DNA, 204 bp, Zea mays
  Clone ID: LIB3062-015-Q1-K1-B2
tcccgactcgacgcacgcaatccattctagatcgctagcttcctccctttttttttttttttatcggttaaacacccattggttgatcaaataccaggtaggtacacttcactacacaaaacaacaaacataaaactgtttaccgtaatatgcaccacctaatgaacaatacctaataactaccactattataattcacttcat

SEQ ID NO: 42518 - DNA, 205 bp, Zea mays
  Clone ID: LIB3062-015-Q1-K1-B3
ctcctcctcattccccagcggcgcatcctcccccttcctacctcccaacgaaatgccgaacggtatcgacggcaatccagatcctaccatggctcaagacattctccaacggcactccatcaaagaaacacccgttgctcccaccgctgctgatccacggcggctcaatcagcgctccggtaacccctcctctaagctcgccgtc

SEQ ID NO: 42519 - DNA, 237 bp, Zea mays
  Clone ID: LIB3062-015-Q1-K1-B4
attcccgaccgacgcacgcattcatagatgtggctgcagctgttgcatgctttactcaaagtgtgcatggatcaaatagaagaagtgtttaaccatacattggtagcgctgcatatatacttgttaatttatggaatatcaattaagtcttcaacatgattgattgcatttgacattattttccaatttctttactaactgttttaaatttctcataactactcaccaaatgatttt

SEQ ID NO: 42520 - DNA, 188 bp, Zea mays
  unsure at all n locations
  Clone ID: LIB3062-015-Q1-K1-B6
ggcggaggaagcgtctgcgcctgcggcttggacggaagcgccgccncgcgagagggcgatgctcgcaggggtcgaggagagcgagcacagcttctacgcgctgcagtgggcgctgcagcacttcttcccgccgggccagccgcagcagtaccgcctcgtcgtcgtcaccgccaagcccaccgccggct

SEQ ID NO: 42521 - DNA, 284 bp, Zea mays
  Clone ID: LIB3062-015-Q1-K1-B7
gattcccggctgtgtccgcgtctcgcctcctcacgccattaaaccccaccgcgcgcgcggcggccggcggcgagcgctcgcccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgag

SEQ ID NO: 42522 - DNA, 423 bp, Zea mays
  Clone ID: LIB3062-015-Q1-K1-C10
agggcagggaacacagccactcgccttcgagaccccggcgcgcgcgagagaaagaggggagaggaggatcttttgttggtgaaaaatattggaggcggagggaaggtgaaggagggggatcggagatgaacgtgttccggctggcgggggacatgacccacctcctcagcgtggtagtgctgctcctcaagatccataccatcaagtcctgcgcaggcatatctctgaagacacaggagctgtatgcacttgtttttgcagcacggtacctggacctgtttgttcattttgtgtctctgtataacactgtcatgaagctggtcttcttggcaagttctttctcgatagtttggtacatgaagcggcataagattgtgcggaggacatatgacaaggatcatgacacctttcgccattacgttt

SEQ ID NO: 42523 - DNA, 412 bp, Zea mays
  Clone ID: LIB3062-015-Q1-K1-C11
ggcagctaacgacctgcagccaaccatctaccagcgactcagcgagcgagagcagcagacactgggcgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatct

SEQ ID NO: 42524 - DNA, 412 bp, Zea mays
  unsure at all n locations
  Clone ID: LIB3062-015-Q1-K1-C12
gccgagctccgaaggccgcagcatcaggcgcggcccccctcgcgtgtgaccgagatggcgctgccgaatgangggaccgttgattacccgagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatatggacctgtgcagggtctgtgaaaacattccca

SEQ ID NO: 42525 - DNA, 267 bp, Zea mays
  Clone ID: LIB3062-015-Q1-K1-C2
cccacgcgtccgcgagaagaagagatgttacatatataataactactgtgtaggcaggtgcgtctcctgctgggacgaggattcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgatttcggcaactttcagaccaacgccatctcca

SEQ ID NO: 42526 - DNA, 335 bp, Zea mays
  Clone ID: LIB3062-015-Q1-K1-C3
acgccgacccgcagccgccgccgttcgccatgggtttcctcgacgcgctctaccgtggggtgatgcgccgcaacgccggctgcgttaccttcgtcgtcgccggcgctttcgcgggcgagcgggcggtggactacggcgttcacaagatctgggagatgaacaacctcggggtacgaagacatatcggttttggggcaaaggccagctgaggaatgataaattttggtcaccagtttgcttcggtttgaccgtttcattttggcacagtaataaacgatgtaaacttacgctggtcctatgacctccttctcattcggttactcttgaaatgcttt

SEQ ID NO: 42527 - DNA, 370 bp, Zea mays
  Clone ID: LIB3062-015-Q1-K1-C4
tcggtttgagatcctgtgcctttctgggtcatacttggtggtagatgaaggtggcggcgcgcgggcccgaagtggagggcgttgcatagctttgtgtggtcctgacaacagggttattggtgggagtgtaggtggagtcctgatggcagctggagcggttcaggtgatagtggggagcttcatgtacggaggaggttcaaagaagaacaaggtgaaagccgagttggacgcggagcctgaggaggcgaacgccggcgaccaagaggtggcacttgcggagcacagcagcatggcccctcatcctgccatgagtggtggtggcggctgggcatctggcatgatgaggcagatggagtcgagaactcccaac

SEQ ID NO: 42528 - DNA, 359 bp, Zea mays
  Clone ID: LIB3062-015-Q1-K1-C6
cgaaagccaagtgtgtgtactagcaaccagctagctcgggcggtagcaggcagccatcatgtcggaggaggagcgccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgtcggcgccttcgcacttctacgagaagcacgaggcaaaaaaggaccccaagcacgcgcacaggcccaggatcacggaggaggtcgttgccgcggcggccgtcggccccggc

SEQ ID NO: 42529 - DNA, 355 bp, Zea mays
  Clone ID: LIB3062-015-Q1-K1-C7
caggaaaatgccaattttgttcctgttcgtggtgattggcgtgaccgttgcttgggtgtgttgacctgcgtagcacttaagattgtgtatctaaagttgtagggattcatgttcatgcgattatgcttggatatacggagtgacatcgtggagcataaagatgacttgtacattcgtcttgttcatcgagagtcatgtgacttttatcaaaagaaacaaatacattgtgatatcaatcacgatatatgttttttaaaaaaaaaaaaaaaaaaaaaaaaaattaaaaaaaaaaaaataaaaaaaataaaaaaaaaaaatatataaaaataaatttaaaaaaatataataataattt

SEQ ID NO: 42530 - DNA, 364 bp, Zea mays
  unsure at all n locations
  Clone ID: LIB3062-015-Q1-K1-C8
gcggggttcgtcctccagtggcgcctcgcgctcgtgctcctcgccgtgttcccgctggtcgtgggcgccaccgtgctgcagaagatgttcatgaagggcttctcgggggacctggaggccgcgcacgccagggcgacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtnctacgcgctggggctgtggtacgcggcgtggctggtgaagcacggcgtgtccg

SEQ ID NO: 42531 - DNA, 400 bp, Zea mays
  Clone ID: LIB3062-015-Q1-K1-C9
ctagttctagatcgcgagcgagctgcccttttattttttttttgctagaaccattactggggaaaggttcaatagttacaggcacaagtttcacttgacagataagaaccatacaaaatacaggatgatcgcgataatttcttaaatctagcacttcaaagctaccaacgttccattgttgttcgtggcaaatatgacctacaagtggtttttctgttggtctctttgtggtttattcttttctcaagggatcaagttctgaaagcaatgttgaaaaccacaaaatatgtccaaacctacaagttcataccactgatttatcaaattgattctagactttgcagctccatagatgctcaggcttcatttaactttcagattgcgttaacttctctttttg

SEQ ID NO: 42532 - DNA, 403 bp, Zea mays
  Clone ID: LIB3062-015-Q1-K1-A9
cttgcccacccggcgaccagaaactccctaaccggctgctgatggagtcttgacaagtgattcttgtggatcggccagctacggcggcggtggccacgaaacgatggaattaggtgcttctgtttccatgtctatcctggaaaagctcgtccagagctgttcctttccagattcatggcgggggccgccagacgctgaggtccaggctctcataggatatctcgaagagctacggtcctccgtcctggatctttccaaggaggatgaggacgaggatgactctgctacgtcgtcgtccacgctgaagatgagcctgacgagccagttgcaggaactttgttatgatgctgaggactatctggagatggcgcagcactcccgtggtggctgctcctggcagatc

SEQ ID NO: 42533 - DNA, 422 bp, Zea mays
  Clone ID: LIB3062-014-Q1-K1-H11
aataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccac

SEQ ID NO: 42534 - DNA, 423 bp, Zea mays
  Clone ID: LIB3062-014-Q1-K1-H12
gtcaaatgtggttattaacctcataggacgagagtatgaaacaaggaactacagcttggaagaagtaaaccaccatatgcctgaacagcttgcaacaattgctaaggagcatgggggtatcataagatttattcaagtttcttgcctaagggcgtcaccgtcttctgaatctagaatgttgaggacaaaagctgcaggagagcaatcagtcttcaaagaattccctgaggctacaatcatgaggcctgctaccatgattggcacagaagatcgaattctgaacagatgggcacaatttgcaaagaattggggtttcctcccgcttgttggtggtggatctactaagattcagcctgtgtatgtaatcgatgttgctgctgctattgtgaactccctcaaggatgacggcactagcatgggaaa

SEQ ID NO: 42535 - DNA, 471 bp, Zea mays
  Clone ID: LIB3062-014-Q1-K1-H2
gccggcatggctcgaccgacgcgtccggggctgagctgcatccacatccacaactaccccaccgctgccgctctcttcttgcacgcctgggcagccgcccaccgccggaccaccagcacgtacccgcccttccttcacccgccggcgttggcggtctccccgacctcgccgcctcctgcaccgcctctgctcgccgagaaagccagcgccgtctaccccaccagcacagatgccgccgccgccatgtcttccgccacgttccacttcccggccgccgcggtgcgcgcgctgctctcctccctggagccgggcaccaccccgttcgcggcgctcgccgcgctcttctggctccggatcaccggcgccgccgacggggagcgagagctcacactggcgctggacttccgcaagcggatgtacgcgccgctgccgtgggggtactacggcagctccgtccacttcacgcgcgcg

SEQ ID NO: 42536 - DNA, 430 bp, Zea mays
  Clone ID: LIB3062-014-Q1-K1-H4
gcttctctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatg

SEQ ID NO: 42537 - DNA, 322 bp, Zea mays
  Clone ID: LIB3062-014-Q1-K1-H5
ggaggctgaagttagcatcggggcaaccaggtccactcgtcaggtctgcctagggtacgtcgacgacgacgaggacggggaagaggtgcctcagaactaccggtcgttcggggcggtgggaaatgtatttagaccaaggatcgggaggcggaaccgtcgccagcctcctggagtgcacgtcctgcaccctcagacaggacccggcggctgaatgaagatggagatgggtgagttcaggaccaaggaaccttgaaatggcaaggtttccgtaagcttaatgaaaacaagggccggaacttggagaaaaggtctaacgggccag

SEQ ID NO: 42538 - DNA, 446 bp, Zea mays
  Clone ID: LIB3062-014-Q1-K1-H6
ggaccggaaggcatggcacagaggcgtcgtccaagctcgcagggttaccggatcggaggagcatacgcgcctaggtcaccacagccgggggtcgcggatcgctaggcaagcttgcgtcgcgcgccctctccgtcggcgggagatggcagcaccagcagcttcgccggctcaacatccacgaataccagggtgcggagttgatggggaagtacggtatcaacgtacccaggggtgcggcggcggggtccgtacaggaggtcaatgacgccttgaagaacatgttccccagtgagaaagagatagttgttaaaagtcaaatccttgctggtggccgagggctgggaactttcaaaagtgggctgcaaggaggtgtccatattgttaaggctgaggaagctgaaagcattgcacgtaaaatgttaggccagattctggtaacgaaacaa

SEQ ID NO: 42539 - DNA, 413 bp, Zea mays
  Clone ID: LIB3062-014-Q1-K1-H7
ggaatacggaaagcgaaagatgatggatctcgccgacccccagcagcagcagcggctgatcgccggcgcggcgctgctgctggcaaccgcggccttcctcaggctcctcctgggctcccgctcccggggcggcaagcgcctgccgcccaccatcccgggggcgccggtgatcggcggcctcgtcaagttcatgcgcgggcccatccccatgatccgggagcagtacgcccgcctcggcagcgtcttcaccgtccccatcatcacccgcaggatcacgttcctcgtcggccctgaggtgtccgcgcacttcttcaagggcaacgaggccgagatgagccagcaggaggtgtacaggttcaacgtgcccacgttcggccccggggtcgtcttcgacgtcgactactccgtcaggc

SEQ ID NO: 42540 - DNA, 399 bp, Zea mays
  Clone ID: LIB3062-014-Q1-K1-H9
cgatgcgtggcgtcgatttcaagtggtatgatgggttcttcctctccatgctcgccactagcgtaattatcgttgccattaattggaagaggtatcgcctgtgtgcccacccgctccacatttggatagtggtggactacaccactgtcttcatcttgcgcctcctaatgtttgttgataatggtctcgctgcaggaatgggattagatctcggatggcaacagagatatgctcgttcttgtggaagaataattgtcctctcagttcttgcgctacttctctacccacttctctgggtttggactgtgattggtacattgtggtttagcactgcatgaggctgctagccagacgaaggacaaacgtggggcttcttgatatggctgcttttcaagtact

SEQ ID NO: 42541 - DNA, 351 bp, Zea mays
  Clone ID: LIB3062-015-Q1-K1-A1
gtcttcttcctctgctgtggatataaagaaggcctaccgcaaagcagcactaagacagcatggagacaaagccagtgggtttcttgtcagaagtgaaaatatcaatgatgctgtatggagagatataacaaatgaaatactcagggatgctgattatttattcaaaataattgggaaggcatatgctatgctttcagaccctacaacgagaagggaatgataacctggaggtggagtgatagaaaagcagtgcacatgtaacatgagcagcgggagcaatgaaaatgatgacaggacctcttagtgagagcatttaatcatgaagttggtaccgcacaaagcttccatact

SEQ ID NO: 42542 - DNA, 428 bp, Zea mays
  Clone ID: LIB3062-015-Q1-K1-A10
gccgcgccagcgccagcaactgaagtttcgtcctcgcggccttctctccctccactcgagaccgcgccgacgagcgacgacaaccgttgctgcattcttcaatggcgactgtgccagttaacccaaaacctttcctgaacaacctgacggggaagcctgtaattgtcaaactcaagtggggtatggagtacaaaggttatcttgcttcggtggactcctatatgaatctccagcttgccaacactgaggagtacattgatgggcaattctctggaaacctgggagagattctgatcaggtgcaacaacgttatgtatctgcgaggtgttccagaggatgcagagatagaggatgcagagtgagaagatgtgaatgtaatttgattctgacatgtatgtttgaatatgccggtgacaactagacctatc

SEQ ID NO: 42543 - DNA, 137 bp, Zea mays
  Clone ID: LIB3062-015-Q1-K1-A2
gcaggaataaacggtgtccctggatccagaactcacgggtcgatccatccagtttatgtcaggcttgtatatctctatgtatgcattgcctgttcgttcgctggaatctactacttgcagcggcctcgtctcttcag

SEQ ID NO: 42544 - DNA, 264 bp, Zea mays
  unsure at all n locations
  Clone ID: LIB3062-015-Q1-K1-A3
gtgccatcctctcctgggcagcgagcagtggtggccgcgggttcccccgcctcgtcggccgggatccggcgacgaagagtaattgaataacttcgataagatgggtcgtggtattagcagtgggggtggtcagagttccttgggctatctctttggcagtgacgaagctccaaaatcatttgagaagcctgcaccagttcaaaagccaactcctncatcctctgcagagagactaaaagatatcgctgctggtattcaaagtag

SEQ ID NO: 42545 - DNA, 316 bp, Zea mays
  Clone ID: LIB3062-015-Q1-K1-A4
gtcgtttaaaaacaaccagagaaacacatggccaacatccccaagtgtcgttggaccggaagccccttaatcctgctatgttacgctgctgtagtgctggcagtactttctactctgacactgccactgcttgcttcatcagatctagatgctgtaaatttcaagaaattctgccttgttttgaagaaccaatacctatgtctaggtcaaaatgccgaaccacgcgcgaggaacgctatggcgctcctgcttaacagtgagggtatatctgggccactttccacggccttgggcgccttcttcaacttgagttacc

SEQ ID NO: 42546 - DNA, 393 bp, Zea mays
  Clone ID: LIB3062-015-Q1-K1-A5
cggaattcccgggggcgagccacgcagtccgatgtgagaaatgtgaagtatgaagcagcgaaatattcttcgtgaccttagacgaagtacctggcctggtcacattgcataccgtggtgactaacacatcgtacaagttgatcattaaatctgtattggggagcaaaacaaagtgctcaagaatcgtattgctcggtgcacaacttctttagtcctgcgcatgtgatgccacttctggaaatagttcgtactcagcacacttcaccacaagttgttgctgacttgctggatgttgggaagaagattaaaaagacaccaatagtcgtctgcaactgtactggctttgcagttaataagatgttctttccatacactcaatcaacacttttttat

SEQ ID NO: 42547 - DNA, 282 bp, Zea mays
  Clone ID: LIB3062-015-Q1-K1-A6
ctaccacggagatctgaatgccttgaggtacgacattgtggagctgaagccgactctgctggttggggtgccccgagtgtacgaaaggatttatgaaggtatcttgaaggccattgcggaactcagacctctaagaagggtcatctttaatgctttgtacaaccgcaaactggcaagcatgaaagcaggctactcgcacaaaaccgcttcacctttcgcggacatgctggcttttcgcaaggtcaaagcaaggcttggaggtcgtcttcgcttactgatttc

SEQ ID NO: 42548 - DNA, 351 bp, Zea mays
  Clone ID: LIB3062-014-Q1-K1-H10
cacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaggaggaggaggaggaggaaggctgtgctggtaataaggcggcgccggccaagaagcgaccgcggggcagcgaggggaagcacccgacgttccgcggcgtgcggatgcgggcgtggggcaagtgggtgtcggagatccgcgagccgcgcaagaagtcgcgcatatggctcggcacgttccccaccgccgagatggccgcgcgcgcccacgacgtcgc

SEQ ID NO: 42549 - DNA, 289 bp, Zea mays
  Clone ID: LIB3062-015-Q1-K1-A7
cggacgcgtgggcgacgcgggctctcccgtctcctctgatggacgggaaccaagccgggccgccccctacccccgcgccgccgcccttctcctcccggccccgcgcgtcgccgtccccggcgacgcaccgccggcgccgccggcactccaaaaaacataagccccggcccgcgccggcgccgacgccgcagggcgcggacttctccgcgctcccgccggatctcgtccaccgggcccctgcgggcgcgtgcgcctccgaccgtccggcggccagccgagcgtgccgcgc

SEQ ID NO: 42550 - DNA, 62 bp, Zea mays
  unsure at all n locations
  Clone ID: LIB3062-015-Q1-K1-A8
ancggcggggcctccatgcgcagcaagcgtacgtcttctgctcaagccaccgcgtcctgccc

SEQ ID NO: 42551 - DNA, 435 bp, Zea mays
  unsure at all n locations
  Clone ID: LIB3062-014-Q1-K1-F5
cactcccaagccagtaccgagtcctacgagcagtcgcacgcaagtgtcaagagacgaggcggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgncagcatcccctccaagtgcggcgtcagcatcccctacaccatcagcacctncaccgactgctccagggtgaactaaaa

SEQ ID NO: 42552 - DNA, 400 bp, Zea mays
  Clone ID: LIB3062-014-Q1-K1-F6
gtccagaacattccgtgctacagagactcggattattggaccgttggtgaagcttcttgatgagagggaagcagatgtgtctcgagaggcagcaatttccctgaccaagtttgcgtgcacagataattacctgcacgttgaccattccaaagcgatcatcagtgcaggtggagcgaagcacctagttcagcttgtgtatttcagcgagcaggtggttcagattgcatcactcacccttgtatgctacattgcacacaatgtcccagacagcgaggagctggcacaagcagaaatcctcacggtgctcgaatgggcttccaagcaagcttacatggtgcaagacccagtaatagacaacttgttgccagaagcaaagatcagattggaactgtatcaatct

SEQ ID NO: 42553 - DNA, 438 bp, Zea mays
  Clone ID: LIB3062-014-Q1-K1-F7
gcgctttcctgtccgactcccagccgtcgtctgctgcggactccgcctccagtttggggtgtttcttgcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctg

SEQ ID NO: 42554 - DNA, 241 bp, Zea mays
  Clone ID: LIB3062-014-Q1-K1-F8
aagctgatgctcttcacaatcatcaagccgttccacaacatgcgcagccctaatggtactgcgaggccattgttggcgcagctctcgcagcactcaccggcacaggtgctcaagaacttcacgcacgtcaagaaccttcggatcgagctcccctttggggatttgggtaccggagaaggaagtcttctggaatggccaaccaaatattggaacccaccttggaaatggggggaccctgggg

SEQ ID NO: 42555 - DNA, 333 bp, Zea mays
  Clone ID: LIB3062-014-Q1-K1-F9
acgaacaaattgtcagaaggaagtgatgtttctcagcgagatcgaatagatcttggaggctgccatccatgcataattccaaaaatgcatggcaccattgttacggctaattgctcatcgaatcaccagcgctcactttcaggttgctgaaagagcgctcttcatgtggaacagtgatcacactagacaacttgatagcacacaaccgccatatgatcatgacacttgttgtttcagagctagagcagaacattcagaatcactggaaccaaaccgacctgaatctggctgttgatgtcaggtatatgatctctgagatggatggtgaccatt

SEQ ID NO: 42556 - DNA, 285 bp, Zea mays
  Clone ID: LIB3062-014-Q1-K1-G1
atccgcagcgcccggaatggcggcacctcttccacgtcctcccgttcctgtcccgcggcggcttgtgtgccgccttctccgcccgcgcccactctggctaccgggctagtctgctgcgctgctcggccgacgtcgatcatgcgagcttgttcactcgcctaggccggatcataaatgacaaggaccatacctacgtgcagaacatcatttgccacttgtacgcgaatggccagaactgatgtgacttcacaacactcgttacttactggaaccttgccgctcacg

SEQ ID NO: 42557 - DNA, 380 bp, Zea mays
  Clone ID: LIB3062-014-Q1-K1-G10
ctacaacttactgcttgctctagctagctagctgctcccggcccatatccactgacacgggtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctcctccatcgccaccgccgccgtcgcccaccagcacgccgtgccctccgccgtcgtccagctccggcggcaagtgccccaagaacgcgctgaaactgggcgtgtgcgccaacgtgctgggcctcgtcaaggtgtccatcggcaaggtgcccaccgactcgtgctgcccactgctggacgggctc

SEQ ID NO: 42558 - DNA, 404 bp, Zea mays
  Clone ID: LIB3062-014-Q1-K1-G12
gacatcaacctctgaagtttatggtgatccacttgagcatcctcaaactgaggcctagtggggcaatgttaacccgattggtgttaggagttgttatgatgagggtaagcgtgtagcagagacgctgatgttcgactatcacaggcagcatggcattgaaatccggattgccaggattttcaacacctatgggcctaggatgaacattgatgatggccgtgttgttagcaacttcattgctcaggctgtgcgcggtgagcccctgactgtccagaggccaggaacacagactaggagtttctgctatgttgccgatatggttgatggtcttattaagctgatgaatggaaacaagactggaccgattaacttggggaacccaagtgaattcaccatgctggaac

SEQ ID NO: 42559 - DNA, 372 bp, Zea mays
  unsure at all n locations
  Clone ID: LIB3062-014-Q1-K1-G2
atctgaaagaaacccgccaccagctctcgtccttccttctctccaatccaaccgcagtcctttcagcttcagcttcttctgctccttctctggtgaggaggcgtggtgagagactgcgactgcgcgatggaggcgtcgtcgtcggcgttggcgctcgtggccgccgtgctcctcctctcctccccgctcgctgcgtcagatttctgcgtgtgccgttcggaccagccgacggcggtgctgcagaaggcgatcgacttcgcgtgcggcccgcagggcggcgccgactgcacgcccatcctgcatggcggcgggtgctacagcccggacaccgncgncgcgcactgcttctgtgctcgncaacacctactacca

SEQ ID NO: 42560 - DNA, 430 bp, Zea mays
  Clone ID: LIB3062-014-Q1-K1-G3
atctgtttccccgagctctcgaaaccctaggtgcgtgccgaccggcggcggcggcgaggtgatggcgatggacccggacgcggtggcgaaagccttcatggagcactactaccggacgttcgacaccaaccgcgcggcgctggtggggctgtatcaggagacctccatgctcaccttcgagggccagaagttccagggcccatccgccattgccggcaagctcagatctcttcccttccaggcctgcgagcaccagatcgttaccgtcgactgccagccgtcggggccccagggaggcatgctcgtcttcgtctccggatccatgcgcaccggccccgaggagcaccccatcaagttctctcaggcattccatttgatgccggcagctgggtccttcttcgagcagaatgacatgttccgcctgaactat

SEQ ID NO: 42561 - DNA, 286 bp, Zea mays
  Clone ID: LIB3062-014-Q1-K1-G4
ggatcaagcatcaactcttcagtttcccagctatgctttggagggttcagtttttcagaggtttgacactgacctcatcaagaaagtcagcaccaactgtcttggcatgcaaaatcacaaattttggatatcaaccaagccatatcgagagaacgatgcactatcaagtttcttcaaaatcttgactacatcacctgatgaaaacggcaaggtctatttctcaactgtacaagccaataattattcaatcacttgcacgcaatggcattctgagaaagccattttt

SEQ ID NO: 42562 - DNA, 432 bp, Zea mays
  unsure at all n locations
  Clone ID: LIB3062-014-Q1-K1-G5
cactgacgccaacaccgactaccccaacgccgtacgaccccaacacgccgnccttcacgggcccatgcacctactggatgatgcacccgggcgtgatctggggcctattcggtttctggtgcccgctggtgcggctgttcggcccgagcgcggcggtgccgttcgggcacgacctcaccgtaccggaggcgctggcgaacacgcgcgaggacggcatgggcgcgctctaccgcgagggcacggcgtcgttgctcaactccatggtgaacaacaggttccccttcacgacgcaggaggtgaaggacgcattcggtgctgcgctcaactctggtgacgacggcgccgccgcggcacaggcgcgtctgttcaagaaagcaaatgangggcacgtcatcaggcagaactagctaggcggcagtcgccgtgtgtatg

SEQ ID NO: 42563 - DNA, 110 bp, Zea mays
  Clone ID: LIB3062-014-Q1-K1-G6
gtcttgttagtactgaaaaccagagtcactcctacctttttgcaatcagtagctactggaaggtggcagattccactatttgcttgcatctatctaaattatatggcgtt

SEQ ID NO: 42564 - DNA, 360 bp, Zea mays
  Clone ID: LIB3062-014-Q1-K1-G7
gcagcagcacacccggtcaaccttccacacacgcgcgcacacacacatggcgtcgcaggagaggcaacagcaggcgggagcggcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccgccgcaacgcgccgctgctgggcctgggcggcatgtcggacgccgacctccgcgggatgctcgccgagggcgacttcgacggcgacggcgcgctcagcgagacggagttctgcgtcctcatggtgcg

SEQ ID NO: 42565 - DNA, 263 bp, Zea mays
  Clone ID: LIB3062-014-Q1-K1-G8
tcgcaccatttgatcatggcacaacaacgactccatcttacggcactgcaccgagtacacgtgctggtggtttccctgaaattcccaagcatggatttgttggatcctgcgactactggaagagccacccagacatgatcattgcagttgttgggtccctcggcaacattggcaagacctttggtgctgcctgcagtctgctcgttggcaagaagcttgagaatctgcatgaagcactctcgaacaccagaactgatggcggt

SEQ ID NO: 42566 - DNA, 436 bp, Zea mays
  unsure at all n locations
  Clone ID: LIB3062-014-Q1-K1-F4
gaacaggcacagtttctatctgatggatcgtctggtcctggaatgtggattgttcctgtaacagcatgctgtggctcatatgatgcacagaaaaagttcttattgaaagataaaatggataagataaatattaaagagttttctgactctcaaagtgctgatggggagaagaatcaaatcatttggatcaaattgaatattgatcaaactggattttatagagtgaagtatgatgatgaacttgcagctggacttgtaaatgcaatcaaagcaaagaagctctcattaatggataagattggtatcgtggaagattcatatgcgctatctgttgcttgcaagcaaacactaacgtcattgttgcgactgctgaatgcttataatgatgagtctgattacactgtactntcacatgtaacctctgtatgtttaagca

SEQ ID NO: 42567 - DNA, 423 bp, Zea mays
  Clone ID: LIB3062-014-Q1-K1-G9
gctggtgctgtgttggtacaggcatgcagtgctgatgaagatggcatgcttggtggtggtgttcaaagtgatggcaatggacaaaagcacctaagtgccatagcggctaatgacgagtctatcttgtccaataccaatggtgttccaggatttccgccaaagaaggcaacctactcatgcattcaaatgaacggaaaggaagtttttcgctttgctgtccgatgcgtgccacagtccattgagaaggcactccaagaagctggtttgcctgcctacagtatcgactggttgctgttacatcaagctaatcagcgtattattgatgctgctgccagcagattagatatcccatccgacaaggttatttcaaatcttgctaattacggcaataccagtgcggcatccataccattagcattggat

SEQ ID NO: 42568 - DNA, 417 bp, Zea mays
  Clone ID: LIB3062-014-Q1-K1-E2
tccccaaattcgtgtcccgcacatctgctcgtttcttttcgaacctgatggcgctcgtcgacgggggtgccttcggcgcgtccacctccaccgtggccgctgcgcccacggtggagcacctgttgttcctcgtcgtcctcgacggcgtctagacgcccatccacgaggggacgctgtacggaagcgccggtggcacagtcaccgtcaccggccctggccagctctccgtcgacggtctctagagcgtcctggtgcgcggcggctggaccgggaccggcgccgtgcggttcacgctctgcgccgacgcggctgccgaaggcgtctgcgcggcgtgcttcgagcggtgcggcgcggcccgcgtggatggcgcgcgcgaggtgtccgtgtactcgtgccgctccgttgaagtggaactct

SEQ ID NO: 42569 - DNA, 423 bp, Zea mays
  Clone ID: LIB3062-014-Q1-K1-E3
catttggacgggagttacattcaatgaaaaaattcatggacaagtcgtgcagtgttatggactcatctatggctaacaagtaggcacatggcacatcagttccgaccaatacggctattgttgtatccatctgcttgctgaagttacaagacccgaaaaataggaaattggaagaagggccatggagggaagccgcagtgttttgcatatattgcccaccttcacctgagagaagatatcgggcgcgcaataatgattagtgagcagtcctgtatggagcctgggtgcagcctctgccagtattaagtgatctacgtgttatacattttttatgttcatgaaacattgatccattgataaaatatatcgtcaggtggcaaggggtcgatttgggggaaaatatcttacgcaatttatttattt

SEQ ID NO: 42570 - DNA, 411 bp, Zea mays
  Clone ID: LIB3062-014-Q1-K1-E4
ctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgc

SEQ ID NO: 42571 - DNA, 438 bp, Zea mays
  unsure at all n locations
  Clone ID: LIB3062-014-Q1-K1-E5
gtttgagttgccatgatacatgtagatcaatcccagttcccctgctgcagcttgtaggatggacgccactggtagagctgaagagaatagcccagaaggacaacgtcgacgcccgagtcgtcggcaagctggagtgctaccagcccctctgctccgtcaaggaccgcagcgctctgagaatgatcgaggacgcagaggagagagggctgatctcgcctggcgccacgacgctggtcgagccgacgagcggcaacatgggcatagccctggcgtacatcgctctggcccgaggctacaggttcgtcgcggtcatgcccgccgagtactcgctcgacaagcagatcctgctgcggtacctgggggccgatttggtgttaaccgatcctgcgcttggcttccagggacagctcgacaagctggaacagctcangaaagaaa

SEQ ID NO: 42572 - DNA, 414 bp, Zea mays
  Clone ID: LIB3062-014-Q1-K1-E6
caaattcctgtcccgcacatctgctcgtcgcccagcgaacctgatggcgctcgtcggggcgaaggccgccggcgcgtccacctcaaccggggccgttgcccccaaggggggacacctggtggttcctcgtcgtcctcgacggcgtcgagacgcccatccacgaggggacgctgtacggaagcgccgggggcacagtcaccgtcaccggccctggccagctctccgccgacggcctcgagagcgtcctggtgcgcggcggcgggaccgggaccggcgccgtgcggttcacgctctgcgccgacgcggctgccgagggcgtcggcgcggcgtgcttcgagcggtgcggcgcggcccgcgtggagggcgcgcgcgaggtgtccgtgtcctcgtgccgcgccgtggaggtggagcgcg

SEQ ID NO: 42573 - DNA, 432 bp, Zea mays
  Clone ID: LIB3062-014-Q1-K1-E7
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggc

SEQ ID NO: 42574 - DNA, 377 bp, Zea mays
  Clone ID: LIB3062-014-Q1-K1-E9
atggagcagttgaattggagcctgccaaaggagaagatgcattgaactcatgccatacattttctggaccgttcggcacgaagcaagcaccctttctacgccagcaaagaaactctttttcgaaacaaggatctcagtcattgaaaaactactgtgctcctaagaatggtatccccaaggaggcaaaggattacttgcagcatgaagaattacctatgttggtgctagatcatgccaagaacaccagtgataaatcaagctcatattcaagttcagctgatgaagttggtctaactggagtcatcaacaactatgcaactgaaggaaatgagaggtcacaacctgatattgaagtagcaacgtcagtatctcgcaac

SEQ ID NO: 42575 - DNA, 421 bp, Zea mays
  unsure at all n locations
  Clone ID: LIB3062-014-Q1-K1-F10
ctgaactcaatcatcctcagcggaggaaagcagagcacggcacagcgagtcgcagagggatagatccgagcacaagcaggccccgatggcgacgacggcgacgaaccggcgggtgatcctcaaggagtacgtggagggatacccacgcgaggagcacatggagctgctccggggcgccgaggttcccctccgcctgacgggcgccgagccggccgggtccgtcctcgtcaggaacctctacctctcctgcgacccctacatgcggcccaagatgtcgcgcccgctgcgggagtcctacacggccgccttcgtcccgggcgacaccatcacgggctacggcgtcgcgcgcgtggtcgactccttcgacccgcgcctcgcgcccggngacctcgtctggggcatcaccggctgggaggactac

SEQ ID NO: 42576 - DNA, 409 bp, Zea mays
  unsure at all n locations
  Clone ID: LIB3062-014-Q1-K1-F11
cgttccccttcttcagttctgccgctgctgctgccgctgccaccctccgtccgcgtccagatcccgccaccccaaccgatctgccggcctccagcatggcggcggcggcgggggcgagggcgagggcgaaggcagcgggagccctggcgctggcgctcgtgctcgcgctagcgggggccaactccgagggcgacgcgctctcggcgctgcgccgcagcctcagggaccccggcggcgtgctgcagagctgggaccccacgctcgtcaacccctgcacctggttccacgtcacctgcgaccgcgacaaccgcgtcacccgnctagatcttggtaatttgaacttatctggtcatctggtgcctgagctgggganattggagcatctgcagtacctggaactntacaagaa

SEQ ID NO: 42577 - DNA, 219 bp, Zea mays
  Clone ID: LIB3062-014-Q1-K1-F12
cggttcggacattcccgacctcgacccacccgtcgcgcgggcccatggaagaacactcttttattgctcatgttgcgcggcttccacgcgtgcgagtaatgtagaagtcgggtgggcaggtattctcataccgtcattagtggatcattgaatttttctgtaagaaggttattgcaatgcaccttctctggccatgaataacacaaaggagacctgctt

SEQ ID NO: 42578 - DNA, 389 bp, Zea mays
  Clone ID: LIB3062-014-Q1-K1-F2
cggagatgagaaggccgtacgatttttgcgacgtacaggcgtcctgcttccgcggacgcacggaaggggaagatactgtcggaatcggcatcttcccctccagtccctggctctaccaccagcagcgaccgttgtcgaaggaggccgtggttggggggaagtgccgaaccggaagacgtaaaggcgtcttccaatcttccaaccccctggggttgccactgtgcctagtctctagttagtcgagaaccttaaaatgggttaaataaacacatgggagtccaagaagattctaggccttccggggccctgggtggcctatacagggtacagtttgtgggccggtcaatatacagtgatgacgaagcagtcaagactagcattatggattc

SEQ ID NO: 42579 - DNA, 418 bp, Zea mays
  Clone ID: LIB3062-014-Q1-K1-F3
agacgaataatctcttcttcacctcactaacaccagctagcaactctttctctgctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccat

SEQ ID NO: 42580 - DNA, 440 bp, Zea mays
  Clone ID: LIB3062-014-Q1-K1-E11
cacacacacagacaagtggtttccaaagccaagtgtgtgtactagcaaccagctagctcgggcggcagcaggcaggcatcatgtcggaggagaagcaccaccacttcttcaaccaccacaagaaggacgaggagcagcccgccggcgagtacgggtactccgagaccgaggtggtcaccgacaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtccgcgccggcggctacgtattccacgagcaccacgagaagaagaaggaccacatggacgccgaggaggcc

SEQ ID NO: 42581 - DNA, 447 bp, Zea mays
  Clone ID: LIB3062-014-Q1-K1-C5
atgctttaaggctctacatgaagcaattcttcagtgaaggaaaagatggtacatattgatgccttcactgcggtgagcggggtttctcgtttctgtgaaaatgaatatccttggagatactccaaggaggaagaaattcccatcgaagaatttgagaaaaggaatttcacctatctactgaatgagcaccgctccatcggtggctaccagtgcctgttcgctgtggatggattctccagagtaaaacttacgccccaaatccccccgctctctctggtgaaagaacccaaggtgtttgcacatgggaatacgagagaccctgacattctttcactgagttggcccggttgtccttgagggcatggggacaccggacacccagattcctgtggcaggaccactaactgccagcagtgaagatgtgtttgagtcagtccgcgtgacaca

SEQ ID NO: 42582 - DNA, 374 bp, Zea mays
  Clone ID: LIB3062-014-Q1-K1-C7
caggcgtcttcgtactcgcctatctcctcgacccaaagcgttcccccttctcccgtcgtctctcatttctgaccaccggcgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgataatactctcaacaccttctttagagagactctcgctctgaaacacgtgccccgtgctgtgtttgttgacctttagcccactgtcatcgatgaggtgaggactggcacctatcgccagctctctcatattct

SEQ ID NO: 42583 - DNA, 427 bp, Zea mays
  Clone ID: LIB3062-014-Q1-K1-C9
cggagcacttcggaggccggacccggcgagaagcgaccgaccgcagccagctcgcgtggccctcttcatccaccatgctgagggtcgcgggcaggcgcctctcgtccgctctcgcctggcgccccgccgacgccgcctcaggctcccggggccctctcgccggtacactacccggccgcgacgacgacgacacacgcgactgcagggcgcgtttcgccatcgaatctcccttcttcgccgctgccagagggttttctgcagagactcttgctccaagaaaccaggatgtgggcttatccgagctcccagcaactgtggcagctgtgaagaatccaagtggaaaaatcgtgtatgatgagtataaccatgagcgctacccgcctggagaccccagcaagcgtgcatttgcctactttgtgctgagtgg

SEQ ID NO: 42584 - DNA, 270 bp, Zea mays
  Clone ID: LIB3062-014-Q1-K1-D1
cccacgcgtccgagcagaccgcacgtcacacaccaccattgcagcaatggcgcgcgccgtcgctctctgcctggcgctgctgtgcctcgtagccgtgcactcggccgtggcgcagaaatccaccccggccccggccaccgcaccggccgccaccaccaccccaccggcgaccccgtccaagaagacgcccgcgccagccgcggcgccgcccaccacccccgccaccctggccccggccgccgcgccgtccaccacccctgccacccccga

SEQ ID NO: 42585 - DNA, 437 bp, Zea mays
  Clone ID: LIB3062-014-Q1-K1-D10
ccttggatgttgattccaaaacctcttcttttgaagaaacaacatcagcaaaggcatcaaggtcaccagggcgctatgcttcagggcattgatgaatcagtgggagcagaattgggggaacatcatgaggacgcacatgaccacgaggagtttgagttcggtgaagtttttgttcaccaactgattcacacgatagaatttgttctgggtgcagtctcaaacaccgcttcataccttcgtctttgggctctgagtcttgcacactctgagttgtccactgtattctacgagaaagtactaatgacggcatatgggtttaacaatgttttcatccttattattggtgtcgtcatcttcatctttgccacgattggtgtcttgcttgttatggagaccctgagtgcattccttcacgcgctgaggcttcactgggtgga

SEQ ID NO: 42586 - DNA, 418 bp, Zea mays
  Clone ID: LIB3062-014-Q1-K1-D11
gccgggtcgacccgcgcgtgctaacgaaagggaaggtggccttttcgaagctcttttacggagtgtagcgctagctagctggccgggctctagaggaggatggtgggacgaggagcggcgacggccctcgtgtggtcggcggtggtggcggtcgcgactgtggtgtcgcgggcgcatcatctgcaggtggggttctacgacacgctgttcccggcggcggagatcatcgtgcaggatgaggtgagcaaggctgtgtccggtaacccttgcgtcgtctgtggcctactgcgcctgcacttacacgactgcttcgtcagggggtgcgactcgtcggtgctgcttgactcgtatgcgggcaaccaggctgagaatgacgcggctcccaacgccagtctgcgcggattcgaggtcatcgaca

SEQ ID NO: 42587 - DNA, 420 bp, Zea mays
  Clone ID: LIB3062-014-Q1-K1-D12
gggctttagcgatggtcctgttcatggctggcgccgcgctgctcgccggggctgccggggccggcgcgcagcagggcgtgtggagcatcatcacccggcccatgttccagagcatgctgagccaccgcggcgacagcgggtgccagggcgccttctacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaag

SEQ ID NO: 42588 - DNA, 166 bp, Zea mays
  Clone ID: LIB3062-014-Q1-K1-D2
cctcacataattaccttctcctaccttactagcaatccttaacccttcaagactccaccaccgatcttttctactactgctccttccacatgctctcattcgacgagctcaccctgcaacttgatacctcccatctacagttcctgatggagatcgccaaccccct

SEQ ID NO: 42589 - DNA, 437 bp, Zea mays
  Clone ID: LIB3062-014-Q1-K1-D3
cttgaggctgtgaaaacactgagagcacagcccaaggctaatgatcaatacttgcccggatgtgtgatagttgatgacagcggcaaagctgttggacctgtattagatggtgatgcagttgtcactatcaacttccgggctgatcgcatggttatgcttgcgaaagcactagagtatgcagattttaacaactttgaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaacggcaaccgctcgggatactttgatgaaactaaggaagagtatgtaga

SEQ ID NO: 42590 - DNA, 439 bp, Zea mays
  Clone ID: LIB3062-014-Q1-K1-D4
ggctagtgattctggtgaaactcagagtcatagtgatttaccttctataaagatgactgctactggagctgattttgagaatgaaagctatcttcggcatactggttatttttctgaggagcagacttcttctgacttcgttgagaagcaagtaactgagtcttcagagagggaatgctcagaaagtgagactgaagaggatgctgaacttctgcaaaatgcaagtgtgattctacctatagaatcacatgctcctgatccgtattctgttccaatatatgagaagttcaagcatgtggattatggtgacaatgaggtggcctattctaattatatgccccagttgaatgaatctgaggaagaggatggttcttctgagctgggtgtctctcagtggcacatgaaaggtaaacgtaacaatcgtaatgccacaaagaga

SEQ ID NO: 42591 - DNA, 434 bp, Zea mays
  Clone ID: LIB3062-014-Q1-K1-D5
agagcaggttctctgtaaatggaaaacccatttaccatttcatggggacatcaagatggagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaagtcctggtcgatcttacaaatggcggcgtggattacagctttgagtgcattggaaat

SEQ ID NO: 42592 - DNA, 431 bp, Zea mays
  Clone ID: LIB3062-014-Q1-K1-D7
ccgcgacatgtgacgcccgccggggtggcgtccatgctgctgggggcgtccatggcggggatgctctgcggctcggtcaccttcatgctcggcttcttcctcatgccctgggttgtcgggctcggtttcctcttcctcttcgtcggcttcatcaccaacctctccgggatctggagggacatcatcctctggccctccgtcgcgtgctccgcatcggactcacccaaggaggcaccctccccatggcatatgttttccaagccttcatccatgtcgacgtgaagccaagtacaaagtaaggctcccacggaggtccacagaagcagggagttgctggagcagcagccattgccaacctatattttccttcctggacaacccttcttttacatgtgacaccgtagcaagttgccaagttttaaatggttttg

SEQ ID NO: 42593 - DNA, 373 bp, Zea mays
  Clone ID: LIB3062-014-Q1-K1-D8
ttatagaccttaccttctataaagaggaagcgtactcagctgatttccgaatgaaagctatcttcggcatactggttatttctctgaggagcagacttcttctgacttcgttgaacaagcaagtaactgagtcttcagagagggaatgctcagaaagtgagactgaagaggatgctgaacttctgcaaaatgcaagtgtgattctacctatagaatcacatgctcctgatccgtattctgttccaatatatgaaaagttcaagcatgtgcattatggtgacaatgaggtggcctattctaattatatgccccagttgaatgaatcttaagcagacgatagttcttctgagctgggtgcctttcagtggcacat

SEQ ID NO: 42594 - DNA, 426 bp, Zea mays
  Clone ID: LIB3062-014-Q1-K1-D9
agcgaaagggaaggtggccttttcgaagccgctttacggagtgtagcgctagctagctccccgggccggagaggaggatggtgggacgaggagcggcgacggccctcgtgtgggcggcggtggtggcggtcgcgacggtggtgtcgcgggcgcagcagctgcaggtggggttctacgacacgctgtgcccggcggcggagatcatcgtgcaggaggaggtgagcaaggcggcgtccggcaaccccggcgtcgccgcgggcctcctgcgcctccacttgcacgactgcttcgtcagggggtgcgacgcgtcggtgctgctggactcgtcggcgggcaaccaggcggagaaggacgcggcgcccaacgccagcctgcgcgggttcgaggtcatcgacagcgccaagacgcggctggagcaggcctgct

SEQ ID NO: 42595 - DNA, 437 bp, Zea mays
  Clone ID: LIB3062-014-Q1-K1-C3
cttccggcgggctctaaagctgtacatgaagcagattcttcagtgattgtatagatggtacatattgatgccttcaggacgattagcaaagtttgtcggttctgtgaaaatgaatatccttggagatactccaaggaggaagaaattcccatcgaagaatttgagaaaaggaatttcacctatctactgaatgagcaccgctccatcggtggctaccagtgcctgttcgctgtggatggattctccagagtaaaacttacgccccaaatccccccgctctctctggtgaaagaacccaaagtgtttgcacatgggaatacgagagaccctgacattctttcactgagttggcccggttgtccttgaaggcatggggacaccggacacccaaattcctgtggcatgaccactaactgccaacagtgaaaatgtgtttg

SEQ ID NO: 42596 - DNA, 419 bp, Zea mays
  Clone ID: LIB3062-014-Q1-K1-B10
ccccgttccagaatatcagccctggtgcaccaaactcgctactacaggttgctgtgaaaaataatcagcagccagtgtggtacttcaatgacaaaattccgctgcatgttttctttggtgaagatggaaaaatggaacgagctggttttcttgaggcctggaaatctttgcctgatgacaatgaatttacaaaggaattcccgggctctgtcatcagcagcatagatgctactgttgagcgcctcgtagcatcaaatgtgttcttcatagccaagcggaaaaatgcgaacatggatgttctgtatctctccgcgaagatgccccgtggaatccccttccttatagaggttacagccgtggttggtgttcctggtgtgaagtgtgcagtcaaaacaccaaatagggagatggttcctctc

SEQ ID NO: 42597 - DNA, 412 bp, Zea mays
  Clone ID: LIB3062-014-Q1-K1-B11
cgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaagtacagaaagaaagatgacgatggacgggacaccttatctgatattgatgttgaaagggaagaggagtgtgggatttgcatggagatgaacagcaaa

SEQ ID NO: 42598 - DNA, 369 bp, Zea mays
  unsure at all n locations
  Clone ID: LIB3062-014-Q1-K1-B12
ctcttcttttaccgatggccaacgattccctcgcccaccacctgctgcttcctgtcggcggcggctgctggtccgacgtggaggaggaggagccgagcaacgtctccttcccctcgttctggccgcccttccccgctctctcgccggaccccgagtccgacgcaaacagcttcgtgcgtccgcgcatggaccggccccgggagaccgccgcgtcgtccttcttggggctcggcttccacgacggggaagacgacgagtgggcaccacccgacgaggatggggagctcgggctgcccctctgctgggactgcctgcagctggaggaccacgacgacgacgaccaccgaaggtgggacgtcngcgtcagcg

SEQ ID NO: 42599 - DNA, 424 bp, Zea mays
  Clone ID: LIB3062-014-Q1-K1-B2
aagctagcgcctccctagctctcgtgtcagcaatggccaccaccgctgcgtccagcctcctcaagtcctccggcgcgggctcccggctcccttcggccacgcgcaccaccaccccgtcgtccgtggccgtggccaccccgcgcgccggcggcggccccatccgcgcgtccatctcctcccccaacccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggcgggca

SEQ ID NO: 42600 - DNA, 369 bp, Zea mays
  Clone ID: LIB3062-014-Q1-K1-B3
tgggcaactggcacctcggtgggatcaacagctgggaggacaggctagtcaacatcgccctggagatcctcatgaggccccggctgctcttcctggacgagcccaccagcggcctcgacagcgcttcagcgttcttcgtgacgcatacactgcaggggctggcgagggatggcagccggaccgtcgtagcttcggtccaccagccgagcagcgacgtcttcttgctgttcgactgcctctaccttctgtcaagaagcagaacagtctactttggcaaagcttcaaaggcttgcgagttcttcgcgcaagctgggttcccgtgcccgccgattcgcaaccctgtcgaccatttcctgcggtgcataaact

SEQ ID NO: 42601 - DNA, 434 bp, Zea mays
  Clone ID: LIB3062-014-Q1-K1-B4
gtgaaaacatccccattgtcctctgcggtaataaggttgatgtgaagaacaggcaggtgaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtagaaaggatcatgagtcttgaacttgagcaggagttgtgccttgcgtgttttaagttgttctagggtgaactcttgagttctcattgtctggatcatctttttctccttggat

SEQ ID NO: 42602 - DNA, 422 bp, Zea mays
  Clone ID: LIB3062-014-Q1-K1-B5
ccgagatggggctccaggactgctccgacacggtggtgggcaactggcacctgggggggatcagcggcggcgagaagaggcgggtcagcatcgccctggagatcctcatgaggccccggctgctcttcctggacgagcccaccagcggcctcgacagcgcttcggcgttcttcgtgacgcagacgctgcgggggctggcgagggatggcggccggaccgtcgtagcttcggtccaccagccgagcagcgacgtcttcttgctgttcgactgcctctacctcctgtcaggaggcagaacagtctactttggcaaggcttcagaggcttgcgagttcttcgcgcaagctgggttcccgtgcccgccgatgcgcaacccgtcggaccatttcctgcggtgcataaactcggacttcgacagggtg

SEQ ID NO: 42603 - DNA, 443 bp, Zea mays
  Clone ID: LIB3062-014-Q1-K1-B6
ggctgggaggcgctaccggaagagttggtagagtccaaagaataaacaagagggtgtgtggtgatctgtgcatccggttcacagttgctggatggagattatcagaaaacgtgttgaacttggtgagctgcacaaggtacttgaacttctagaccgagcatctttgaaacacagcgtgttcctagaggaagaagaagcacacagcttggttgaacttgtatctgctctggactgcttcatggcccttaaaactgtgttgctactcccacatgaatctctgagactgcagtgcctgcagatggtggaggtgaaaatgagggaaggaatcgtgtccacctcatcaaatgctgatgatcaggagcttcttgccttggttctttcctctggaactatgcacaagatcatcacagaagatgcatactctaaaattttctcttacatat

SEQ ID NO: 42604 - DNA, 436 bp, Zea mays
  Clone ID: LIB3062-014-Q1-K1-B7
gtaaaaattatgattgagaagagaatggaatccagtgcaatatctgaaagaaagagtggggatgctcgatcttactttatgaccttggaatactgggaagatttattttgtaagctaaatgagatgagaagatataggagaatagttgggtctcttgcgggctcttgtttatcagctgccatcccacttctctcttccaataaggaaacagcatgccttgtggcccttgacattgtggagagtgctgctatatctattgccaatgttgaggaggcttataagtgtgaatgtcaaagcaaaggagtcattgaggaggccatccagttttgttcatttgacgagcttcttgatggtacagatgccaccgaagatgttgatgaaaataggctactcccagcaatgaacaaactgtggccttacttggttatctgtctaa

SEQ ID NO: 42605 - DNA, 418 bp, Zea mays
  Clone ID: LIB3062-014-Q1-K1-B9
ggagccgaaagtaagcctcagttccgccggcgtgcgaggggttcgatctgggtgagcgtctcacgatgccgccagcccccaagtccggcgacgccctcttcgccagcgtggatcgcgtcaatgcggagctgttcacgctcacgtacggcgccatagtgcggcagctgctcacggatctggaggaggtcgaggaggtcaacaagcagctcgatcaaatgggttacaacattggaacacgattggtcgatgagttcttagcaaagtcaaatgtatcaaggtgtgttgacttcaaggagactgccgatgttattgcgaagcttggcttcaaaatgttcttgggtgtgactgcaactgtgaccaattgggatgttgagggtacaagttgcagcattgtcctcgaagacaaccctcttgttga

SEQ ID NO: 42606 - DNA, 246 bp, Zea mays
  Clone ID: LIB3062-014-Q1-K1-C10
cggacgcgtgggcggggatgaccgagtcctgtacgcacatgggcagctttggctgcagggacagcacatcattggacgggctgttggctatctgccttatgctgggtggcttacaatcgtcatgacggagaaaccagtcctcaagtatctgctaattggtgcactggggctgctggtggtagcatccaaggagtgacgttaaaggtaggatcgatgaacaggagaaaagatttccgagaggggaaa

SEQ ID NO: 42607 - DNA, 421 bp, Zea mays
  Clone ID: LIB3062-014-Q1-K1-C11
ggacaagctgttagcctgtttggtgttttcgacggtcatggaggatcacgtgctgctgagtatttgagggagcacttgtttgataaccttctcaagcaccctgatttcttgacagatacaaagcttgcgataagtgaaacatatcagaaaacagatacagatttcttggaatcagaagcaagcgctttcagggatgatggttcaacagcttcaactgcacttttggtgggtgaccatttatatgttgcaaatgttggtgattctcgtgccgttatttcaaaagctggcaaagctatggcgctttcagaagatcacaaacctaacagaattgatgagcgaaagagaattgaaaatgctggtggtattgtcatttgggctggcacttggagggtgggtggtgtattggcaatgtcccgtgcat

SEQ ID NO: 42608 - DNA, 411 bp, Zea mays
  Clone ID: LIB3062-014-Q1-K1-C12
atcacagctagctagcatacagacgaataatctcttcttcacctcactaacaccggcgtggcaactctttctctcctgcaataatggccgctcgctcctcctcctcccagccgcagctggtcgcggcggcggcggtcctggcagcggcgctgctgctgctggcggcggtggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtccgcggcggaccggcaagccacctgcaactgcctcaagagcatgacgggccggcttcgcggcggcgtcagcatggccaacgccgtcaacatccccggca

SEQ ID NO: 42609 - DNA, 436 bp, Zea mays
  unsure at all n locations
  Clone ID: LIB3062-014-Q1-K1-C2
ggaacggaacactagttccaggttttgaagaaggcatacgggacatgaaaccaggtgggaagagaagaattataatacctccagagcttggtcctcctgttgggccttcgacgttcttcagtgcgaagcagttcgaagtgttcgatgtggagttactggcggtgcaggactgccagcggaggacgatagcattttactctgatgtcgtgtgcagctgaacttcggtttgtctagtcttccgcctatggcacatcgcagcagcatcctgcacttttggctgctggtctgagttgccgtccaattgtgtgtatgtatatagccagctgttgttactgcggctactgatgatgggcaatggtagtgtgttattagttcattnttgtcttgaatctcctgatggcgggatatgcgcatttggtgtgtctgtttagaagtt

SEQ ID NO: 42610 - DNA, 421 bp, Zea mays
  Clone ID: LIB3062-014-Q1-K1-A8
cgcattctcctcccaccaccaccacaccacgccctcgcttatccccccccccccccccgcggggacccgacccctggtcgacgacgtgctggcaaaacctcctcctagtcctctcgcagaaggaggctgtgttcttttcttcatcggcgcggcaacagcgaaagcttctcggtctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgcgatttctgtgggaaacaaaggtcaatgatctact

SEQ ID NO: 42611 - DNA, 427 bp, Zea mays
  Clone ID: LIB3062-013-Q1-K1-H10
agctactcctgctcccacactcccagccgagctcacgcacacacgcgcgagcaggaggtccggcaagatccaaaattaattgtcccctgcccgcgcgcgtcggggccgggcgcaaagcggcaaagggatcatcggatggcggtgttcgcaggggcacgggcacggccgctgctgggcgccctgctgctttcagcgctcctgctcacggtcacggccgccgacagccagaacaaccctgccgaccagctcgttgcactgatcaacagcaaccgtaccgccagcaagtccgcttccgtttctgacaaccaaggcttgggatgcatcgctctgcagtacatcaaagcgtacgaaggtcactgtgaccaggtggacgacaagaagccgatggagtcgagtttcacggacacgttcgccccgacctgtggcg

SEQ ID NO: 42612 - DNA, 452 bp, Zea mays
  Clone ID: LIB3062-013-Q1-K1-H11
cttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgctgcgcctgcgcctgcgtctgcgtctgcctaaaggagatcagatcagtcgtcgccg

SEQ ID NO: 42613 - DNA, 205 bp, Zea mays
  unsure at all n locations
  Clone ID: LIB3062-013-Q1-K1-H12
gtcacacacacacacacagacaagtggtttccaaagccaagtgtgtgtactagcaaccggctagctcgggcggcagcaggcagccatcatgtcggaggagaagcaccaccacttcttcaaccaccacaagaaggacgaggagcagcccgccggcgagtacgggtactccgagaccgaggtggtcaccgncaccggcgagggcgag

SEQ ID NO: 42614 - DNA, 481 bp, Zea mays
  unsure at all n locations
  Clone ID: LIB3062-013-Q1-K1-H2
caggtgcatgatgagctttcaaaggttaaggcctcattagctggcacagcccggcgtcttgagttgttgcagaaggatggcgagttgcagaagaggcagactgaatcgctgaggcagcaatgcaattgcactctccattgaaagttatgcaagattaaggacatggaaggagtttttcagcttctttggcggattagctatttttttccaacaccaagggaggaaaaccagattgagttctaggaatgagaactggcatatgaaaatgattgagaacatatatagtgtatagaccatagtgttcgtcctttataccaatggtgagctgcacagttcatccaaagtgatcggtgggaacttcattggtgacaatgcaaagcgcagaagtcaaaacgtaaaagatggcgccatatggttataagctcctaatttctgagtgattntgcagtggcagtttgcatgagtacctgactatctgtag

SEQ ID NO: 42615 - DNA, 466 bp, Zea mays
  Clone ID: LIB3062-013-Q1-K1-H4
cggacgcgtgggcggcgcggtcagttgaaccatggcggactccaaggccacctcggcggtcacgctgggcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcggaagaacagggccaagaagatccgtggtgtcaagaagaccaaagctggtgacgcctggaagatgtaaacgttcgtttacatttgtatt

SEQ ID NO: 42616 - DNA, 454 bp, Zea mays
  Clone ID: LIB3062-013-Q1-K1-H5
cccacgcgtccgcacagacaagtggtttccaaagccaagtgtgtgtactagcaaccagctagctggggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaagaggtcgctgccgcggcggccgtcggcgccggcggctacgtattccacgagcaccacgagaagaagaagaccacaaggacgccgaggaggccagcggcgag

SEQ ID NO: 42617 - DNA, 458 bp, Zea mays
  Clone ID: LIB3062-013-Q1-K1-H6
ggaagctcttgagaatcattctgcttccagacatgattgattgatgtagaattggagttggcagttttacctcaacctggccttggatagattgatattacagattgtaagttgtcaactgtggtttgtctatatctggatgatgttttgagggaaggagcatgccagaaggatgccacattgaggccaattaagtgctagtcatctaggaattgagcttccggaaaagaatttgaagtgtacttagatacaatggtgtcaccaactatactcttttcctcctcttctctctcgttttaggacggcatgtgatagctgcaatgtgatcttatctgattcataggacgacgccatatagaaatgtcaagcatcgttttttcctgtaattacatcaaattggccagttgtcattgtgtatacttagtctatgtaaagtatatcaattcatactttatgac

SEQ ID NO: 42618 - DNA, 337 bp, Zea mays
  Clone ID: LIB3062-013-Q1-K1-H7
gcgtgacggtccgggccaaggacgaaggcgaggacgtgaagccggcgcccaagcatcgccgccgtggcgccagcggcggcggagagcgcaaggaatccgagcggtcactcgccaaggtcatggggcagacggaggagcagttggtgccggaggcaggcccggcctcgggccccgcccccagctcctccaagcaaggggacgccgacacgccggccggcctcgacgccgacctggaggcgctcctgcagccgcacggggcgttgctcggccgccgagccggccggcagtggaggcccgcgctgcaaagcatcgccgaaggcaaagggtaaaggggggc

SEQ ID NO: 42619 - DNA, 478 bp, Zea mays
  Clone ID: LIB3062-013-Q1-K1-H8
cctattagtattggaagttcatgcacgtatagctgaagagtctcaccacttccatcatcttgtatcctacctaatctgcgccttccacaacaaccattttctactggagaagcgtggtgctttgatagtccgtcgcctctgcgttcttctgggtgctgaaaaagtatatcgtgagttctccactattcttgagagtgaagttgaccttgattttgcatccgtcatggttcaggctttgaatttgattttgctcacatcaactgaacttggtgagctccgctctcttcttaagaagtcgttagtggattcctgtggcaaggacttgtttcagtcattatatgcttcgtggcgccactctccgatggctacaataagtttgtgtttacttgctcaggcatacagtcatgcgagctgtgttattcagtcgctgggagaagaagacataaatgtgaaatttttggttcagttagataaattg

SEQ ID NO: 42620 - DNA, 400 bp, Zea mays
  Clone ID: LIB3062-014-Q1-K1-A10
tcttcttcacctcactaacaccagctagcaactctttctctcctgcaataatggccgctcgctcctccgcctgccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggcttggcgggggcgtcagcatggccaacgccgtcaacatccccggcaagtgcggcgtctccgtcggcgt

SEQ ID NO: 42621 - DNA, 424 bp, Zea mays
  Clone ID: LIB3062-014-Q1-K1-A11
ggtgaatcacatcagaaagatgctgataacaaagggcagacatcatcagcaacgtccgggttctcgtttacaaatctgtcaagtggccaaaatgctttcaccggtctgactggaactggattttcaagcacgtcattctcgtttggctcagcctctacagatggcccaagtactggtcccctgttcgggctgaaagctgatggttcttcgttcccttcctttagtcttggtgctgccagcaacgggagttccgccacagtgcttgctacctcagcagaagcacccaagaaatttgctatggcagaaggccctgtcgaaaccggcgaagaaaacgagaaggctgtatttactgccgattctgccttgtatgagtacctagatgggggctggaaagaaagaggaaaaggtgaactgaagctgaacg

SEQ ID NO: 42622 - DNA, 232 bp, Zea mays
  Clone ID: LIB3062-014-Q1-K1-A4
cgagccgcagatggtctcacccggccgcagaggcttagcgttgagagccacatgttgagtgaacagacggcggctagcactagcagcggcgagcatcaggagaggagcgtcgtcgaggacaggcggctacagccggtgggggagaacgaggaggcgggggaggaggaggaggagttcagggacatccacgcgctgagcccgccgctgagccagccttcgtcgtaccgccgga

SEQ ID NO: 42623 - DNA, 423 bp, Zea mays
  Clone ID: LIB3062-014-Q1-K1-A7
ttcggaccgtagagagagtgagggatcgccgacccgatcctttcttcatcctgcatggccgctgtttccgacaggatgtttctcacgaggacggagtacgaccgtggggtgaacaccttctctccggaggggcggctgttccaggtcgagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcataggttctcatacggagagccaatgactgtagaatcttcgacacaagctatc

SEQ ID NO: 42624 - DNA, 314 bp, Zea mays
  Clone ID: LIB3062-013-Q1-K1-H1
ggcaggccacaaaggatgctggggtgattgctggcctcaatgtgctgcgtatcatcaatgagcggggcgctgctgctattgcctatggtcttgacaagaaggcaaccagtgtcggtgagaagaatgtcctcatttttgaccttggaggtggtaccttcgatgtctccctccttacaattgaggaaggtatctttgaagtcaaggccacagctggcgacacccatcttggtggtgaggactttgacaacaggatggttaaccactttgtccaggagttcaagagaaagaacaagaaagatatcactggcaacccg

SEQ ID NO: 42625 - DNA, 465 bp, Zea mays
  Clone ID: LIB3062-013-Q1-K1-F4
cgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatcgatcatcagctggcggaggcgatgcgacgatgatgcagaactttgtacatgcgtggtgggtgtgtaacatagtgtggctggcaacaagccatgctcatgcaaaccgatgaatctatctctgtatcatgcatcgatctcggttgcttgctagtcccgactccagactccagacatggctatatatagctggtgctaata

SEQ ID NO: 42626 - DNA, 461 bp, Zea mays
  Clone ID: LIB3062-013-Q1-K1-F5
caacgtcgtggtcaccggccacagcctcggcgccgcgctggcgaccatcttcccggcgctgcgtggcgttccacggggagcggggcgtcctggaccgcctgctctccgtggtcacctacgggcagccgcgcgtgggcgacaaggtgttcgcgggctacgtgcgcgccaacgtgcccgtggagccgctccgggtggtgtaccgctacgacgtggtcccgcgcgtgcccttcgacgcgccgcccgtcgccgacttcgcgcacggcggcacctgcgtctacttcgacggctggtacaagggccgcgagatcgccaagggcggcgacgcgcccaacaagaactacttcgaccccaggtacctgctgtccatgtacggcaacgcgtggggggacctcttcaagggcgccttcctgtgggccaaggagggcaaggactaccgcgagggcgccgtctcgctgctctac

SEQ ID NO: 42627 - DNA, 478 bp, Zea mays
  Clone ID: LIB3062-013-Q1-K1-F7
cttgttttttttttttttttaagtacaaacggtactattgcagtaatattttgggggggaaagccgtacattacccgctgacatttctcattgcacactgatctatatgtacaccatggaagaacatgacaaatacaaaaaggcataaggggttccttgtctatgccttctatgcatatgcaaaacgcatccgaacagatattcgcagatttctcttccacaagcaaactcgccctcctctcctttcaggagaactgcctcactgtgcccaaacgggccctttaatttcccttgccattctcagtccacacgctgtcccacgagttaactttcggcgcctcaacaagctgctggcctcgtccctccgatgatggagctcctgggcccttaacaccgctcttctttggttttcttttgatccccagcaaacgtagaacaaatcttgcaagctcaccataaagcattccagcccgatcac

SEQ ID NO: 42628 - DNA, 392 bp, Zea mays
  Clone ID: LIB3062-013-Q1-K1-F8
gtgaggcgtgagcgccacacccacacgaaggatcccgaagccgaagagaaccctaccgaggaggcagaaaatccgtaggcgcgcctcatacgattccgagatccgtgcctcttatcggcagccatgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtcggcgcgccggcgtgcggggacgtcatgaagctgcagatccgcgtcgacgaggggtccggcaggatcgtcgacgcgcgctt

SEQ ID NO: 42629 - DNA, 375 bp, Zea mays
  Clone ID: LIB3062-013-Q1-K1-F9
gcggacgcggccgtggtcgccgagctccgccacctcgcgcgcctccgcgaccgcttcggccgctccgcagccgtgggccacatcccgcgcccgaacccgtccgcgccgccgctgcgcgaggccgtggcgccgtacgaggcggcgctcgacgacctccagcgccagctccagtccaagcagggccaagggggccgcgctcaagaagaaactcgcggcgggcaacaacccgcggaaccggcgccaacaacacgttccggccttcaagcagaacggcggcgcgccgacggcggaactcttcaacaactgcgccgagcaagcccgcgcggcgacgccggccttcgcggggcacctcgggcacctgatgccccccggcgg

SEQ ID NO: 42630 - DNA, 459 bp, Zea mays
  Clone ID: LIB3062-013-Q1-K1-G1
gtgctttgataacttcggcgacaaggtgaagaattggttgacctttaatgagccccagacattggcttccttttcctacggaactggggtctttgccccaggtcggtgctcacctggactagactgtgcctacccaactgggaattcactcgtcgagccttacactgctggccataacattctcctagcccacgctgaggctgttgatctttacaacaagcattacaagcgcgacgacacccgcatagggcttgcgtttgacgtaatgggtcgtgtgccatacggaacatcgtttctggataaacaggccgaagaaaggtcctgggacatcaacctaggatggttcttagagccagtggttcgtggtgactaccccttctccatgagatcattggctagggaacgactacccttcttcaaggacgagcaaaaggagaagctcgccggttcctataacat

SEQ ID NO: 42631 - DNA, 440 bp, Zea mays
  Clone ID: LIB3062-013-Q1-K1-G10
ggcagaactagggaactccgactcgagagggttgttcataaactcatgcttcgtgcagtgccagtctgagatacaggagctatggttctcatctgactcccccgtgctcggaaacacaacagtagcaaacgctgttggcgactggttcttcgaccgcagctccttccataagatagactgcccatacccttgtgactcgacctgtcacaatcggatctacgatgactcatcacaagcatagcaattacagtggtctcacttcgtactgccattcaccatgttactccattacatttgacgcttccagcattgctaacagtagggcaatgcgttgacagccattgatttttttttctttttacgaataagatcaggtgccggcggctctaactcggttgctaccggaaagtgagcgtgcatcttccgacggtacatggcat

SEQ ID NO: 42632 - DNA, 465 bp, Zea mays
  unsure at all n locations
  Clone ID: LIB3062-013-Q1-K1-G2
ctcgctagcactagcatagtcgtctctttcttttctgcttccagacattgtccacacgagctagggcactggtgtcgctcgcaaccaaattaaggacgtactgagccatggcatccaagggcgtcctcttcttggctctcaacctcctgttcttcacagtggccaacgcctgcggcagctgcccgaccccaacgccgccggtcgtgccaccgccgccgcctcctgctgctaccccacccccttcatcatccagtgggaagtgcccgctgaacgcgctcaagttcggcgtgtgcgtcaatgtgctcggcctcgtcaaaggcgaggctggcaaggtaccagctgagccatgctgcaacctcatcaaaggccttgcagacttcgaggccgncgtctgcctctgcacggccatcaagggcaacgtnctcggcgtcgtcttcgatgtccctatcaagttcaatgccctcg

SEQ ID NO: 42633 - DNA, 463 bp, Zea mays
  Clone ID: LIB3062-013-Q1-K1-G3
ctcaggtcgggaacgcagaggcgggggcaacaagaaggccgggcgagaagacaagaggaagccggaaggagaacgagttcggaagggagcggatggcaatggctctgctccagctattgctgtcgctcctcatcgtctcctgcgccgcgcagtcgccgtacgcgtcgaaggctcctccgctcagcgcctcggcgccggggggctctgtcgcgccaccgacaacggcggtctcggcgccgcaggcgtctgcacagccgccgacaacagtcgccgcgtctgggcctcaggcctcggccgtagcaccaacaaaagcagccttggcgccacaggcctctgctgcgccgccaactacagctgcctcgccgcagctggctgccacgttggccccggtttcctcaccgccactagctgctgctgcgccacctgcctccgctacccctccaaccacgccaccatcggcaac

SEQ ID NO: 42634 - DNA, 440 bp, Zea mays
  unsure at all n locations
  Clone ID: LIB3062-013-Q1-K1-G4
cagcaatgacggcgactacgagcacacgtccgcagccgcagccgcagccgcagccggcggcggtggcggaggcaggggcggcggccgccgcctctgggtcaaggagcgcgaccacgagtggtgggaccggatgagcagccccgcgtgccccgaggacgagttccgccgcgccttccgcatgtcccgggccaccttcgaggccgtgtgcgaggagctgggcgccgccgtcgccaaggaggacaccatgctgcgcgccgncatccccgtccgccagcgcgtggccgtctgcatctggcgcctcgccaccggggagccgctccgcctcgtgtccaagcgcttcggcctcggcatctccacctgccacaagctcgtcctcgaggtctgcgccgncatcaaggccgtgctcatgcccaaggccgtgcagtggcccgaggcgcccg

SEQ ID NO: 42635 - DNA, 108 bp, Zea mays
  Clone ID: LIB3062-013-Q1-K1-G5
ggagagcgctggtgtttaggaccgcatgcattcagaagctctctgtgctgctggccagatgtgtcgttcgttgtatcatgtatgggtgtttctggctttcgttctggg

SEQ ID NO: 42636 - DNA, 445 bp, Zea mays
  unsure at all n locations
  Clone ID: LIB3062-013-Q1-K1-G6
cggacgcgtgggcggacgcgtgggcacagcggccctcggtggaggacgtgctgtggaacctgcgagttcgccgcccaggtgcaggacgactgggaggcggatgcctggagcagcggcggaggaagcccagtgtcgtcgtcgtccagacccaccaggccgtctcggctacacttgagcagatagatgatcaggtgcttcaccaatctccagtaaagcggtcacatgatctacccatagtctaccggggacaaggatctaaagatgggaaatgctggtcagcctacagtacagcatctgcctctgatgggatgctgaaacccacagcaggatcagctcactgaaaactgtcccccctgtggtgcagactaatgtgctntgcgctggtgcagactaatgtgctttgcgccactgtagagttctttttggggttctcttataataacgt

SEQ ID NO: 42637 - DNA, 473 bp, Zea mays
  Clone ID: LIB3062-013-Q1-K1-G7
ggatgatggcttcctctagtcctcagcgtgcagcgggcgccgccgtcgccggcgtgctgctggtggcggctgccgcgctgtgctcgtgcggcgccatggcgcagctgaccgcggactactacgactgcacatgccctgacgcctacaacatcgtgaagcaggtcctgatcgaggcgcacaagtccgacgtgcgcatctacgccagcctcacccgcctccacttccacgactgcttcgtccagggctgcgatggctcggtgctcctggacgccgttccgggggtggccaactccactgagaagctggcgccggccaacaacaactcggcgcgggggttcccggtggtggacaaagtgaaggcggcgctggaggacgcctgccccggcgtcgtctcctgcgccgacatcctcgccctcgccgcagagatctcggtcgagctgtccggaggaccaaaaggggcagtgcttcttggg

SEQ ID NO: 42638 - DNA, 430 bp, Zea mays
  Clone ID: LIB3062-013-Q1-K1-G9
atcgaggcggggatatacatgctgcactgtctacctctcaggctggtcggagccgagggtgcaccgaccagatgcatcctcatcaagtgatcgttcctcggccgtcctgctcttgctgccttgctggaggtggcgacactggaccatgccagctgagctggtgctccgtcgtgggtcgtggccaatatttggctcgcatgcagtcgtcgatctatatggaacagaacactgcatgcctatgtagatacgcttgtatggacaataaaggaaccgcagtacttctgtcgatgaaatacttttgggtgagctggtaatctaagacaccaggcctacaggttacttgtaactgtaagctggaggccctagaaggctaaggctagtggctagggatggatccagatttttatttgaatgctattttttggtcatc

SEQ ID NO: 42639 - DNA, 431 bp, Zea mays
  Clone ID: LIB3062-013-Q1-K1-F3
ggagaaacgagccgtcggaaacgacgtgcataatctcgaccccagcactgggatgaagatcacggaagcactacgcgtgcagctcgacgtgcagaggcgcctccacgagcagctcgagatccagaggaacctccagctgaggatcgaggtgcaggggaagaagctgcagaagatgttcgaggagcagatgaaggcgagcaggaccgtgatggagccacgacaggaggaggaagatgatgacgacgacgcgttcgacgatgtgcacgtgcagctgctggcgaccgcggcccgcagcgacgccgggttccagttgaagataagctagcctttggccgtcgcgcgcctctagctggctcgatcggctttgtaatcgtaaggtttaactacaaatatcagcctagtgacccatggatagggatgactacaatgtt

SEQ ID NO: 42640 - DNA, 430 bp, Zea mays
  unsure at all n locations
  Clone ID: LIB3062-013-Q1-K1-D9
ctcaacttcgcgtcgagcctgtactacctgccgccgttcatcgcgacgatgcagaacgtgaaggccctggtgctgatcaactacggcagcggcagcgcggccctggacaacctctccgccttcaccacgctgagcgggctgaggagcctgtggctggagaagatcatgctgccgccgctgcccaagacgacgatcccgctgaggaacctgcacatgatctcgctggtcctctgcgagctgaacagcagcctgagggggtcgacgatggacctgtcgacgacgttcccgcgcctgtccaacctgacgatcgaccactgcatagacctcaaggagctgccgccgagcgtctgcgagatcgggtccttggagaccatctncatctncaactgccacgacctcaccgagctgccgtacgagctggggcggctgc

SEQ ID NO: 42641 - DNA, 460 bp, Zea mays
  unsure at all n locations
  Clone ID: LIB3062-013-Q1-K1-E1
ctgacaataccgtcctcaggacaaggcacctcagaagcccttctcgtccgcgccgcctccttgagcccgctggccggcgagctgctcagcgcggcttttttttgcatccacaatgccgcagcttggcacatgttcattgcctggagctgcaatctatggcacttcaactaggagatttggaggtttggagtttcagcaacataaagttaatcacatctcatttggtcggaaagcgtctgttaaagcaacattgaaaactgtgagatgcaatgccactcaaacacaaagcgtccaaaagaaatcttcaagtgcaactattcagcgtgataagaaaggaaatgtacaagggccaaaactggatgacggaagcggtgggttccctccattccgctttggcaaaagtgggggtggtggtggaggccggngaagtggcagcaactactttggcggatttcttctc

SEQ ID NO: 42642 - DNA, 438 bp, Zea mays
  unsure at all n locations
  Clone ID: LIB3062-013-Q1-K1-E11
atggcgtccaccttcatcggcaactccacctccatccaggagatgttccggcgcgtgagcgagcagttcaccgccatgttccgcaggaaggccttcttgcactggtacacgggggagggcatggacgagatggagttcaccgaggccgagagcaacatgaacgacctcgtgtccgagtaccagcagtaccaggacgccaccgccgacgaggagggcgagtacgaggacgaggaggagggagatctccaggactagaataggctgcttcacattcagtcaccgtcagtcatgaaaaactaatcatttgctgcttttcgtcgtcgtagtagtagtaggtcggtaatcatctgtcgtgggtttgtttcgtttctatcattaatcagcattagtagtagcagctgctgctgcgggggcacaacacnaggnggggataggaac

SEQ ID NO: 42643 - DNA, 433 bp, Zea mays
  unsure at all n locations
  Clone ID: LIB3062-013-Q1-K1-E12
cggacgcgtgggcggacgcgtggggcctcggcgtccccgctcccggcctccacgcgcgggtcctcgcccaggtccagctcgctgagcctgggccgggggaccgccgggaacggcccgcgccgtcttgccgcagcagcgcccccacgggcgttcttctcatcgtccccctaccagccgccccaaccggaggggttctcgccacaccgggagtacggcctggtccccatggtgatcgaaaccacctcccgcggggagcgcgcctacgacatcttctcgcgcctgctgaaggagcgcatcgtctgcatcaacgggcccatcgccgacgacacggcctcgcttgtcgtcgcacagctgctcttcctcgagtccgagaacccactcaagcccgtccacctctatatcaactcccccggnggtgtcgtcaccgcggggc

SEQ ID NO: 42644 - DNA, 376 bp, Zea mays
  unsure at all n locations
  Clone ID: LIB3062-013-Q1-K1-E4
ataaactgcggattctttctttctcttccattcttacgtttccatattaaagtgtagtttttttacgtaaatttaataatattaatctaatatgcccattggtgttccaaaagtaccttaccggattcccggagatgaagaagcgacttgggttgacttatacaatgttatgtatcgagaaaggacacttttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcanacggtgacacctgatatatatacaatatg

SEQ ID NO: 42645 - DNA, 462 bp, Zea mays
  Clone ID: LIB3062-013-Q1-K1-E5
cccacgcgtccgattcggcttattgatctgcgacagtcagcactgtgtgacaaccatgctgaactatttgaggagcatgaagcacccggatcaagatccttttttacagagataatagcatcagtttcagatataaaatttgcaagggatggaagacacattcttagtcgtgattatatgacactcaagttgtgggatctaaacatggattcaggcccagttgcaacttttcaggttcatgaatacttacgtcctaagctttgtgatttatacgagaacgattcaatttttgacaaatttgaatgctgtctcagcggtgatggactccatgttgcaactggttcttatagtaatttgtttcgtgtttttggttgttctcctgaaagcgtggaggcatcaacgttggaagccagcagaaatcccatgaggcgacaggttgttgatccagcaaggcctgcacgg

SEQ ID NO: 42646 - DNA, 448 bp, Zea mays
  unsure at all n locations
  Clone ID: LIB3062-013-Q1-K1-E6
cggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactncgacgggaactggaggaactgagcggtgggg

SEQ ID NO: 42647 - DNA, 458 bp, Zea mays
  Clone ID: LIB3062-013-Q1-K1-E8
cgaggaggagctggagtacgttaagatggccatgcggaaggccgtcgcgctcctgccggagcacgcactcgtgggcctcgtcaccttcggcacgcaggtgcacctgcacgagctcggattctccgatctcagcaagatctacgtcttccgggggaccaaggagatctctaaggaccagattttggatcagcttggcctggcgggtgctgggcggccgggcttccccaagatgccacagcaaccgggcgggccacaggtgaatgggatgcatccgccgtccacggccggggtcaacaggttcctgctcccggtgtcagattgtgagattgctctcagcacgttgctggacgagttgcagcctgaccaatggccagtcgaggctgggaaccgtgcgatccgttgcactggtgttgcgctcagtgtagctgctgggttacttggtgcttgcatgcctggaa

SEQ ID NO: 42648 - DNA, 425 bp, Zea mays
  Clone ID: LIB3062-013-Q1-K1-E9
agaccactggcccgaacatggttgtagatatgtgcaagggagtgcagtatctcaatgggatcaaggattctgttgtggctggtttccagtgggcatcaaaggagggtgcactggctgaggagaacatgcgtggaatttgctttgaggtctgtgatgtcgttcttcatgctgatgctatccacaggggtggtggtcaggtcattcccactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgcagaggccgggtaccccgctctacaacatcaaagctttcctccctgtcatcgagtcctttggtttc

SEQ ID NO: 42649 - DNA, 416 bp, Zea mays
  Clone ID: LIB3062-013-Q1-K1-F11
ggttttggagtttcctttttcttgctatttggggtatatgcagctagcttttatgctggtgctcggcttgttgaggacaggaagacaacctttcccaaagttttcagggttttcctagctcttgcaatggcggcaattggagtgtcgcaatcaagtacccttacatcagattcttccaaagcaaaatcagctgcatcttctatatttgcaattgtagatcgaaaatcaaggatagacccaagtgaggatgcaggggtaactgttgaggcactacaaggaaacatcgtattccagcatgttagcttcaagtatcctaccaggccagatgttcagatattccgggacctttgcttgacaattcatgctggaaagactgttgcactcgttggagagagtggtagtggcaaatcaacggc

SEQ ID NO: 42650 - DNA, 252 bp, Zea mays
  Clone ID: LIB3062-013-Q1-K1-F12
aactccaccaactttaaccacaccttcatctatcttctcctccacatctaccacatcttcaactccaacacactctacatatattactacccaaccaaaccacccacatccaataccatcaacatcatctcctccaaatacaatatataccctattaactcatcctatttctcctcatcatcacaaccctaatcaaacatactctatcctgattaacgaacacataacatcataacaaactatcttaacttc

SEQ ID NO: 42651 - DNA, 461 bp, Zea mays
  unsure at all n locations
  Clone ID: LIB3062-013-Q1-K1-D6
gtcgacggagctccgccacaagtacaacgtgcgctccatcccgatccgcaaggacgacgaggtgcaggtcgtgcgcggcacctacaagggccgtgaggggaaggtggtgcaggtgtaccgccgccgctgggtcatccacgtcgagcggatcacccgcgagaaggtgaacggctccaccgtgaacgtgggcatccacccctccaaggtgatcgtcaccaagctgaagctcgacaaggaccgtaaggcgctcctcgaccgcaaggcccggggccgcgccgccgacaaggctaagggcaagtttactgccgatgacgtcgctgccgccgccgctggtggcgccgncaccggcgcctctctccaggagatcgactagactcttcacggtcatctgatggttgtcgtaccgncttttcctcatctctttagtttttgctaccaaattgtatgtgatagaggtctta

SEQ ID NO: 42652 - DNA, 389 bp, Zea mays
  Clone ID: LIB3062-013-Q1-K1-C12
gggatatatttatgaacattgatatcgtttttatgcttactcacatgggatctgatcgtttaactcaagatatttgtcttttggtaatatgatcgtctaacttaaatttgcattcaatttagactttaggttatgttagtcataacaagcttgaaaagacatattaacaaagaaagatcatattagcagttcatgttacgtttgcagatatggacctcggtggttttctctacattagaaaagctggaagagccttttgaactcagtttttttgctaccagtggtgttatggtgaaacagagttttgtgtgtatgtaccaacaactaaaatgtaaacacgacattatcatagttgagtacataaataattatctcttatatcttattgt

SEQ ID NO: 42653 - DNA, 472 bp, Zea mays
  Clone ID: LIB3062-013-Q1-K1-C2
atggcgggcaagggctcaactgggtgaagttagatgacgaagagagagaatagctaggccgcgccgacgccgaaccgcagcagacacgcgcgcggacagcgtacgagggagggagctgcctgaggtagaggaggaggagaacatgcagggcggcggcggcgtggaccagccgccgatgcagatggtgctgcgggtgaggcacccgtcgtcgctgggcggcagcggggcggacgaggacgacggcgaggggtcctctaggtcggcgctctcggtgttcaaggccaaggaggagcagatcgagcggcgcaagatggaggtccgggagaaggtgttcgcccacctcggacgcgtcgaggaggagtccaagcgactcgccttcatcaggcaggagcttgaagggatggccgaccctacaaggaaggaggtggagtcgataaggaagcggatcgacacggtgaaccgtcagctcaag

SEQ ID NO: 42654 - DNA, 434 bp, Zea mays
  unsure at all n locations
  Clone ID: LIB3062-013-Q1-K1-C3
gtgcgcgcgcaatggcactcgtgtccgcctcctcgtcctccaccaccgccgtcgcggcgctccgcaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctgnggcctcggatctgacccggagagcctgcggtggaacgtgcaggcggagctggtgcactgccggtgggcgatgctcggcgcggcgggtatcttcatccccgagttcctgaccaagatcggcgtcctcaacacgcccttctggtacaccgcc

SEQ ID NO: 42655 - DNA, 356 bp, Zea mays
  Clone ID: LIB3062-013-Q1-K1-C4
acccttctctttattaacatcaccaacgactacccttacataaggagttttaccttctatgtattgccatcaccaaaagtctcatacactgttgtgtaaccttacaatgctacactttctgttcaccaactcgttcataacgcttatcaatgtattgtgcttgacaactaatctctttatgacatatgctttctcactctaaagctcgccacccctacctttggctacctgaaccatctcatctctgccaccatgagttgctttacatgctaccttatgttccctgttcatctcaactcttaccttctcaagcttgccataaacctgatccttttccctctccttcacttcttcat

SEQ ID NO: 42656 - DNA, 451 bp, Zea mays
  unsure at all n locations
  Clone ID: LIB3062-013-Q1-K1-C5
gccggagaccgacctgtgggtgataagctggcaggggctgcccatctacgacgccgacttcggctggggacggccggcgttcatgggccgcgcgtgcctccagttcagcggcctcgtgtacctcgtcccgggcccggacggcgacggccgcctcgacgtcgtcgtggccatggagcccaagagcctggccagattcaaggagctgttgtacgagctcaaaggtgcaggtgttccgtgcacggcagactgagctgctgcattccgtgcaggttccttggctggctaccggctggcaaaacgaanacctgtttgccggattgttccttgcattgcgtatctacttcgacctttactgcagtactcctagttntctactcgttgtttgtgatcgcaatctggtgagtactgtactctatatgcatntacatggctatctatattattcggagct

SEQ ID NO: 42657 - DNA, 460 bp, Zea mays
  Clone ID: LIB3062-013-Q1-K1-C6
ctgtcacacacacacacacagacaagtggtttccaaagccaagtgtgtgtactagcaaccagcgagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgaga

SEQ ID NO: 42658 - DNA, 455 bp, Zea mays
  Clone ID: LIB3062-013-Q1-K1-C7
atcagtactgccaaccatttgttctccactcagaaaggcctgcgctggtatggatctttcagcggtgcatgatattttgctcaaaacaggttataaagatgatgagggtgcagaaaacgagctatcctttcaagaatggacccagcaagtgcaagagatgctgaacacaaagaagtttggtgacattgcatttagagacaaggattttaagactgcaattgactactactccaagctagttgcgatgatgtcgacgccttcagctacggtttttgtcaggcgcagtttttcctacatgatgaatgggcaagcagagctcgctctacgggacgccatgcaagcccaggtctgcatgcccgagtggcctacggccttctacctccaggccctggctctttcaaagctcggcatggaaaccgatgcccaggacatgctcaacgatggcgccacgtttg

SEQ ID NO: 42659 - DNA, 459 bp, Zea mays
  Clone ID: LIB3062-013-Q1-K1-C8
ctggatctggcatgggcacccttctcatttccaagatcagggaggagtaccctgacagaatgatgttgaccttctctgtattcccatcaccaaaggtctcagacactgttgtggagccttacaatgctacactttctgttcaccaactcgttgagaacgctgatcaatgtatggtgcttgacaacgaagctctgtatgacatatgctttcgcacgctaaagctcgccacccctacctttggcgacctgaaccatctcatctctgccaccatgagtggcgtgacatgctgcctgaggttccctggtcagctcaactctgacctgcgcaagcttgccgtgaacctgatcccgttccctcgcctccacttcttcatggtcgggttcgccccgctgacctcccgcgggtcgcagcagtaccgcgtcctcacggtccccgagctgacccagcagatgtgggacc

SEQ ID NO: 42660 - DNA, 346 bp, Zea mays
  Clone ID: LIB3062-013-Q1-K1-C9
attgctcgctgtgacaatcatataccaatacttcgaaacctttgagaaggaaagggcggctgagcttggtttctttggtttttgattagtagctgtggaaccttaacttggctatagctgaattttcttgtaagtccctgtagtgcttagccagttgtaacttaaagagttctgtttaggttgccttcttgcggccacaatcatgtagcagaatgtgcgtgtgtttcaggttagcgtgggggtatgtgcatctgtccaaagagagtctgcaatttggcaaccggatattttgttatcaatttcagttacttcgaactgaacatgttctcattcttacttcctgttt

SEQ ID NO: 42661 - DNA, 430 bp, Zea mays
  unsure at all n locations
  Clone ID: LIB3062-013-Q1-K1-D10
aagatgcagaacggtgtctcttgaatgacttgcacatccttgatcttgaaaccatgacgtgggatgatgtggatgcaataggcacccctccttctccaaggtcagaccatgctgctgcttgccatgctgaccgctatcttttaatttttggtggggggtctcatgcaacatgtttcaatgacctacatgtccttgatttgcagacgatggaatggtcaagacccaaacaacaaggcccgactccaagtccaagagctggccatgcaggtggaactgtcggcgagaactggtacatagttgggggtggcaataataaaagtggtgtttctgaaacacttgtgcttaacatgtcaactctgacgtggtcggttgttagcactgtggaaggacgagtcccccttgctagtgagggcatgactntagtgcatag

SEQ ID NO: 42662 - DNA, 56 bp, Zea mays
  unsure at all n locations
  Clone ID: LIB3062-013-Q1-K1-D11
caaggttgtcgtcactgaagttcttggtggtgggaagttntatgttcagacagtgg

SEQ ID NO: 42663 - DNA, 443 bp, Zea mays
  Clone ID: LIB3062-013-Q1-K1-D12
actagttctagatcgcgagcggccgccagaccattcgtttctcgcgagccatcgcttgggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgttttgaagttcatgctaccttttaaagtacggattaccttgtgcctatgttcaaaaa

SEQ ID NO: 42664 - DNA, 225 bp, Zea mays
  Clone ID: LIB3062-013-Q1-K1-D2
ccgagcttcaaggccacatcggacttcgtcagataccggcatatcctgtctgaaatggtttgagcagctttccgttgtgcaaacttgttgtcccgaaatgacttggcacgtcctctgtaacaagcaacgtcacctcggagggtacttttatttaattcttttggtccctcttgcagaaaataatattttattgttgtgaataaaaaaacgttgcaattaccgatg

SEQ ID NO: 42665 - DNA, 339 bp, Zea mays
  Clone ID: LIB3062-013-Q1-K1-D3
ggacaagaaaaagaagaaggagaagaagaagcacggcgagggccacgaccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgc

SEQ ID NO: 42666 - DNA, 419 bp, Zea mays
  Clone ID: LIB3062-013-Q1-K1-D4
cccacgcgtccgcatctccgccctctgcgaggccaccggcgcgaatgtgactgaggtggcttacgccgtgggcaaggacacgaggattggccccaagttcctgaacgccagtgttgggttcggtgggtcttgcttccagaaggacatcctgaacctggtgtacatctgcgagtgcaatggcctgcccgaggtggccaactactggaagcaggtgatcaagatcaacgactaccagaagagccggttcgtgaaccgcgtcgtgtcgtccatgttcaacaccgttgccggcaagaagatcgccgtcctcggcttcgccttcaagaaggacaccggcgacaccagggagaccccggccatcgatgtctgcaagggcctgctgggtgacaaggcccagatcagcatctacgacccccaggtga

SEQ ID NO: 42667 - DNA, 460 bp, Zea mays
  Clone ID: LIB3062-013-Q1-K1-D5
atttgggcagacattagttgagcccaatgtgatagtaataaatgtggaaaaatttgcatcgacgtccttcagaaaataactggttcagcattgaggagagacctcctattgcatatgtgaagcttgagattctagaaggaactgacatgaagccatctgatataaatggactagcggacccatatgtgaaaggtcaccttggtcctttcaaattccaaacacagatacagaggaaaacattgtcccctaagtggtttgaagaatttaaaataccaatcacatcatgggaggcaacgaatgaacttgtcatggaagttcgtgataaggaccccatgtttgatgactcacttgggcaatgtaccattagtttacatgatctgagaggtggacaaagacatgacaaatggatatcactgaataatgtgaagaaaggaaggattcacttggcagtaacaattga

SEQ ID NO: 42668 - DNA, 438 bp, Zea mays
  Clone ID: LIB3062-013-Q1-K1-C11
gcgagtgtgaacttatcggcacatgcatactggaccccagatccaactttcacaagctgtttaaactacggagctggcattagtgaggtggaaattgatgtgctgacaggagcaacaacaattctaaggagtgaccttgtctacgattgcgggcaaagcttgaaccctgctgtcgacttgggccaggtggaaggcgcattcatccaaggagtaggcttctttacaaacgaggagtacacaacaaactctgaggggttggtcatccacgatggcacatggacgtacaagatccccacggtcgacaccatcccaaagcagttgaacgttgagctgatcaacagcgcccgtgaccagaagcgtgtcctctcttccaaagcatccggcgagcctccgcttcttctagctgcctcggtgcactgcgcaatgagggaggccatc

SEQ ID NO: 42669 - DNA, 458 bp, Zea mays
  Clone ID: LIB3062-013-Q1-K1-A7
ctgaaaaatcgactttgaaccctaatgctaaggaattcaagctaaatcctaatgccaagagttgcactccgtcagcatctctgaggccaccacaccctacatcatctgatgcatcatattactatcctaataacatgccggcggtgccacttggacccggtttgcctgtgggcatggggttcccaccggcatatggcgcccagcctgtcatgtacaatactcaacctggagcatcaccgcacggttatatgcatcctgctggtccacaggagatgcaacaatacagaggaagaaacttttagatataccattctgaactgctcttagatggaagtcgctgcaatccccacaagtgggattttgaccagcaaaaaccgctattacaatggaaaaaactggtcctgttgtgttgctcggattggttggacaaaaaagcgcaccgactttgtgttgctcgg

SEQ ID NO: 42670 - DNA, 440 bp, Zea mays
  Clone ID: LIB3062-013-Q1-K1-A9
acgcgtccgatcgtgtacgccctggtcgcgcggggcacggtggtgctggccgagttcgccggggtcgcgggcaacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgacaccttcggaagaaggatcccctttctctacctggaggacatccaaatgaggttcatgaaaaactacggcagagtcgcccactctgcgctggcttacgccatgaacgatgagttctccagagtgctccatcagcaaatggagttcttctccagcaacccaagcgccgacacactcaaccgtctccgtggagaagtcagcgagatacacaccgtcatggtcgacaa

SEQ ID NO: 42671 - DNA, 363 bp, Zea mays
  Clone ID: LIB3062-013-Q1-K1-B10
ctagggtttttgattttagccgccgccgctgctcatctcacatccctcgagaagacgcgtgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcaaagcctggcgctgagtttcctaatgccgcccgctggtacaagaccgtctctgcggctgtagcctcaaaattccttgttaaggctgtggtggtaaacctgcctgcggaaccacttcttccggaacttgttctgccgattaagcctaagatta

SEQ ID NO: 42672 - DNA, 365 bp, Zea mays
  Clone ID: LIB3062-013-Q1-K1-B12
cctctaccttttttctctctctttctcttcacctccctctcatccatccggcacctttattttaaaattccgctcggcctaccaccacttctactctcacaccttctcttttccatccactacctaccctcatcattctcacaccatccatataatctttttcatctttactaacaaccccacctcccaacttccctactttccttccttcataactaatcaacatttactctccttatcctactctctacccatactcataatcaatctcccacttctttcccatctcttcctctttattacacatctccctccttcctcattttatccttccttattctctccctttacctcttccttactat

SEQ ID NO: 42673 - DNA, 461 bp, Zea mays
  Clone ID: LIB3062-013-Q1-K1-B2
atctcgccgacagggccggcgggaacactgatgagctcaacatggatgtcttctgccggccgtggggctcacagtcacagctgcaagataaggtgcaggggcaggggcagggctctagcgtcaccaagattggactatggggtggaccgggagggtcggcacaggacatcacggcagagcggccaccgcagcgtcttcacagcgtcaccgttcgtgctggcgttgccgtcgactccatcgagttcacctatactgacagcgctgggcagaggcgcgccgctgggcgttggggtggacttggcggcaatgttcgaacgatcgaccttggcaacgccgaggatgtcagggaagtctcgggaacatacggcgcatttgaaggtgccactacgctgacctcgctcaggctcgtcaccagcagcagaacctggggcccctggggggtcgagaacgggacgcgtttc

SEQ ID NO: 42674 - DNA, 430 bp, Zea mays
  unsure at all n locations
  Clone ID: LIB3062-013-Q1-K1-B3
ccgagaaagaacaagcagccgccaccggagctcagaaccaccatcagcagcagcagcacacccggtcgaccttccacacacgcgcgcacacacacatggcgtcgcagcagaggcaacagcaggcgggagcggcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccgccgcaacgcgccgctgctgggcctgngcggcatgtcggacgccgacctncgcgggatgctcgccgagggcgacttcgacggcgacggcgcgctcagcgagacggagttctgcgtcctcatggtgcgcctcagncncgagctcatgga

SEQ ID NO: 42675 - DNA, 460 bp, Zea mays
  unsure at all n locations
  Clone ID: LIB3062-013-Q1-K1-B4
attttatcctctgttgtttcaattaaaaattcttttggtatttcaatgagtgttgagtccgaggaaaaattatcgttgttgttatataccccatttccaatggcaaggatccaattattgaatgataacaagtcttcatactcttcatttgatatattactttgtcgtagtcgcatgttttcagaaaggaatataatgttgacatggttccaaaggtatgaagcaatgatacaagcatttattatttgttcttttgttccattttctataacaggtaatatttgttttggatcgccacctagcacaaccactttaccaccaaaaggaatgtcaagagctttttcatatgtttctcctactatatctctaagggatctatcaaatgcttcaaagcattngttatttgtcattagagcttcatcccatataataagatctgtgtcaataagaagttttgcaa

SEQ ID NO: 42676 - DNA, 458 bp, Zea mays
  unsure at all n locations
  Clone ID: LIB3062-013-Q1-K1-B5
cccacgcgtccgattcatgtcagcattaccaatttagcatgttttctctgtttcctgtggtgagacattctctaattgtacacagaaattacggctgaggatagaggatcctcctcggagaaagcacatggtgtatctgggaggtgcagtgcttgctgggatcatgaaggtaattcttgtatatgcgaatggcgtttacactgtgatggattgatagcaatatacttccccgcgtattgtttggaacgtgcaggatgcaccggagttctggataaccaggcaggagtaccaggaagaaggtgtagcgtgcctaaggaagtgcgggcagtcataagtcttgccacatatcatccacagaagaaatggaggttgcatgtgtaaagaagagctctgntgttggtgttgtgtattgtagtgagctatagctgtcctgaacatgcttggggataaaccatgtt

SEQ ID NO: 42677 - DNA, 450 bp, Zea mays
  unsure at all n locations
  Clone ID: LIB3062-013-Q1-K1-B6
aggacaaaacagtcaccttatatggcatatatattatctcacaaactgtaagcgacaaacagtcctctccagcaacatatgcatcacatgcaacgagaacggtatggaactgagtttctggacaagtctatatggattcagcacctatttcgaatattcacatttctttataccaaaagcagacgatacgcaaaaaacgagcatatctgacagtaacatgcaacgggtagcgctacaacatagatctagcataaccctggcagtttagtaacttggacccatgctacaagaacgggacagtcgcttttccatctctcgtccagtcccaactgttgctcttgagccacctncaccgccgccttctgctgcagaaactgtgttgtattgcttcctgcaacctgngcagcgcccatcttccaccaagatcctgttgtggcagaagaggcacat

SEQ ID NO: 42678 - DNA, 432 bp, Zea mays
  Clone ID: LIB3062-013-Q1-K1-B7
cagacacatcccggtgatcgacggcacggggatgctggggatggtctccatcggcgacgtcgtgcgcgcggtggtggccgagcacagggaggagctgaaccggctcaatgactacatccagggaggctactaggacggcgtgtgcagcgacgacgacccctccgatcccgccagtcagtgaagtccgcctttgaaatccaataactcggaacgatgatgatgacgaaataggccgtgttttcttggacaatgatgttaagttcggcaaggtttgcctttctctttttttttttctactgcgtggtctatgtgtatattgccaaaggcatgcgtgagccatgcgcccggtgctgtgctggggcgcagataccatctgatggtggaaacaccggaaataagagcgtgccgctgtgtgtttcctttgaaggaatg

SEQ ID NO: 42679 - DNA, 459 bp, Zea mays
  Clone ID: LIB3062-013-Q1-K1-B8
ccttgatgaaccaaagtcagttttttatgatacacgtgccgataatgatggtgaaccgttggagttctgttctggagaaggcttggtaccagagggttttgaaatgtgtgttcggctaatgcttcccggtgaaaaatctattgtcacgtgcccaccggattttgcatatgataagttcccaaggccagcaaatgttcctgaaggagctcatgttcagtgggaaattgaactacttggattcgaaatgcccaaggattggactggcttaacttttgaagagatcatggatgaggcggacaaaataaagaacacgggtaacagactgtttaaagaaggaaaattcgaacttgcaaaggcgaaatatgataaggtgcttagggaatataaccacgtgcattctcatgatgatgaagagggaaaaatctttgctaattcaagaagttccctacatctaaatgt

SEQ ID NO: 42680 - DNA, 439 bp, Zea mays
  Clone ID: LIB3062-013-Q1-K1-B9
gaatctcataaggaagatgctctgcccttgtccttcagagcgtctgaaagcccatgaggtactacgccatccttggatctgtgaaaatggagtggctactgatcaggctcttgatcccggtgttctctctcgtctcaaacaattctccgcaatgaacaaattaaagaagttggctctgagagtgatagctgaacgactttctgaggaggagattgctgggttaagacaaatgttcaaggcagttgacgttcaaaatagaggcgtaattacttttggtgaacttagacaaggtttaaaaagatatggtagcgaattggagaatagagaaattagtgatataatggaagtggctgataatgacaataatgtgaccatcaattatgaagaatttatcgctgcaactgtgcctcttaacaaaatagaacgtgaggagcacctg

SEQ ID NO: 42681 - DNA, 456 bp, Zea mays
  Clone ID: LIB3062-013-Q1-K1-C10
cgagagaggcaggcggcgttcgagggagaaacgtcactacagttattcaccaagttcttctgagagaggcaggcagtctctacggcacaaggagaaacaatattacagtgactcaagttctgatcggagccatcgacactcgagaagatcgagggagaagagacatgatagagactcaagttctcctgatgccatcaggcgctcaagtagatcgacggagaaacagcgccgtcctgatacaagcccacgtcatgccaacgggcattcaaagaaatcaagtggcaagcaagactatactgagcgtagccgttacgaaaccagtagacattcaaggagatctcaggagaaacggcactaccctgattctagcgcctctgattactcggactctgatcagcacaaaaaacatcgccaccatcataggagaaaatgaactggcagtgtataaggtaaaat

SEQ ID NO: 42682 - DNA, 460 bp, Zea mays
  Clone ID: LIB3062-013-Q1-K1-A6
ccggaggggaagctcctcgacgacgtagcggccagtggcagctcggacgatggcctcgtccagcgccgccgccccggctcccgccgacgggggcgacgacctcgaccagctcctcgacagcgcgctcgacgacttcaccaacctcgatctctctgcctctgccgcccccaaaagctccggcgaggcatcggggtcaggatcgggaggcaaggggccagtgaaggggctggggctggggcttccggaccccaaggcgccgaagcggcgcgcggggaagcagccgccgccgaggggcgcgtgcgccaaagaggcgctcgaggagctgacgcgcgagacgcgggaggctgtgcgcggtctcgagacggccactgggagtgtcccgtcactggacgatgacgccatgatggaggagtttgtcaagcagttccaggagttcgcaggggcacaggatatggactcc

SEQ ID NO: 42683 - DNA, 431 bp, Zea mays
  unsure at all n locations
  Clone ID: LIB3062-012-Q1-K1-H2
ccagaggagcaccctgtgttgctcactgaggctcctttgaacccaaaggccaacagggagaggatgacccagattatgttcgagactttcaatgttcctgccatgtacgttgcaattcaagcagtgctgtcactctatgccagtggacgtactactggtattgntctcgactctggtgatggtgtgagtcacactgtgcccatttatgaaggatatgcccttccccatgccattcttcgtctggatcttgctggtcgggacctcacagactccctcatgaaaattctcactgagaggggttattccttcacaacctctgccgagcgagaaattgtgagggacatcaaggagaagcttgcatatatagctcttgactatgagcaagagttggagactgccaagaacagctcctcagttgaaaagagctatga

SEQ ID NO: 42684 - DNA, 429 bp, Zea mays
  Clone ID: LIB3062-012-Q1-K1-H3
atttgataatttggggaggggaaatcgctcgtaactgtgcaaacacttgttcctcgatgccccctcaatcaatcgagccgtggtgtttgttgtctctctctctctttaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctgaaatcgtccatgccgctcgagaagaacctgtccctcagccacctctccatccatcttcatcacgggctgctgcagctgccgcctctcgccccatgagccgtggtaagagaagcaagaagagaggtgttcgtgcgctcatcaggggtttaaatggaatctatgctatct

SEQ ID NO: 42685 - DNA, 351 bp, Zea mays
  Clone ID: LIB3062-012-Q1-K1-H4
aatccctcatagatttgattctcctgatacctcttgccaaccaacggcggcttttaaaaaggtcggccgaccaatcaacttctctcttttcccttaccccttttcatgcctttttcatccaatctctaattaaagtcctcaaccttcctttcccccaaattttcatttacttcattgtctttaccatactttcctactacttctctgccatcaccatcaatattgttataatccccctcctcaatatattatatcacatcctcattcacttcaacaccattcctttcttcatttacataacatccaatccctactactcaacctttattaatatctccacttattctttca

SEQ ID NO: 42686 - DNA, 410 bp, Zea mays
  Clone ID: LIB3062-012-Q1-K1-H5
caagagattgctaaaaaggattttgagaatcttaggcaagatagtgatgccagtgggcgagaaccggaaccagaacgagaacccaagccggagcccgaaccagaagaaccaaagccacagcctcgccggggcaggcctccaaacaagaataatgccaaacagaaagttgggaagccaccagcagaacgtgccactgcagacttttctggtgcaacacttgctactgcggcaaatattggacgacatgcacaggcagatgttgatctgtcacgaagagtaatggataaagcgatgattgcggatgtgttgagagcttcttttgccaacctaaggaatgagcacaactggtctggtgagcggaagtttgaaagacttgaagcttactcaggttatgggggtacatggtctgc

SEQ ID NO: 42687 - DNA, 424 bp, Zea mays
  unsure at all n locations
  Clone ID: LIB3062-012-Q1-K1-H6
ctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccctactggttctctgccatgaccatgaagagtgttggaagcgccgccctgaagatggtggaggaggtccgcaggcagttcaacaccattcctgggttgatggagggaacagccaagcccgactacgcaacctgtgtgaagatctccactgatgcttccatcaaggagatgattcctcccggcgctctggtcatgctgactnccct

SEQ ID NO: 42688 - DNA, 419 bp, Zea mays
  Clone ID: LIB3062-012-Q1-K1-H7
gcagaagttagcaagcagtgcaacgcgcttccaagaggtgaattcgcctcaaaagcgactgagccacagcttcactgtgttcgcgaaagatatggttgaggcgatatcattctcaaatctgtatgcccctgagcatttgatcatcaacgtaaaggatgctgagcagtgggaggagttcatcgaaaacgcagggtcagttttcttgggccaatggaccccagagagcgtgggcgattatgcgagcgggacgaaccatgtccttccgacctatggttacgcaaggatgtacagcggtgtatcgctgaactctttcctcaaatacatcactgtccaatccctaacagaggaagggctgagaaagctggggccgtacgtcgcgaagatggccgaagtggaggggctagaggcgcacaagagag

SEQ ID NO: 42689 - DNA, 430 bp, Zea mays
  unsure at all n locations
  Clone ID: LIB3062-012-Q1-K1-H8
gaaagactaaaaatgctcatagaaaagacaaaaatcaagagagcctgaaagggaataggggaagtgctggatttcctcctaggaaagatatttcagatgtatctaacaaaaagagtgacaagcaagagttaaagcccatccattgtaaagtgcaaacaggaaagaggaagagaggaacagaaaggaggttgttatcgaagaagcaaagttgccaggaccctggaccattgcctgcgtatcgccaagaaattgcatcttgcaatgaatccagaaaatccacccacagaaggattgaaaatgacccttctaccgaggtgaagcttaaagttggtgatgtgagattggcaaacattgatgaaaacatcaacaagcccagtgggactcagagagaaggaatagaaattntttgtggtcctgatgattggacaaa

SEQ ID NO: 42690 - DNA, 61 bp, Zea mays
  Clone ID: LIB3062-012-Q1-K1-H9
aaaaaaaaaaaaaaaaaaaaaaaaaaaataaaaaaaaaaaaaaaaaaggacaaacaaatgg

SEQ ID NO: 42691 - DNA, 453 bp, Zea mays
  unsure at all n locations
  Clone ID: LIB3062-013-Q1-K1-A1
gacgttctgtggcaagccatggataaatgtcttggaagatcttagaatccaggatacggatctgtggggttcaactagccaggacaaatgcttatggactgcaaagctttttcctgtcatgtctctcccagaaatgcttaatgtgggcatgtggcttatgggatcagaatgcgacccagatgggagaatagcttccttgtggcaaaaatcacagaggatcagcctggaagagctgcatcgtgctattgattacagacaactttgcaccgattcgagcaagcatcaggcaaatcttgcagctgacatagccaaggcttgcatgaactatggcttactcggtcgtaatctgtttcaactttgtgaggaaatgttacaaaaagatacatgtttagcagtctatgaangaatactttcattttttccaagtcacagtgaacagtatcctggggttct

SEQ ID NO: 42692 - DNA, 382 bp, Zea mays
  Clone ID: LIB3062-013-Q1-K1-A10
caacttctcatcaaatcagaccctggtgaagttgttaaacctgaccaattcaaggcgagtaacgatgaggggatgccaatttaccagaggcctttcatgaaggggaagctgtacatccatttcacggtggagttccctgactcgctggcaccagagcagtgcaaagctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatc

SEQ ID NO: 42693 - DNA, 413 bp, Zea mays
  unsure at all n locations
  Clone ID: LIB3062-013-Q1-K1-A11
ggtcttcggtacaagcgagcccgggcagcgtgtcgtgccgtacgtgctgtggaggcaaccggggtgcgcgaccccacaccggctagctacgacaacatgctgacgcccagatcgacgccgtgtacgccgncatgaaggccatggggcacacggacgtgggcgtccggatctcggagaccggngtggcgtccaggggcgacgaggacgagaccggggccacggtgcagaacgccgccgcgtacaacggcaacctcatgcacagggtcgccatgagccacgggacaccgctcaagcccaaagtgcgcgtgtacatgtacacgtgctcgctctttaaagcgagcacgtgaacccagcgcacacgtgagagcgcatctacggtctgctctaccacaacggctcgccggtgtacgctc

SEQ ID NO: 42694 - DNA, 403 bp, Zea mays
  Clone ID: LIB3062-013-Q1-K1-A12
tggcatcaccaagcatcagaatttcttccaaagatgaatgctggtttgatctttggtccaccagcactcgatggtcatgtcttgcgcgcattaattctgcgataacaggaccgatggttgcttggattatttcagattatggaccatttgcagtatgattgctcgagagaaatctggagctcctgttcagatccactttgtgacagcaaggcatgcttcagcatgaagatccatgtatgatacctctgaaaggtttacttaggcctagactcagtttgtctctgattctgtacattcttgatagattatatatttgctcaagaatgttgttcagtgcagcattcaactgcaaattttattgctggatgaatcgctatccactagtacataccgatttccaggc

SEQ ID NO: 42695 - DNA, 458 bp, Zea mays
  Clone ID: LIB3062-013-Q1-K1-A2
atcataaaggactttgatgaacctggtactcttgcaccaactggtcttttcgttggaggtacagaggacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcggcgattacctgatcgagcagggcttctaaaagttcgtcatgttctgttttggtcatttgggcaccaaagtttgcgcctcatttggttctgtaatccgtgagctcgtgcatgtacttggcgtattgcatgcagtgaataatttagcttgggtttgtttgttgggggcagtgttggggacggatttggattggggtttatgcttggcatcgcgtcgtatcgaaactcagctgctgtttcg

SEQ ID NO: 42696 - DNA, 459 bp, Zea mays
  Clone ID: LIB3062-013-Q1-K1-A4
ctttgctctcgcctcgcgcgctccccccccttcctccccgcgcgcatcgtgccgttcgccaccggagggcgccgatggaggtgggcgccgtgcccagatccgccgcggcctgccgtgcggcgcccctgctcccggccgttcgagccgctgcgtgccacctggccctgccccggcgcgcgttctccgcatccgtcgcggcggcaccggcgccgcgccgcctcgccgctcgtcgcgctgcggatggtgacagcgtggagacggcgccggaggcggtccccattgagaaaaggttccctcccttcccgagcgtcatggacatcaaccagatccgcgagatcctcccccacaggttcccattccttttggttgatagagtaattgaatacaaggctggagaatatgcagtggggatcaagaatgttacaataaatgataatttcttcccaggacattttcctg

SEQ ID NO: 42697 - DNA, 414 bp, Zea mays
  Clone ID: LIB3062-013-Q1-K1-A5
caaaaaacgaacttgaaacgaccgcgaagccacaagtcaaaggcggcggcggcgatggggagcgacacggagacggagaagaaggcctcggtggcgctgatgtccattgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaacatttctcctattgatgtgattacacatgttccgatactatgtgaggaagctaatgttccttacgtatatgttccatcaaaagaggatcttgcgaccgcaggaaccactaagaggccgacttgttgcgtcttggttctgaccaaaccaaacaagggg

SEQ ID NO: 42698 - DNA, 424 bp, Zea mays
  unsure at all n locations
  Clone ID: LIB3062-012-Q1-K1-H12
cagatgatggttacggcgtggtcgggatggaggcggacgcagacgcggacgcggacgaggagatgatggcgtgcggcggcggcggggagaagaagcggcgcctgagctccgagcaggtgcgcgcgctggagcggagcttcgaggtggagaacaagctggagccggagcgcaaggcgcggctggcgcgcgacctcggcctgcagccgcgccaggtcgccgtctggttccagaaccgccgcgcccgctggaagaccaagcagctggagcgcgactactccgcgctccgncagtcctacgacgcgctgcggcacgaccacgacgcgctgcgccgcgacaaggacgccctcctcgccgaggtagttgtcgacgttatgccgttatacaagctgctggacgagcacgatgacgcgcgcaatggctgacc

SEQ ID NO: 42699 - DNA, 423 bp, Zea mays
  Clone ID: LIB3062-012-Q1-K1-F8
ggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcagcggcggcggagctgctgtacctcgcctacaacggtgacaagga

SEQ ID NO: 42700 - DNA, 302 bp, Zea mays
  Clone ID: LIB3062-012-Q1-K1-F9
acccactcatccgaaggtctccaaacttctcccccccctctctccaattcctcttctcctcaacctcactggtcactttaaacacttgcgacgcctcctaatcatcaacactacctctacttctattacttacttcccttcaccaccatcaactaatctctcaacaatgccttcacctcctacatccatatcctctactccaaccacatcacacaccagcacacacatacctctatccacttcaactttcatacctactacttccagaactacattctcaacactatctagaacactaacta

SEQ ID NO: 42701 - DNA, 417 bp, Zea mays
  unsure at all n locations
  Clone ID: LIB3062-012-Q1-K1-G1
cggccatcgcgctgggcgcggtgctcatggccatcgctgtcgcgggcctcgccggcgcctgcttccgcgccacctggctgctatggctctacctcctcaccatgctcgtgttcatcgtcgcgctgctctgcttcaccgtcttcgccttcgccgtcaccaacaggggcgccggggaagccgtgtcgggggtaggctacagggagtaccgcctcggggactactccacctggctgcggcgccacgtcgaaagccgcaaggactgggcccggatccggagctgcctcgccgacgcgcacgtctgcaggcgcctggaggagagggagagcaaggacgcggcgggtctggctcggctcggcctgtccccggtcgagtccgggtgctgcaagccgnccacgagctgcaacttcacgtacaccg

SEQ ID NO: 42702 - DNA, 421 bp, Zea mays
  Clone ID: LIB3062-012-Q1-K1-G10
aaagattcagtgctctgattcttcttgggttgtctttctccggcagatctctaacgaggagatgttctctcttcttttcttttcttcttttttttgaaagcttccctgtaacctgaaatcggctttacttaaatttcgagccaacttaatcttcttctttgccaattcttttttaaagaagaaagttgagagatgcctgtagttttttttttgggtgtgtttgtgactccagagtctgaaatcacaaatcagagctgtatagggagcaggtgatgactgagtgactgacaaacgtggggaagatggagacaaagaaacgcaagcctgtggtctactaaagacgggggcatcgccatcgagggcaaacggaggccacaggattagcagcttctccgaactcccctctcgtgctgctgcgtct

SEQ ID NO: 42703 - DNA, 399 bp, Zea mays
  Clone ID: LIB3062-012-Q1-K1-G11
actagttctagatcgcgaactgtgcacttctgtagtcaaaaaaaaaaaaaaaaaaaaaggaaaaaaaaaaaaaaaaaaaaaaaaaaaaaaaaaaaaaaaaaaaaaaaaaaaaaaaaaaaaaaaaaataaaataaaataaaaaaaaaaaattaataattataataaaacaataataaaaataaagaaaaaaataaaacaaaaaactataaataaaattaaaaaaaaatgtttgagatatccatagtctaaaatcacaaatctagatcatctataagaaacaagattattgactgaagtgactgacaaacgttgtggaagatccaaaactaaaaaactcatgcctgtggaatactaaagactgctgcatcgttatcgacgtcaaacaaaagtcacatgatt

SEQ ID NO: 42704 - DNA, 326 bp, Zea mays
  Clone ID: LIB3062-012-Q1-K1-G2
cacagcgttggtggccttgattgcattcatgccaaccaaccctggtggggcattgggggcattggattacaaaaaggaagatagacgggcacttggtataaaatcacgtgaagcaccgccaaaatttgggtccccagaacgacaaaaactaattgatgagatccatgagcaaatgctcagtaaggctcctcctgtcccccaaacgctaccaaatgtgccaaacgaggagtctaacgaattacccgcatctgacccttctggcgagcatgcagacaaggtagatgaaggtaattcgttagactcctcgattggcacatataggttca

SEQ ID NO: 42705 - DNA, 433 bp, Zea mays
  Clone ID: LIB3062-012-Q1-K1-G4
caaccagtacaaggctacgattggggcggatttcctcaccaaggaggtgcagttcgaggacgaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaagatggaacgaacgtggaagatgccttccagtgtattgtaaagaatgctctgaa

SEQ ID NO: 42706 - DNA, 429 bp, Zea mays
  Clone ID: LIB3062-012-Q1-K1-G5
cgacgacgaccggcggcgagcgcgtccggacgacgttccccgaagacagcggcaggggtcggccgcccaccgacgtgccgggcgccaccgaggaagaggggggaggcgccggaggagacctcgagggcgtccggccgtacccggaaaacggcagcggcaggggccgcccgccgtggtactacacggccttccaccgcggcaggcagcaggagcaggagcagcgggacttcgggatgagcgacacgaggctgtaccagaacggccgctactactacgacgtggacgccggcaggtacggctacggccgcgagtcgaaccccatgcggacgcgccccgacgagggagagttcggctccgggtacggccgaccccgcggccccgccggtggcaggcgcggcagtagctacggcgacgcggcgggttaccagc

SEQ ID NO: 42707 - DNA, 429 bp, Zea mays
  Clone ID: LIB3062-012-Q1-K1-G6
gcagcagcaggaaccctagcaccgccgcatccgcagccatgggtatcgacctcgttggcggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccac

SEQ ID NO: 42708 - DNA, 428 bp, Zea mays
  Clone ID: LIB3062-012-Q1-K1-G7
aacaaaagcaaatgaagagtccttaacgaggaaagatatcatggagagagtggataaagggctatcagcttgtgatgaagagacttggcttgaggaatataaccaagatgataataggtatagtgctggcaggggtgcccacttgaatcttaagcgtgcagagaaggcaaggataactgtccaaaagattccaactatgattgacagcttgatagccaaaacttttgcatgggaggatgaaagaaatgtgccatttttatatgatgggattcgtttggttgccattttggaagagcaaaaactcagaagggcacaaagggaggaagagaagagacgcagccgggatcagaggaagctgcacagtttattgcttaaggagaaggagttgattttcgggtccaaacctagtcctagaaagacaagcagct

SEQ ID NO: 42709 - DNA, 427 bp, Zea mays
  unsure at all n locations
  Clone ID: LIB3062-012-Q1-K1-G8
caagggacaaggatggtgaggtgggagatgatgtgtttgatgaagaactggaggctgaggaaactgacaacccagagctagctgttaagcctgtttatgtcaaggacgacttctttgattccctctctagtggaacgtttggacgtggagggccaaatggaaggggaagaccttctgaacggcgcagagtagacacagagacgtttggtgaatttccgaggcacaggcagccctaccgtggtggcggccgaggctaccgtggcggtgggcgttcccgtggttcatattacggtggcagaggctatggaaacacggngaggggtggccctgggaattcttatcctcactggggcaatgggagagattgattatagcagcagcagccatactttgcggtgttgtagtcttttgccacatgcatgaagcg

SEQ ID NO: 42710 - DNA, 283 bp, Zea mays
  Clone ID: LIB3062-012-Q1-K1-G9
gattggtgttggtttctgtgggcttttacggttgttgttactctcatctccatctctggcaggaggctaccccaagcatgtagtagcttccattctgattctgggacggtgttgcacgttacagtgctctcaagctgtctctgcaaagtgtgtgtttttttattccatttccctcctgctcttgttctctccaactgcgcttacctgcccccgatttctctaaaaaatgtattaaactatctgagaaattcatccaactgcgagtactgtgctgtgcgtgagc

SEQ ID NO: 42711 - DNA, 429 bp, Zea mays
  Clone ID: LIB3062-012-Q1-K1-H1
cgcaagctttgtccacggttctgacggcctgggaaaccaggatttccctccaccggctggcaagcctatagatcagtccgctgctgccttcctggttgagcaagcaaatctgtaccctggacaagttaccattgttgctctcggtccactgaccaaccttgctctggcagtggagcttgacccttcgttcccgaagaagatagggcagattattattcttggaggtgcgtattcagttaatggaaatgtgaaccctgcagctgaggcaaatatctttggggatcctgatgcggcagatattgtgttcacctgcggtgctgatattttggccgtgggactaaatgtaacccaccaagtagttctaaccgatgctgacagggagaagcttgaacagtgtgatagcaaatatgcccgctacttatgcaagat

SEQ ID NO: 42712 - DNA, 340 bp, Zea mays
  Clone ID: LIB3062-012-Q1-K1-H10
cgaagtcaagattatcttactgggacttcaggggacagttctggagctgcgcaagagaaggttgcaacgctattggtcacagtaaccagagtggactcgacagctgggagacggcacaaaatacaagtacagcaccggtgccgcagggagacgtattcgtcaagaggttataacttggcggatcgattctttgcttgaaccagagaattcagaagtactaggcgaacgatgttgatgtcccagtgtgcatagagatttgcatgttgtagaacaaaaatcctgtgatgagagtggcataaaaacgcggatttggagagttcaaatttattaatagtgtcgg

SEQ ID NO: 42713 - DNA, 427 bp, Zea mays
  Clone ID: LIB3062-012-Q1-K1-H11
gcggaatgggaattgctattctttctacttctcgaggtataatgacagatcgagaagcgcgactaaacagaattgggggagaagttttatgttatatatggtaatggccccacctatagtacccaaattctatctcgaacttcctattttgaaaataaaaatagaaaaataggagaaaaatatatgacagaaaaaaaatagtagagaaaaaaaaaacccgagagaagcaaaagtcactttcgaaggtttagttacggaagccctacccaacggaatgttccgcgttcgcctagagaatgacacgatcatcctgggctatatttcaggaaagatccggtctagttctatacgaatactgatgggggatagggtcaaaattgaaataagtcgttatgattccagcaaaggtcgtataatttatagactt

SEQ ID NO: 42714 - DNA, 425 bp, Zea mays
  Clone ID: LIB3062-012-Q1-K1-F7
gctgcgggccagctcaaggagaacctcacgcggcggcattctgtttcggctgcgggccggctcaaggagaacctcacgcggtcgaaacagaatgccgctgcctaaatcaattgctcctcctggctcaattcccctcccgcctgatcatgacactctattggcccagaactaccaactcctgcctacgttgaagacgccacctcaatctgaggaaaacgaggcttagaatgaagaatccaacccaagtatgacaccgaatccggcaaattctaatcctaccttctcgtaggatcagcgtagtaacgagcaacagcacactcctcagcatggacagagggtttcattccaactcaatgctttggcagctgctgctgcatagcgacctcggatgaccgtcgaccagctgaacatctgctaaccatcat

SEQ ID NO: 42715 - DNA, 430 bp, Zea mays
  Clone ID: LIB3062-012-Q1-K1-E2
atgtagttctgcgatcacatttctgaggaatagaatggataggcctcgaaagcgtggtgcagactcattatccagccgggctgccctgatgcttgatgcagaaagagaaccagaaaagacatggagccccatagttgaaatacattatgtagggggaacttatagaggtagatgtcaagaaggtgtccctgaaggaaagggacgtctaaccttcagtgacggaagcttttatgatggactctggaggtatggtaagagatctggtttggggactctatttcacagtaacggtgatgtataccatggaacgtggagggatgaccttattcatggaaagggctggtactattttcacagcggtgaccgctggtttgcaaatttttggaagggcaaggctaatggtgagggtagattttatgccaatgatggg

SEQ ID NO: 42716 - DNA, 429 bp, Zea mays
  unsure at all n locations
  Clone ID: LIB3062-012-Q1-K1-E3
gttgattccagatcatcaaatgcaattctttctggaaatggcttcacagatcaatttagcatcattcaaggggttagtggcgtacctggttcaggcaaaataagaaacaccctagataatggcttcttaggtgaagttcgaactgggcagccatctgtgctcacagctgctgcgaatggagcaagacatgacaaaggtacaaataatgtcatacagggttatggtggaaagcaacaagggaggtcaactgggatggcttacctttccagaagatgaagtagttttcactcgacgcaattggttttgagggtggtgaagctgttggaaaccatacaagtggcattgttttggcctccaaacggccgatgctgaagatgacctgnattaaagttattctagatttattttttttgttgcaccattgctatt

SEQ ID NO: 42717 - DNA, 417 bp, Zea mays
  unsure at all n locations
  Clone ID: LIB3062-012-Q1-K1-E4
tgacattaacacaagctctagattcccaagccaaggagttaaggtgcgtgaccgagtcaatcaatcgtaccagggaacccataaacattaccagagacgataggttttctcagcaccgcccactggaagaccatgtccctcctgttacgaggaatggggcaattaacagttcatggagatcttctcagcaaactaacatgtatggtgtgtcacatggtgactttggttccgcaaggtctgcttcattcgtgccagcacctgctgaacctacagctggatcattttcaaaatcttgtgccgagcagacgtccaccgctgcacaacgagcggataggtcctctggcggtaagccatgggagatgcagcagtattcgcagcagaggcctggttatggatccaactnccagttgaatgatg

SEQ ID NO: 42718 - DNA, 426 bp, Zea mays
  Clone ID: LIB3062-012-Q1-K1-E5
gcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaac

SEQ ID NO: 42719 - DNA, 429 bp, Zea mays
  Clone ID: LIB3062-012-Q1-K1-E6
ggccccggtaaccttacttacagaaggtgttaaagttagtccagcagttttgcagtctgctggtttgaacttgaaacagatatacacaaggtcattgattgctgcatgctgcttccatgcataccaacaggtgtcatacatgatcctcgccagggtatccccagtcacacattcagtgggcaattgcgtcaagcgtgtggtggtcattgtgacctcggttctgttcttcaggacccctgtttctcccatcaactcactcggtaccgggatcgctcttgctggagttttcctatactcgcaattgaagaggcttaagcccaagcccaaggctgcttgatcatagacctttgcaggtccatccaatagaacttttgaagttatgctatgccattggaatgattagtgagtgccgtagttagaatgatgttt

SEQ ID NO: 42720 - DNA, 432 bp, Zea mays
  Clone ID: LIB3062-012-Q1-K1-E8
cttgtcaaaaaggttaagaaatctgtgccaaccttgcgcatactgaacgcaaagccccgagaggccacctccaagagtgatacgaggtctacaaaagagaatcctcctagcaaagatgaagaccccattgggattgatgcaaagaaggataaaaggaagggatctaaacaagaggtaaagggccttgaagagcttgaagtccagagtgtttctacaggtatcaccacttcgaaccctggtaaacttgaagtgccagacggtaaggaaaagaaaaaggtcaaggaagctaagacgaagaaatctgaagagccgtaccatgccaataacagtagcttaaagaacaaagaagttcaatcttttgtctatgataccagcacgaaggacaagaaggaagccaagaggaagaaatttgttgacgaagaagatgtagat

SEQ ID NO: 42721 - DNA, 373 bp, Zea mays
  Clone ID: LIB3062-012-Q1-K1-E9
ggcgtttcttcatgattaaactttggaaccataacattttagatgcccgcactatgaagacatgcaatacagtccttcaaattttacaagaagaaagcacaggactaaagtaattttgatgcttctgatgaaaattcaagggaagaagatttctttaccatttccaagaagaaagcatagaattggagtaactttttattgataatttcattcatatctattgtcaattgtattaatggtttttaaaagagacaaatcatgtctaactctcacgctgtaatattctaagtcgtacgtgaatttgatgaatattcattgttgttttacttaagagttatcgtattgagatccttaacatattattttatttttc

SEQ ID NO: 42722 - DNA, 411 bp, Zea mays
  Clone ID: LIB3062-012-Q1-K1-F1
cgccagcaagaagcgcgagggctccagccactccaacatgcaccggtcccgggcttctagggggccttaacaaactggtgagccttaccaaaggctgggccggcccaaaggccgcgggttaccaatggcgccggcaaggaaccggcggcggcggccacaaagcccgaccacaaccccggccccaacccgaggcttcgtcctaatgaggctgttcgacgtggtgtcggcgctcaagtcggggtacgtgaagctgcagcgggcgcacttcccgtacgaccccgacagggtggcctcggccgacgaggccgtggcgtcggagctcgactcggtggccgcgctgcattgcctgtgcagctcccgccgcgggatcgggccgctggtagacgaccggtggtccctggtgcagcgcct

SEQ ID NO: 42723 - DNA, 345 bp, Zea mays
  Clone ID: LIB3062-012-Q1-K1-F10
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccg

SEQ ID NO: 42724 - DNA, 431 bp, Zea mays
  Clone ID: LIB3062-012-Q1-K1-F2
cgcaaactttgtcgacgaggttggggcggaagtcgaggaggttctcgaggacagcgaggttgttgttgaacacgtcacgcgataccgccgaggcgtggtcagcgtcgcggagctcccggagcatcagcacgtgtgcgcagaacccgagcgagagcgcgccggtggccgtgcaggcgccgagcacgctctgcacggtgtaggcgtcgggcctgtcgcgcttgagtgcgtcgaggagcaccagcttccggaattgctttgtcgcttccatctggaccaccgtgtagaggctccatttccagagtactgcacggtcgggctccgattcggaaccagagtcggtaacggagccgacgcggaaagagtcggtggcggtgcagtcagacgagagcgcgatgatgcgctcgtcgtcgtcgcagggcgaggacgggacg

SEQ ID NO: 42725 - DNA, 426 bp, Zea mays
  unsure at all n locations
  Clone ID: LIB3062-012-Q1-K1-F3
gcgccactgtccagtgcgcgcgtcaagcttgcttagctagccgccatggcctccctcggcgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctnctgccgatcaag

SEQ ID NO: 42726 - DNA, 432 bp, Zea mays
  Clone ID: LIB3062-012-Q1-K1-F4
gagggatgatgctattaaagatcttaatagagctatggagattggggatgagaatgcggttgaaaaatttagtaaaaggactgtcaaggttacaggaaggcataatgatgactgcaagaggctgttaaggttgatgggtgtccctgtagttgaggcaccaggtgaggctgaagcacagtgtgcagcactttgtgaaaatcaccaggtttatgctgtagcttcagaggacatggacacactgacttttggtgcccgaaggtttcttcgtcacttaactgaccttggttataagaaatctcctgtgacagaatttgatgtgtcaaaggttttggaagaacttggactcacgatggatcagttcattgacttgtgtatccttagtggatgtgattactgtgagaatattagaggtatcggaggacaaagagcctt

SEQ ID NO: 42727 - DNA, 418 bp, Zea mays
  Clone ID: LIB3062-012-Q1-K1-F5
caacgcatctgcacttccttctcctacaaaatcgcagcagcacttcttcctccacgtggcaaatcaaagcaggaccagcgcgcgcgcagtgatctagggcgaagcaaagcgaggaacagggaccgtctcgttgggcccggaaaactggcgagatcgatggacgctgccgcggaggcctcaacgccgtcgtccccgtcgaagctgcgcgacaagctgcggaccacggtgtgctgctgcttcggcgtggagagggctcggtggcggcggcggcggggggcggcgacggccgcgggcgagttccgctacgacccgctgagctacgcgctcaacttcgacgagggcgaggacgacgacgcgtacgcggaccccaccgcggccttccggtacaggaacttcaacgcgcgccttccgccctcgc

SEQ ID NO: 42728 - DNA, 357 bp, Zea mays
  Clone ID: LIB3062-012-Q1-K1-F6
aggatttcaaggttggggatcttgtgtgggggatgaccggatgggaggagtacactctgatccataacccggagtcatttttcaagatcaatcatcctgaattgcctctgtcctactacacaggcgttcttggcatgccgggccttactgcttgggctggatttttcgatgtgggcaagcccaagaaaggcgactgtgtcttcgtctcagcagcatcaggagccgttggtcagcttgttgggcagtttgctaagctcacaggatgttatgttgtcggcagtgctggttctgacgagaaggttaatcttctgaaaacaaagtttggattcgatgaagcattcaactacaagaaagagc

SEQ ID NO: 42729 - DNA, 416 bp, Zea mays
  Clone ID: LIB3062-012-Q1-K1-E12
ctattgccctaatcatctacacattcattgcagtttggtttgttggtggcctctctgggttccatctgtatctcatgagcacaaatcagacaacatatgagaacttcaggtatcgctatgatcagcgagacaacccatacaacaagggagtcatggaaaacatcaaagagatcttctttacaacgatccctccttccaagaacaacttctgtggtagggtcgaacaggagcatggtctgaggccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccaca

SEQ ID NO: 42730 - DNA, 440 bp, Zea mays
  Clone ID: LIB3062-012-Q1-K1-D1
ctcgcgtatgccttcccagatccatcgactcgctcgggccgcccctcccgtcgtccccgttcgaaggtgcggcagccggcaagcgaacgatttcattcgacatgaatcccgagtagtaaggcctccgatcatccttcccttcagtttccttccgctgtcttccgcgttcgtgaccgtgatctatgtagcttttgctttcgtaattccgttggatttttcgtttgttgctgtggttgcgttgttcggatgggactttacggagatctgatcggatgcacgctggttgctcccaccagatttcgatctggatctgggaatctgtgttccaaatcgggattccctgaatgaaagggcctcctgcggccccggtgctttggtctgcccgcatgcagaaatttatgtactgcgccatgcaccttcgatggatgtgttcgctctcc

SEQ ID NO: 42731 - DNA, 385 bp, Zea mays
  Clone ID: LIB3062-012-Q1-K1-D10
cacacatacacaagcacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaagaagagcggtaccgcatcagccccgtgtcctacctcctggtggacggcatccctcacgaggaccacatgaaccacac

SEQ ID NO: 42732 - DNA, 445 bp, Zea mays
  Clone ID: LIB3062-012-Q1-K1-D11
ctagcaaccagctagctcgggcggcagcaggcagccatcatgtcggaggagaagcaccaccacttcttcaaccgccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaagtcgctgccgcggcggccgtcggcgccggcggctacgtattccacgagcaccacgagaagaagaaggaccacaaggacgccgaggaggccagcggcgagaagaagcaccaccacctcttcggctgaccgtagtacc

SEQ ID NO: 42733 - DNA, 287 bp, Zea mays
  Clone ID: LIB3062-012-Q1-K1-D12
atgcccgtcgctgtcgtccacctgtttttttcgttgatccgcagccgccccttcctgctcccatttcggcgtctcgaagccagtagattattcatttctcgatccacaaatccctccacactctccatcccgaaccctgaaatcgaggagcgcaggaggacgccgcaaagcgcgttggctcttagggtttgccggtagggttgggaggctccgacccgcgcgcacacgtgtgaatattcgagatctccgatatgctctagatgtagaacacgacgagcgagaggagc

SEQ ID NO: 42734 - DNA, 393 bp, Zea mays
  unsure at all n locations
  Clone ID: LIB3062-012-Q1-K1-D2
cggacgcgtgggctcgtcacttcgcttccccacttctccattccattgcggttctgcgagccgctacctccctgtggtgcttggccatggcggactaccacttcgtgtataaggacgtggagggggcgagcacagagtgggacgacatccagcgccgcctcgggaacttgcccccgaagccggagcccttcaagccgccgcccttcgccccgaaggttgacgccgacgagcagcccaagtccaaggaatggcttgacgtgcgcgagcccgaagagctcgaggaactagaggacgatctggatgacgaccgcttcctcgagaagtacaggaagatgaggctcgcagagctganggaaagccgaaaagccgcgcgatttggtactatacttccca

SEQ ID NO: 42735 - DNA, 423 bp, Zea mays
  unsure at all n locations
  Clone ID: LIB3062-012-Q1-K1-D4
gatggaagcaggcggcggccacggccacgaccggcagcttgtcaccgtaacagcagcggagggcgaggagccggcggtctgacctgttcctacttctacttcctagttgcgcgcgtgtcccgtgaggcgggagctctggaggccatggagagggagccggcggtcgaggaggaggacgacgaggaggaggaggaggtggcgtgcgagtgctgcggcttcacggaggagtgcacggcgccgtacatcgcgggcgtgcgcgcgcggttcggcgggcggtggatctgcgggctgtgcggggacgcggtgggcgaggagctggggcgcgcggggaccccgcccatctcccccgccgaggcgctggaccgncacgcccgcgcctgccgcggggcgtccgcgccgccgtcgcccgcgggcagccccgac

SEQ ID NO: 42736 - DNA, 422 bp, Zea mays
  unsure at all n locations
  Clone ID: LIB3062-012-Q1-K1-D5
actaaaggcacaagccgacatatggcggctcagcctctcctacctcacgcccctgtcgctgaggtgcgccgtggagcttggcatccccacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagcacggaggaggagcggtaccgcatcagccccgtgtcctacctcctggtggacggcatccctcacgaggaccacatgaaccacaccgctctggtgctcacctgcacctcgacgcgctacatcgaggcggngatagggctggcggagtggttcaagagggacgtggtcacgtcaccgttcgaggagctgcacg

SEQ ID NO: 42737 - DNA, 427 bp, Zea mays
  Clone ID: LIB3062-012-Q1-K1-D6
gttggaaccctccgggtcgacattcttgggcctggatgacaacaggttgtgtagatgggatatgcgcgacgccagaggccgggtgcagacaatcggtagctcatcagactcaccagtgctgaactggtcacagggtcatcagttctcgcggggcaccaatttccagtgctttgcaagtactggggatggttcaatcgttgttggttctgtggatggcaagatcagactctattctaagagctcgatgcgtatggcgaagacagcattcccaggccttgggtccccgattacacatgtagatgttacttatgatgggaaatggattctgggaacaactgacacatacttgatcttgatatgcactatcttcaaggacaaagatgggaaagaaaagactgggtttagtggccgaatggggaataggatt

SEQ ID NO: 42738 - DNA, 425 bp, Zea mays
  Clone ID: LIB3062-012-Q1-K1-D7
caaaaaaaaaaacaaaaaaaaaaaaaaaaaaacaaaaaaaaaaaaaaaaactaaatggcgagctcaaacctacatgcacatataccatggacctcattccgcggagtctctcactcactgccatacgcgatcatcaatcgccatcggcaccgctcgacctctcttgtaccttcatcgacacgcaacgcctaagataatccacagaagcgtcaaggccaccaacgtgctgctggattcatacttctcggcgcacgctggcgatttcggtctgacaaggcttattcccgacgaccgaacggaccacgcaaagatagccagcagctatagccagctaagctaccttgctcccgagtacgcctacatgttctgcaaaccaactgcatgctgcgatgtatacagcttcaggatcatactgctggagcttg

SEQ ID NO: 42739 - DNA, 440 bp, Zea mays
  Clone ID: LIB3062-012-Q1-K1-D9
gtcgcgacatcgccatcctttgccaacaggctgccccacatctacaagaaccctgactcgtatgaccctgatcgggtcggtcctggaagggaggaggacaaggctgcaggcgccttctcatacatctccttcggtggcggcaggcatgggtgcctcggtgagcccttcgcctacctgcagatcaaggcaatctggacgcacctactgaggaactttgagttcgagctggtatcgccattcccagagaacgactggaacgccatggtggttggcatcaagggcgaggtgatggttaactacaagaggcggaagcttgccgtggacaactaagattgtggccgcagtctctagatgcttgcttcttgttgattcaattgttttcacatgtttgtcagcatttgttcagtgcaagttctgctgtacgcaagccagccttgtta

SEQ ID NO: 42740 - DNA, 418 bp, Zea mays
  Clone ID: LIB3062-012-Q1-K1-E1
ggggaacaaaaaggaagggcgaggaggacagggagccgagcgcaagagctgaggcttggccgcgaaaccccagacctcgcgccgccccttcccctccgcggcgtcgtcctcgcacgctctccgatccaagatgtataagctggggagaggaaaccgcgacaaggtgcagcagttcatgaccattaccggcgccaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctacaggttgatcctcaggatattgtcatgcttgtcatatcatggcacatgaaag

SEQ ID NO: 42741 - DNA, 441 bp, Zea mays
  Clone ID: LIB3062-012-Q1-K1-E10
cgagttcgcaaccacgggagtcatcatacggttctaagagacagcagggcacggaagtttcagcagaaaagcagcggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccagcatcggctgccccggtgctttctggaactccggctaccagcacttccaaagcaccaggccttctgtcaatcttctcagatgatgtaccaaccggagtgactagtgtgtccaccg

SEQ ID NO: 42742 - DNA, 426 bp, Zea mays
  Clone ID: LIB3062-012-Q1-K1-E11
gaagttcagagatctgtttgttacctggaatccggtattgatagagaatgaaggttcagatcttggtgatgaagactggctgttcagcagtaaaaggaactccgatgctatcatggttcaaagcagagctactgatagttcagtgccgatccatccaatggtgcagcagaagccttctttacaacccagggcaacatttttgccggaccttaatatgtaccagctgccatatgtcgtaccattttaaacatctggcgaggtagatgagaattagatgagatgttgggagagagctgtgtggatgtgggagataatgggttccctgccgcagttttccagctttgttccatagtgtttctttgaggccaatagagttctggcagaacttataatgtaatattgattaattatttcgctcatgtatgt

SEQ ID NO: 42743 - DNA, 426 bp, Zea mays
  Clone ID: LIB3062-012-Q1-K1-C9
gagcaagtggggcattactggctagagctgggaaggcgatccaagtaccagttgcacatggtgatagccatactgtcatacatcctcttcgggctgctgccaccagtcatctacggactgtcattcaggacgagcgacaacagagagaacaaagtgctggtggtcgctgctgcatctctcctgtgcattgcgctgctcgcaatcgggaaggcacatgttaagaggcataggacatacctcacaaccctcctctactacctgtccattggattcagcagctccggactgtcgtacgtcgcaggcgtcctcctcgcgaaggtcctagcacacttcggtatcattgatcagggtggtgcatcagctcctgctcctccaggtctctcattccctgaagcagccgcctgggcttcctactgagactggagc

SEQ ID NO: 42744 - DNA, 427 bp, Zea mays
  Clone ID: LIB3062-012-Q1-K1-B3
gcaaccccgtcgtcttccgccatgatccggttcatcctgctgcagaaccggcaggggaggacacggctggccaagtactatgtcgctctcgaggactccgagaagcacaaggttgagtacgaggtgcatcggctcgtggtcaaccgggaccccaagttcaccaacttcgtcgagttccgtacgcacaaagttatctataggagatatgcaggactttttttctctatatgtgtggacatcaccgacaacgaattggcatacttggaatgtatccatctgtttgtcgagatattggaccatttcttcagcaatgtgtgtgaacttgatttagtatttaatttccacaaggtttacttgatattggatgagttcattcttgctggagagcttcaagaaacaagcaaaagggcaattatagagaggatgg

SEQ ID NO: 42745 - DNA, 219 bp, Zea mays
  Clone ID: LIB3062-012-Q1-K1-B4
ccggcgtgccggacacgtggaacgagctgctctactggaagctcttcttccccagcaacgatgaggttctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctc

SEQ ID NO: 42746 - DNA, 423 bp, Zea mays
  Clone ID: LIB3062-012-Q1-K1-B5
aaggatggcgtgctcgagcagatcggtagcgggaagggctatgtggacatgtccactggtgacgctgcaacttcgaccaagattagcgaggcagttaaacaaaaagggggagctttccttgaagctccagtttcagggagcaagaagccagctgaagatggccaattggtcattcttgctgcagggaacaagccattgtatgatggtatgattcctgcatttgatgtactggggaagaagtcattctttctgggagagattggaaatggggcaaagatgaagcttgtggtcaacatggtcatgggaagtatgatgaattctttgtccgagggactctgtttggccgacaaaagtgggctgagcccccaaacacttcttgatgtactggaccttggtgccatcgcaaacccaatgttcaagctg

SEQ ID NO: 42747 - DNA, 430 bp, Zea mays
  Clone ID: LIB3062-012-Q1-K1-B6
cccacacaggcagttgtcaccctcaaatcggataatcaggtctacttctggaaatgatggtgtcaattccaggagtccgtttgataatattcaacagaagaaattagcagcgcttggagccaatgcagcgcgaaggcctttcaaagattttctcagtacattgacaagaaccaaagaaagtatatcgcgcgcgacacgtcttgctatggaatgtgctaaatttggcattctggtgatgtatgatgcctttggtgttaggctacatgtagggaagcaagcagaggtcttgaaccagattgtgtatgagcttccatcagaacatccactggctgaaacaagaccactgcgagagctgctagggcacacacctccacaggtatttgctggcggagtgcttggatttgcagtagccacatttacagcgatgatc

SEQ ID NO: 42748 - DNA, 422 bp, Zea mays
  Clone ID: LIB3062-012-Q1-K1-B7
ctctgcactccaatcagatcatcagatagatcactggccccgtgctgattaccgggcgtcccatctgagcagccagcctcccaggctacagggagagacgcagaggagacagctgctgcctggctgagacgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgcttcgcgggtgcggcgcggtgacgatcaacgcgagcaagaacgggcagatcacgttcccgggcgtggcgatcgtgtgggggctagcggtgatggtgatggtgtacgccgtgggccacatc

SEQ ID NO: 42749 - DNA, 427 bp, Zea mays
  Clone ID: LIB3062-012-Q1-K1-B8
agcgcagatcgagtcatcaagctagctagcccggagcacgcctagacacgccagcagcggtggcggctcagctggccgtcgcgtttctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgccctacggcgagaccttctttggccgcgccacctgccgctgctccgacggccgcctcgtcgtcgacttcctggccgagaagttcgggctaccgctgctgaagccgtcgaagcagggcggctcagacttcaagcagggcgccaacatggcgatcattggcgcgaccaccatggactcgggcttcttccagtctctgggcat

SEQ ID NO: 42750 - DNA, 206 bp, Zea mays
  Clone ID: LIB3062-012-Q1-K1-B9
ccacctactctcacacctttttccacccactatataccttcactcccaccgtgcttattaaaaccacccgagcatctccaatcaaacacacaaacccaaccccctaacaacacccaaacccaacaacaaccactactactacacaaatcttacatatctacacaacaacaaatatcaacaaaaaccactcaatcaacttaatgcca

SEQ ID NO: 42751 - DNA, 414 bp, Zea mays
  Clone ID: LIB3062-012-Q1-K1-C1
gacacatgtatggtgatgcttctatttctctttgaaactgaaacttcaggtgtgcctagctaaaggtttaggcgtgcccattggattcaaaggcttctgtatatctatcgagcacgtttatagatttactgatcagattgataacatcacacacacacgaagttcatcttcaacatgcttagtattattatgcatctgatggtatggtattgtctctgatagatccatttgctgaggctaatgctgaggagtctggtgttggtcttggaacgaaggattatgtgcatatgcgcatctaagagcgcaacgatagaaagagtctgactacagtccagggtctgaacaaagaattcagctataacaagaacctcattgatctgaagaaggaattctgctgcaatggtactgaagttc

SEQ ID NO: 42752 - DNA, 428 bp, Zea mays
  Clone ID: LIB3062-012-Q1-K1-C11
cacggacacacaacttctccatacacgccgtagccatggcttccgctgcgcagaagaagatggcaattgtttgcttgatgctgctggccgtcgtcggccaaatcgtcgctgatgctgatgttaccgtagaacatcccagccgcatctgcaccgaaacggtgattgatcctcgtgttcccaacaacgagtgcatctgctccaagaactgcgcctgtgccggtaagtgcatccttgagtcggctgatgctgtccagacctgctttgtcgactgcgtcctcaagaacgactgcatctgcagcagcaagatcatccccggcgctgacgacccaaaggctaatgccaagtgaagtagtactgctatcatcccgaataatgtcgtacgtatagtacctgctgaataaacctcccatgcaccaacagggagagag

SEQ ID NO: 42753 - DNA, 425 bp, Zea mays
  Clone ID: LIB3062-012-Q1-K1-C12
ggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtg

SEQ ID NO: 42754 - DNA, 428 bp, Zea mays
  Clone ID: LIB3062-012-Q1-K1-C2
gttttaagggtattggcaaagattctataatattgagttggctgcattcttttggtaagcagttttatagatcagtatctaaatcagattacaccacaatgcgtcttggttttatcatgactcactgccctggaaatccaaaatttgatttccatagatacatggtaagggttttagaggcggattttaagaaagtggtaggcataagctggtacttgtgggtcttcgtggtgatatttctgttgctgaatgttaatggctggcacacatacttttggattgctttccttccccttattcttctgttagccattggcactaagctggagcatgtcatagctcagctagcccatgatgtagctgagaagcacacagcggtcgagggcgatgtgatcgtaaaaccatcagatgaacacttctggttcggc

SEQ ID NO: 42755 - DNA, 422 bp, Zea mays
  Clone ID: LIB3062-012-Q1-K1-C3
gttgtaagggtattgacacagattctattatattgagttggctgcattcttttgctaaggaggtttataaatcagggtcgaagtcatattacaccacaatgcgtcttggttttatcatgactcactgccctgtaaatccaaaatttgatttccatcgatacatggttagggtcttagatgcggattctaataaagtctacggcatcagctgctacttgtgggtcttcttagcgatatctctcgctcatgactgattatgcttgtcacacatacttttggattgctcaccttccccttattcttctgatagccattggcactaagcttgcgcatgtcatagctcacctagcccatgatgtatctgagaaccacactgctgtcgacagcgaattgatcgtaaaaccatcagatgaacactttct

SEQ ID NO: 42756 - DNA, 358 bp, Zea mays
  Clone ID: LIB3062-012-Q1-K1-C4
gatggaccaactcatttcatttaacaaatcaaataataaagtgaggggtgagaagatgtactttctcattcctcaaacaagcacgctataatacatttgtttaacttcttggtatttacatatggtctagataaccacgcataatcacaccacgtgatctggaactgggcactaagaaatatattgtgcagagtgcagactacagaattacaacaatagctttgaactataaattgaccagagattcagaggagcattactggcagtggacaaaacgtggtgcagtctctgcatcctgccactgtgttccacccattttgcattggccaaaatatcctactaccggatcaatgttctg

SEQ ID NO: 42757 - DNA, 429 bp, Zea mays
  Clone ID: LIB3062-012-Q1-K1-C6
gtcgagtgcgtgctgccggtcaacacggaggccacccccaaggcgcagggcgtcttccgacgtcgacatgatcatgctcgcgcacaaccccggcggcaaggagcggtacgagcgcgagttccgcgagctcgcaaagggcgccggcttctccgggttcaaggccacctacatctacgccaacgcctgggccatcgagttcatcaagtgaaccaccgtcgccgcgatgagatggcatggctgccacatgctttgcttgcttggtcctcgtatcgtacgtcgccgtcgtcgtcttcttctggttattgcgctgctacctcgctgctctcgcgtatgcatgtacttttgcttaattttctttcttcatatcatgcactctggctggcctagactgcccccgatccatggtggccggtacgtcttgtcgagctc

SEQ ID NO: 42758 - DNA, 431 bp, Zea mays
  Clone ID: LIB3062-012-Q1-K1-C8
ctatgcgcgtccagcgtctgctgaggctgaggatggcgtcccgctcgtgctcccgctgcgctgccttggcgccgcacgctgcgctcccgctctcctctctcctcgccccctcgccctctgccgcgcgccctcgatccgcgcccctctcgtgcgcagctcggccgtgcaggggccacgcggcggcgtcagcgttgcacggcgcggcagggcggaggcccccgagcgtggcggcgatgtcgtcgtcgacgccgccgccgggatccgtgcagaagtcggaagaggagtgggaggccatcctcacgccggagcagttcaacatcctacgcctcaagggcaccgagtaccctggaacgggtgagtacgacaagttctttgaggagggcatttataaatgtgctggatgtggaactcccttatacaaatcatcgaca

SEQ ID NO: 42759 - DNA, 444 bp, Zea mays
  unsure at all n locations
  Clone ID: LIB3062-012-Q1-K1-B2
tcttgacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcagccccaccgtcgactgcaccaagatcaactgatcgatgg

SEQ ID NO: 42760 - DNA, 168 bp, Zea mays
  Clone ID: LIB3062-011-Q1-K1-H12
tcttgtacacggaataagctcaatgattcaaaatatcctatggttcctgcgcatgagatagctggagttgtaactaacgtcaatgcagatgacaaacgctttaaagaggttgaccatgaaaataatgtaacatatgtgaactgttgccgtgattgtaagaactgaaat

SEQ ID NO: 42761 - DNA, 395 bp, Zea mays
  Clone ID: LIB3062-011-Q1-K1-H3
cgagagccgaccgtctcagtgtgcgcgcgaagaagagaaggaggaggaagaagaagaagaatgtatccggccaagcccaccgtcgccaccgccagcgagccggtcaccgggatggcggcgccgccggtgaccggcatccccatcagcagccccggccccgccgtcgcggccagccagtggtcctcgggcctctgcgcctgcttcgacgactgcggcctctgctgcatgacgtgctggtgcccgtgcgtgacgttcgggcggatcgcggaggtcgtggaccgcggcgcgacgtcgtgcgcggcggcgggggccatctacacgctgctggcctgcttcacggggttccagtgccactggatctactcctgcacgtaccgctccaagatgcgcgcgca

SEQ ID NO: 42762 - DNA, 405 bp, Zea mays
  Clone ID: LIB3062-011-Q1-K1-H6
agaaattgttttattctggggaaggggctgattcaaggagagatgacccagaggtcaagagcttaattgaggagattgagaaaatgagggaatcgttcgagtctatagaaaggccaacactaagcatagaatctgagaaagcaaaaccactacctgttgagggatcgaaactgagtccttcacctcttcaggctcctgctaccccaaaagctgcacacgttgactcaccaaaatctcccatgaaacctgagcagcatttcgattcagatgcggagcttgcaaccctgggatcagagatcgggaaagaagacaaagagtactcagttgaggagataagcgggtgggagtttgacgagctcgaagaggaccttaagagctgacacaaagaatcgacaaacagaacac

SEQ ID NO: 42763 - DNA, 433 bp, Zea mays
  Clone ID: LIB3062-011-Q1-K1-H8
ggacccacgcgtccgccgctgctcgcctcgggtcaaaccctaagcagggagttgatttatccgctgcagccgtgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtgccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccg

SEQ ID NO: 42764 - DNA, 428 bp, Zea mays
  unsure at all n locations
  Clone ID: LIB3062-011-Q1-K1-H9
cactgatgtgcacgaaagccaccagtgtgaagctgttggaagagttgctgacatcatacagattccagccttcctctgtcgccagactgatcttctagtggctgctgctaagactggaaaaattatcaatatcaagaaaggacaattctgtgcgccttctgttatggtgaactctacagagaaagtaaggcttgctgggaatccaaatgtgatggtctgtgagcgtggtaccatgtttggctacaatgatctatttgttgacccaaggaaccttgagtggctgagggaaagcaactgcccagttgtagctgatgtaacacatgctctacagcaaccagctggaagaaagcttgatggtggaggtgttgcaagcggtgggctacgagaactaataccgtgcattgcanggacttctgtttgctgtggtg

SEQ ID NO: 42765 - DNA, 57 bp, Zea mays
  Clone ID: LIB3062-012-Q1-K1-A1
acgcttgttcacctcactaacaacagctagcaactctttctctcctgcaataatggc

SEQ ID NO: 42766 - DNA, 425 bp, Zea mays
  Clone ID: LIB3062-012-Q1-K1-A10
ctcctctctcgcatccgcagcctctcgagctctactccatcccctcgatctcgaagcgcgagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcac

SEQ ID NO: 42767 - DNA, 425 bp, Zea mays
  Clone ID: LIB3062-012-Q1-K1-A12
cggacgcgtggggaatttaagaagcataaatgcatacataaaagatatgcttaccacgtggtgctaaaaaccttggatttgctgcgatcgatgccttcccttgttgatgtggatgttccaaacggtggacattttacagtttgcggtgatgtgcatggccagtactttgatttgctcaacatatttgacctcaatggccttccatcagaagaaaatccttacctcttcaatggcgattttgtggaccgaggatctttctccgttgaagtcatactcaccctttttgctttcaagtgcctctacccaaaagctatgtaccttgcaagaggaaatcatgaaagcaagagcatgaacaaaatatatggctttgagggggaagtgaggtcaaagctgggtgagaagtttgttgaactttttgctgaagt

SEQ ID NO: 42768 - DNA, 348 bp, Zea mays
  Clone ID: LIB3062-012-Q1-K1-A2
cggacgcgtgggcgagatgatccgtgaggccgatgttgacggcgacggccagatcaaggacgaagagttcgtcaaggtcatgatggccaagtgaggagccgtccccgttatctatgaattgaagttaaatatcaggcacacaagctgtactttgccatgtcccttttgagtacacatcagtatcatgcaggaggtaatgtctagtagtggtcggtttaggtggtgtagtcatgggaactcgacatcagatacctggtctcttttgattgtgatgttatcttgcattattgctcctgctggagcttttaggatttgttgtaagctcaaaaaaaaaaaaagatataaaaa

SEQ ID NO: 42769 - DNA, 427 bp, Zea mays
  unsure at all n locations
  Clone ID: LIB3062-012-Q1-K1-A5
ngctcttctacgtggcggcgttcacgcacgtgctgcacctggccgcgcatgccggggtggggtacaacatggaggcgccgcagacgtacgtggcgtccaacgtggccgggctcgtcagcgtcttggaggtggcggacaagcacgccgaacccgaaaccgctgtcctttgggcctctgactctgtcccgtaccggcttaacaccgagacgcgcccttctccgatgaccaccgcaccgaccgaccggcgtcgctgtacgcggtcaccaagaaggccggtgaggccatcgcgcacgcctacaaccacatctacgggctctccatcaccggcctccgcttcttcaccgtgtacgggccgtggggctcgtcccgacatggcctacttcttcttcgcccgcagcatcatgaccggcgagcccgttacgctgtt

SEQ ID NO: 42770 - DNA, 254 bp, Zea mays
  Clone ID: LIB3062-012-Q1-K1-A6
acccactcaaccgcactcttatacataatttaatacacacttttgcttaccttaaacattcctccggggggctatataaaaacctatggtcctgcagacgaacgttgccttcaatttttcctatctactttacatactttatatattttacaatcactcctactctcaatcgccagtactctgatcctcttactatatcttataccaactcaataccatcacaccattatccttacatcatcactcccaactat

SEQ ID NO: 42771 - DNA, 329 bp, Zea mays
  Clone ID: LIB3062-012-Q1-K1-A7
caacgatgacggcggcggcggcaccggcggtcgctagcagggtgtgggagtgggaagggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccaccgccgccgacggcgagccggcgcccgactgggcgcacgagacgctgctggagcacgacgccgagcgccgtttcttccgctacgagatgaacgacaacatcgtggtc

SEQ ID NO: 42772 - DNA, 438 bp, Zea mays
  Clone ID: LIB3062-012-Q1-K1-A8
cgcactcgcggtagccggcggcggcggaggaggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgcggaggccaaggccaacgtcaagaagcgcatcgagtacatctccgcagagctgaagcggatggatcgggcgctcaaagacttggaggaaaagcaaaacagcaagaaggaatcgatattcaagttgcagcagaggatgcaggctgtacaagcta

SEQ ID NO: 42773 - DNA, 426 bp, Zea mays
  Clone ID: LIB3062-012-Q1-K1-A9
agctttctgattttgggctagcgaaacttttgggttcagaaaggagttatgtcacaacgagggtcatggggacgtttgggtatgttgcaccagagtatgcgggcactggcatgttgaatgaaactagcgatgtctatagtttcggaattcttatcatggaaataatatctggccgtgtacctgttgattacaacaggccgccaggggagattaatctagttgagtggctgaagacgatggtcagcaacagaaattctgagggggttttggatccaaagatgactgagaagcctacttctagggcattgaagaaggctttgctagtggctctgcggtgcgtagaccctgaagctcgcaagaggccaaagattgggcatgtcattcacatgcttgaggttgacgatttcccgtacagagatgagcgcc

SEQ ID NO: 42774 - DNA, 427 bp, Zea mays
  Clone ID: LIB3062-012-Q1-K1-B1
gcacaagggccaggacgtagccgtcaaggtcatccccaaggccaagatgacaacagctgtcggcattgaagatgtgagaagagaagtgagaatattgagttctctgacaggccacagtaatttagtgcagttctacgatgctttcgaggatgaagataacgtgtatatagttatggaattatgtaaaggaggtgaactgctggacaggatattggctagaggtggaaagtactctgaagaggatgcgaaggtcgttatggtacaaattttgagtgttgtatcattttgccatcttcaaggtgttgttcaccgtgatctgaaaccagagaatttccttttctcttcaaaggatgaaaactctcccttgaaggtcatagattttggcttgtctgactttgtgaagccagatgaaagactaaacgacatt

SEQ ID NO: 42775 - DNA, 300 bp, Zea mays
  Clone ID: LIB3062-012-Q1-K1-B11
cttcatagccttgatttgggacgtggatctgctccgcaaggttttccattcaagccaggctctccttggaaccacccaaggtaggaggatgaccgttcgatttcatgattgtaaattcttcagtagtggttcttttctccccgcctggcgattgcagaaaactgcatatacgagtgtaaatgtattttgctcttcgatatggttttagctttcgtgttgtgcgaggatagctccttaagtgggatgtgtgatatagtcttttctgtataacacgttgtcatggagagatgccttttagac

SEQ ID NO: 42776 - DNA, 430 bp, Zea mays
  Clone ID: LIB3062-011-Q1-K1-H11
cccacgcgtccggaacattggaagcgggttatgcaaggccatgctggtgccaacttggtgcctcttgttgcttccaaccggattggcagagaaactgttgacactgagcatggcaagagctcgataaccttctatgggaattccttcattgcaggaccaaccggagaaatagtgaagcttgctaacgacaaagacgaggaagtgctggtggcagagtttgacttggatgagatcaagtcgattaggcatggttgggggatattcagggaccggcgccctgaactatacaaagtgctactgacgttggatggcgagaaacaatcataaaccccggtctcacgcttaatagtggtaaggcacaggcaggctccagctccacatcaatgttagatttttttttctccttttttaccctgtccaacgatgccat

SEQ ID NO: 42777 - DNA, 116 bp, Zea mays
  Clone ID: LIB3062-011-Q1-K1-F12
cggacgcgtgggcggcgcccttttttttttataggtggacttaatgtttgtgtaaggcgaggcataacatcatgtctcaatggacgttgccgttgcacattggtgcattttatttt

SEQ ID NO: 42778 - DNA, 407 bp, Zea mays
  Clone ID: LIB3062-011-Q1-K1-F2
gagatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgacccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaaggtatccaaatcga

SEQ ID NO: 42779 - DNA, 372 bp, Zea mays
  Clone ID: LIB3062-011-Q1-K1-F3
ccaggatatattgtttcaaaggacatagctaaagaagtttacaggaaacacaagagtggggagttaaagatgttcaagctggaggatgtcgcaatgggaatatggatcaatgagatgaagaaggatggcttggatgtcaagtatgagaatgatgggaggattttggttgaaggatgcgaggatggctatgtgattgctcattaccaagaaccaagggatatgatgtgcctctgggatcagtttcagaaaacaaaacgaggaacatgttgcaaataataacagaaatcatgcgaatggtgttttatgttacggtggctgctggttgccggtgcttgaatagacacctttacgctaaaacgttcttgatgtata

SEQ ID NO: 42780 - DNA, 411 bp, Zea mays
  Clone ID: LIB3062-011-Q1-K1-F4
gagaaagagaacagagcgagagagggggaggacgaagccctccgcgtcgtctcctgcggttgcatcccacatctattctgcctcggcttgcaccttcgacctcgctgaaagttctgacctcaaactgaaaggggcctgtgaagcgtttccttgcggcagtgcaatggaggtgaacatctctggttctattttcatcgtcgggtaacaagaaactaatcagggagtctcttcccatttcttgcagtggaggaatgtttagctacagccgcgcagcatgctttccagagcataaattggtggaagagaagtttgatgctaccactttgccagaagaaccgagccagacacaataacatcaaactgagtctgagatactgcactttacaaattctttcgatattggcagattga

SEQ ID NO: 42781 - DNA, 452 bp, Zea mays
  unsure at all n locations
  Clone ID: LIB3062-011-Q1-K1-F8
ctcttactcaattgaggctggtgttggtgctggaattgacatgatcatggttccattcaggtacacagaagtgagcgacgacctgacgacacaagttcagaacaaggtcatccccatgagcagaatcgacgacgccgtctacaggatccttcgtgtcaagttcaccatgggcctgttcgagaacccttaccccgactctagcctcgccggcgagctcgggaagcaagaacaccgggaactggcgcgcgaagccgtcaggaaatccctggttctcctgaagaacggcaagtcctcctacgctccgttgctgcccctcccgaagaaggccggcaagatcctggtcgccggcagccacgccaacgacctgngcaaccagtgcggggggtggacgatcacgtggcaaggaagcagcggcaacaccactgccggcacgacgatccttttcgggatcg

SEQ ID NO: 42782 - DNA, 425 bp, Zea mays
  Clone ID: LIB3062-011-Q1-K1-G10
gtaggatatgggcatctctaacttcggtgtcacttggtgggcagccttccaggcgagttgctgttggactgatgggctcgaccatctaacagcaacaagagaacgtgctgattcattgaattgctcctgttaaggctgtaactcacattgctcatgttaaggctgtaactcacatgagcatatttagacagaaaaggtctctggctttctgcttagaaacatacatcctgtttgtagcatgtaaatcttagcgatacttgtagcctttgtaagtcatgttgtaacattagtcgttagtgccccgatcaggcaggctgcctttggcaagagaaaatgcagcacaagcttggtcttcccctccccagaatacatggtcaaatgcgctgttttatcatgtaatctgcaatgatcaatggacatccttc

SEQ ID NO: 42783 - DNA, 428 bp, Zea mays
  unsure at all n locations
  Clone ID: LIB3062-011-Q1-K1-G12
cggacgcgtgggtcagcatccacatcggccaggccgggatccaggtcggcaacgcctgctgggagctctactgcctcgagcacggcatcgagcccgatggcaccatgcccagtgataccacggttggcgtcgcacatgatgccttcaacacgttcttcagcgagaccggttctggcaagcatgtgccgagggccatcttcgtcgaccttgagcccactgtcattgatgaggttcgcactggctcgtaccgccaactcttccacccagagcagctcatctcgggcaaggaagacgcagctaacaactttgcccgtggccactacactgttgggaaggagattgtcgatctatgcctggaccgtgtgcgcaagcttgcagacaactgcactgggctgcagggattcttggtgttcaatgctgntggtggt

SEQ ID NO: 42784 - DNA, 389 bp, Zea mays
  Clone ID: LIB3062-011-Q1-K1-G5
ctcgcctgcctctcccccgccgcgccgtcacttcccctctcccgtcaactccgggttcggcgcgaggtcgagctagcgtttggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataactgggatgcaaatctcagccttcttcgcttgtaccagagtgagccagaaaggatgagcatacagattgtggcccacatactgattaaggctctcatggcaatgccagcccctgacttcagtttgtgcttattcttaatccctgaacatgtgcaaatgg

SEQ ID NO: 42785 - DNA, 440 bp, Zea mays
  unsure at all n locations
  Clone ID: LIB3062-011-Q1-K1-G6
cctcactggaaagactatcaccctcgaggtggagtcttctgacaccatcgacaacgtcaaggccaagatccagggcaaggagggcatccctccagaccagcagcggctcatttttgccggcaagcagctcgaggacgggcgcacgctggccgactacaacattcagaaggagagcaccctccacttggtgctgcgtctcaggggcggcatgcagatcttcgtgaagactctgaccggcaagactatcacccttgaggtcgagtcttctgataccattgataatgtcaaggccaagatccaggacaaggagggcatccctccggaccagcagcggctcatttttgccggcaagcagctcgaggacgggcgcacgctggccgactacaacattcagaaggagagcaccctncacttggtgctgcgtctcaggggtggcatgc

SEQ ID NO: 42786 - DNA, 406 bp, Zea mays
  Clone ID: LIB3062-011-Q1-K1-G7
cggacgcgtgggcgcccgcgagctccgcgacctcgtcgccgtcgccaggctctggccggggacagggacgacagggacgagggcgctggcgtcgtcaccattccgcagatcgtcaggtacctccaggggaagctggagcggatcggatgccaggccaggttcggatgatgatgatgacggtgatggttcgcctgcgttgcgtgcgcgggcgatcagcgtatcatcatcgtctttgttcttctttaacagcctgtctgtaccatcaaatgtacaaaagcgcgtggcttttcttctgtggatgcccagaatctgttggtgtcgatcagtcgatagaggaaccaaagtgagttgctgactgcgattggaagcggagtgcaattttctcttctgatggacatttttttcg

SEQ ID NO: 42787 - DNA, 397 bp, Zea mays
  Clone ID: LIB3062-011-Q1-K1-G8
agtaatcaccccaaatcctagggttctagtcgcttctcgtcgtttcgttcgtagatgacagagacaatggtgaaggcagttgctgtcctcgccggcactgatgtcaaggtcaccatcttcttttcacaggaaggggatggtccgaccaccgagactggaagtatctctggcctcaagccaggcctgcatgggttccatgtgcacgcgcttggcgacaccaccaacggctgcatgtcgactgggccacacttcaatcctgttggcaaggagcatggtgcaccggaagatgaggaccgccatgccggtgatctggggaatgtgacagcgggagaagatggtgttgttaatgtcaatattactgacagccagatacctcttgctggaccccactcgatca

SEQ ID NO: 42788 - DNA, 424 bp, Zea mays
  Clone ID: LIB3062-011-Q1-K1-H10
agagatccttctggagttctctcaccacacagttttaaccgcagagcagtgcaaagcggcgatgtttcgttgaagatcatatactgtggagtctgttatgcagacgttgcttggacacggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctgtctagacaaccattgcccaaaagcagtttatactttcaatggcattgatacagatggaactgtcacaaaggggggttactccactcacattgtagtccatgaaaggtattgcttcaaaatacccgatggctaccctttggcga

SEQ ID NO: 42789 - DNA, 426 bp, Zea mays
  Clone ID: LIB3062-011-Q1-K1-F11
gcagcattaaactcgaccacaccaaacgacggccggcccaaattaaaagaccgacccgggccttgcaacaaccacgcaaatagatcccactcatatacactccagtagctagtagtagtcgacccatctgcatctgtatgtgtgcttgcccccggccggccacctttccggccgatccatcatctagagctagctcatcatcagtctttggcgtgtgtgtatgtatatggtggtgaccagcagctagctatagcagcagggtggttgttctatagttcgttcctatggttatggcggcggcggcggcggtactgctcgcgctggccgccgtggcgacggaggtggccgcggcaggaacgacgtacacggtgggcgcgccggacgggctgtgggacatgcagaccgactacgcgcagtgggtgaaga

SEQ ID NO: 42790 - DNA, 387 bp, Zea mays
  Clone ID: LIB3062-011-Q1-K1-D7
cccgatctctactatctaccgccgccttccttggtcgccgcgcgcggccttcctgggggcccaagccccaacctcgccgacgcgcctcgcgtcgtcgtcccgcctcggtcctcctctcgccctgccgatggatccggccgcccccgagcctgtccccgcacccgccactgacaccgatgccgagaccaatggttatgaggatgcctctgaattcgaggatgcggaggctgggggcgagggcgctggggccgggaccgagaccgggaccgggtccgggtccggaacgatgccggcgggcggtgtagcggagatgaaggagctgcccgaggagcttgccaagggggtggtgtgcctcgaatgcgagacatcggccgaagcggcggtgtc

SEQ ID NO: 42791 - DNA, 343 bp, Zea mays
  Clone ID: LIB3062-011-Q1-K1-D8
cgcgaacctgccgctaccgcacgcccgcagtcgccgcaaaatccgccgccacgaaccggccgcacgccagcctaccacctccctacgcccgcctgcccgcccgcaatcctgccaccgccgcgatctggctgcttgcccgccacaatccagccaccccgccgcgaccgctccgtgcatgccgcaaccgctgcgatccgcccgccctcctcaatccgcccgcccgccgcaatctggccgcccgcccgccgtgaccggcgagatccggtgcagcggcaaatgcaggtgtagagggaggcgacaatgtcccagatgctgtggagtgtgggtctgaaaaggacgggca

SEQ ID NO: 42792 - DNA, 414 bp, Zea mays
  unsure at all n locations
  Clone ID: LIB3062-011-Q1-K1-D9
ctccttatgctccttgtacnaaccgcaagagctgctacggggaccagtttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattgacacaaaacatcagggcacaacaactacaacaacttgtgctagcaaaccttgctgcctactctcagcaacaacagtttcttccattcaaccaactagctgcattgaactctgcttcttatttgcaacaacaacaactaccattcagccagctatctgctgcctac

SEQ ID NO: 42793 - DNA, 299 bp, Zea mays
  Clone ID: LIB3062-011-Q1-K1-E1
aggcaatgccctgttcattgctaccggcagactgcgcaaatttcatagtcatccatttgaaattcgtaatgatgtggtgggcaacatttaatgtggtacaaatatactactagattttctgtgcattacaacggaacatgtttggtagtattgtccaaaaaaaacttgtcaagctaaaaccaagatacagagggtccgtgtcaacatgttactatgtgttttcagtgctttgtttttttaaaggaaatatcttgctgaagtatgcaaaccgtaatgtctaattaaacttatgattccat

SEQ ID NO: 42794 - DNA, 425 bp, Zea mays
  unsure at all n locations
  Clone ID: LIB3062-011-Q1-K1-E10
aaagaaagaaagaagccaagcccaccagggccggggaagctaagagaggagagctaaggaaggaaaggaaggaagatgatgagcaaggaggcagtggtgaacgcgttcctggggtgcttcatgcacgtggggctggcgctggtgctcgccgtctacctccccgtggcctttgtgtgccgcctcctccaccgcctcctcgtccgccccttcgccaggggcgaggacctccgcggcaaggtcgtcctcgtcaccggcgcgtcctccggcatcggcgagcacctggtgtacgagtacgcgaggcacggcgcgtgcgtggcgctggtggcgcgcacggaggtggcgctgcgcgccgtggccaaggcggcgcgcgacctgngcgcccccgacgtgctggtcgtgccggccgacgtcaccaaggtcgacga

SEQ ID NO: 42795 - DNA, 427 bp, Zea mays
  unsure at all n locations
  Clone ID: LIB3062-011-Q1-K1-E12
agcgaggcggcacggccgtggagggcctccgtggctgcccctactgctcctacccgccggcggccgcagccttcagcctcctgtccccggccgaggccatgaagcgggaggaccccggctggttcggcggcgccgaggagctgcgccagggcgtctggaccgtcgaggaggacctctacaccacgctcaagaagaaggtgagccgggtgtacgccgcgccgccggaggagaggaagaagcgcgtctacagcaccgcgccgtccaagttcaccaccatcgatcagtatagcgggctcgggttcaggctggtgaggatggggttcgaggacatgtacctctgcagcccgggaggcatgtacgacaagttcggcaaggactactttctgtgcacggngatggcgtccatgttggtgcccgtcgtcgtcaa

SEQ ID NO: 42796 - DNA, 437 bp, Zea mays
  Clone ID: LIB3062-011-Q1-K1-E2
gaaagaaggatctatgatggggctgtgaggggccttttacctgttcaaggtccactgggtgggaagttccctcttccagatcccagagaccccttctccttgaagccaggatctcttacatttgctgcttccaaacccactctgcaaaaatctgaaagtgttgctgcagcaatagccggggctcgaactgcagccactcaattctcaaagaaggatcgcaaagctgctgctagtagtgaaattggtacagaagagcaatcctggggaagccatggcggtagcagttcagttgattgcaatggtctgtcaattgtccatggcagctatgcgcatctacagaaccagaatcggccttcaattttcccgagcactcaagcgaattcccaaaatccaaattctgagcctcggaaaaaccctagactagaatttggagcttt

SEQ ID NO: 42797 - DNA, 392 bp, Zea mays
  Clone ID: LIB3062-011-Q1-K1-E3
ggttccgctggtgttgtgaggaggcaggccgtggatatctcacccctgaggagggtgagccaggccatctacctcctcaccactggtgccagggagagtgctttccggaacatcaaaaccattgccgagtgccttgcagatgagctgatcaacgctgccaagggctcatccaacagttacgccatcaagaagaaggacgagattgagcgtgttgccaaggccaaccgttgaactgagcttgtatcctggtgcactctgcgctggaaacttttatgtcgctggcagtcgtatcggttcttgttttaccaatgtttagagttttttgagacctatatgcggttttggttttcagtgcacaattaaaattactgagtaatgtagttgattgggaa

SEQ ID NO: 42798 - DNA, 372 bp, Zea mays
  Clone ID: LIB3062-011-Q1-K1-E4
ttcccggcgggacccgtccgatgatcctgaaactggagaggaagacccctcaaagagaggtgtctgcagtaacttcctgtgtggctcaaaaccaggggacaaagttcagatcacaggcccctcgggcaaaataatgcttcttcctgaggatgatccaaatgcgactcatatcatgattgccacggggactggtgttgctccctaccgtggctacctacgtcgcatgttcatgggaagatgtccccacttttaaatttgggggtctggcttggctctttcttgggggtgccaactcttgccgccttctctatgatgaaaagttcacaaactacctttagcagtatccagaccatttcaggtacgacaaaacgc

SEQ ID NO: 42799 - DNA, 380 bp, Zea mays
  Clone ID: LIB3062-011-Q1-K1-E5
atcatctctccacacaactaagaagccagcggcagtaacaggagtgaagcaaagggatggcatcatcaacgggatcagagatgagcgaggaaatcgatgtccagcttagtccagaggagaaagaaagtttagatgagatcatcaaggaagctgagagcgacttggagtctgaggaagtcctggatcaatcccttgccattgttgccgagaatgaaggtctggacaaggactcatctgcaaaactcacaatttacactgtaggtggtgtttggaagaatctgacatagggccccttgagtgttatggataagcacatatatgcaggacacactgtcaaaccatttcccagcctgattggaactggaaagtctggttgtttc

SEQ ID NO: 42800 - DNA, 399 bp, Zea mays
  Clone ID: LIB3062-011-Q1-K1-E6
atcaggcagctctaccgagcatgatgctgtctctgttcacaactcttccgagcacgccgctgtctcctttgtcatcatcatcagctcagatctagcagcttcgccttctcagattctaaatgaaattcttggagatagagagcgtatccaatctctgtattctgagattcctgggagaaccacaagcaatgccagtacctccagaagaacttgtaatttcagtgtggacgcaactggagatgaaagcctttctgttgaagcacacaattgtaaactcgacaatactgcgtctattttatccatgaggagctgcgctgacaagctgtggaagagaagaaaaggttcaaaactttaaaatcagaagataaaccagaggaagcaatgcaagctttcaagtat

SEQ ID NO: 42801 - DNA, 346 bp, Zea mays
  Clone ID: LIB3062-011-Q1-K1-E7
agaaatctgaaatgcttcgtaggggccaggtagaacatgtcaaagctgaaaggagcctgcttgctgaagttgatagtgcttacatagttaagctctattattctttccaagacgaagagttcttatatctcatcatggaataccttcctggtggagacatgatgactttacttatgcgcaaagacacactaacagaagatgaagctagattttatattgcagaaactgggcttggcatcgagtctattcacaagcaccactatgttcatggggatatcaaaccagataatcttttggtagatcgcaatggtcaccttgagctttctgacttcggtttgggtaaacc

SEQ ID NO: 42802 - DNA, 434 bp, Zea mays
  unsure at all n locations
  Clone ID: LIB3062-011-Q1-K1-E8
atcaaaatgaaatagctgaggcactttataagcttgtgtcagataagcacttgtggtgacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacatcaaaaaggatgtgccaggtgagaatggtaagtggtcggcattgcgtangaggaagcacatcattggaattgct

SEQ ID NO: 42803 - DNA, 425 bp, Zea mays
  Clone ID: LIB3062-011-Q1-K1-E9
cctaaatgcatattctacgctcgaacatcttggcatgcagttcttagactgcaggcatgctttgaagtctagtgttgaggcctttctcagtgaaaatgatactgacccagccacacctcaactggagaccaccatgtttgcccctggaagtagaatggagaactacaacaggaagcctgcaagtccaagggataccacagctcttgctaatttcaaagaagtcctacaggaatcaggtttagagattttgtacagcgtccctgtactacactgtccacaagcatttggagttgttttgaaggccatggaaaaagcgaacagcactggaaaggtaattccaggctggaaggttgtatattctggcgacacacgaccctgtccaggtcttatagacgcatccagagatgctacagtgctaatacatg

SEQ ID NO: 42804 - DNA, 426 bp, Zea mays
  Clone ID: LIB3062-011-Q1-K1-F1
cttcaaaaccaaagcctgatgaaatagcagcatcagaaatggcagctgcagatggctcgctgaattgggcactagttgaaggccgacctccatctgctgctgaatgtcatcactgtggtattaatgcaacagctacaccaatgatgcgtcggggacctgatggaccaagaacactatgcaacgcttgtggcctcatgtgggcaaataagggtctcctgagggacctatccaaatctcctgtacctcttcactctatacaacaatcagctccaattctaaatggtggtcagaacggaagtgccatgtctgcgcttggctctgagctagagaatgctgcagcagccatgggcaatggccacgagccataaggtagtggtgtttagccatgtgctaaagccacgagcatcatcgcgcaatgatctctgc

SEQ ID NO: 42805 - DNA, 426 bp, Zea mays
  Clone ID: LIB3062-011-Q1-K1-F10
cagaaacacaaagaagtgaatttgggtactccaggagcatcgtcttcaactcggactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccact

SEQ ID NO: 42806 - DNA, 390 bp, Zea mays
  Clone ID: LIB3062-011-Q1-K1-D6
ggcaaggccaatccgaaatctcgagcgttcgcgccggcgaccacagcaaagaggagggcacagcacgacagcgccccagggttcctactctcgtcgcagcggcagcactgaggggaagatgtcgtcggtgttcagcggcgatgagaccgcccccttcttcggtttccttggcgccgccgccgctctcgttttctcatgcatgggggcggcgtacgggacggccaagagtggcgtcggcgtggcgtccatgggtgtcatgcgcccagagctcgtcatgaagtccatcgtgcccgtggtcatggctggtgtgctgggtatctacggcctcatcatcgccgtcatcatcagcactgggatcaaccccaaggccaagccatactacctctttga

SEQ ID NO: 42807 - DNA, 432 bp, Zea mays
  Clone ID: LIB3062-011-Q1-K1-C2
acagggaatcgcaccatcgtgggacccgtacagcgcaccgcccagccgccggatctgcgccggcgacgcgcccggacgtcggatctacgccgccgcaggaggggggaggcggcgctgtggccgttctctgcccgtgagcgcccggatccgtcccgccgcaaggattatggatccgaaagagaagccaaatgtatcgagcagtccaccaacaccacggctggactgcataaaatgctttgatatgctctggttctgttactcaccattccaccagatgcagaattattaccggtatggggagttcgacacctgcttcggcaagtggggcgatcttatgggctgcctcgctctcaagacaaagcggaaggcagaggtggaggagatcctcatcgcgcgggagaaggccaaaccacatatctggacctaacggac

SEQ ID NO: 42808 - DNA, 409 bp, Zea mays
  Clone ID: LIB3062-011-Q1-K1-C3
cacgcagacaacagccatcttggaggtatctaattccaatattgtatgtctcggttgagcttgtgaaggcgttgcaagcacatatcattaactgggatattcatatgtttgatgaggagatcggcaataccactcagaatgaagatggtcaaaatcttgatgttttctttggttgcatccgcattctggactattcctgacagcatttaagtttttattacggttcaacggtcgtccagcgtaatccttttacaaccatgggtggcaagtttgaccatgcagatcgtttgttccaaagcattgagaacgcttacataaatagcttatcaaatacaagtgacgtcaaagagcttattccagaattcttttacatgcccgagtttcttggaaattcaaattcatatcatct

SEQ ID NO: 42809 - DNA, 430 bp, Zea mays
  Clone ID: LIB3062-011-Q1-K1-C4
cacctcgtcgcaccactcgccgaggtgcccatggagtccttccaccaggttttcgacagcaatgtctatggtgcaatgaggttaattcaatctgttattcctcacatgatggaaagaaggaaaggaacaattgtgaatgttggaagtattaccgctctggcacctggaccatgggctggtgtgtattcagcatccaaagctgctcttcatgcattgagtgactcgttaagggttgaactaagaagcttcggcataaacgtgatgaccgtcgccccaggagggacgaggtcgaatcttgggaattcttctgcagccaagtatgatcagatgcacgagtggaagtactacaagaaatacgaggaagggctccgagccaggactggcatttcccagggccccaagtccactccagcagaagagcttgcaaagg

SEQ ID NO: 42810 - DNA, 420 bp, Zea mays
  Clone ID: LIB3062-011-Q1-K1-C5
gctagctcgatccgcagagcaaagcgaaagcagcaagaagcaaagcaatggagaaccgtgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggatcaccagcgaaatcgggaacgcgcaccaactgttcgtcgttgtgttcgacaccgacaggctcaagggctccacgctcgtcaccaatggcgtgataacgggcgggtctgacgagtgggcgatctacggcggtaccggggtgtttgccatggcgaagggcggtataagga

SEQ ID NO: 42811 - DNA, 406 bp, Zea mays
  Clone ID: LIB3062-011-Q1-K1-C7
caacgccgcgggcgcggaggcgggcgtcggcgccgccgtcacccggcgcatcatggcggcgctcaagatccccggggacgagtacgccatggtgtgcacggccaacaggaccgcggcgttccgcctcctcgccgagtcctactcgttccagcccggcaagcagctgctccccgtgtacgactacgagagcgaggccgtgggcgccatggccgacagcgcgcgccgccggggcgccgaggtcgcctccgcgaccttcgcctggccgagcatgaggatccacggcgccgacctccgcaagaggctggccaggggccggcgccgcggcggcgggggacgcggcctcttcgtcttaccgctcgcgtcccgcatgacgggcgcccgggacccgtacctgtggatgagcgcg

SEQ ID NO: 42812 - DNA, 411 bp, Zea mays
  Clone ID: LIB3062-011-Q1-K1-C8
cgtaaactacaagcttcgagattggctttttgccagacagcgctattggggtgaacctttccctgtgagctaccgtgatgataccaatgaaatggttcctcttacagaagatgacttgcccttgacccttcctgaattggatgatttcactccaactggtactggggagccacctttgaccaaagcaacaaattgggttagaaccattgacccttcatctgggaagcctgcgagaagagaaacaagcaccatgccacaatgggctggatcttgctggtactatttgaggttcatggatcccaaaaactgcagtatattggttgataaggctaaagaaaggtattggggtccagttgacatctacgtaggtggtgctgaacattctgtcttgcacttgctttatgcaagatt

SEQ ID NO: 42813 - DNA, 425 bp, Zea mays
  Clone ID: LIB3062-011-Q1-K1-C9
accgccccgtcgccgaccggagtagccccagggtctcgccgcgcagccctctgcccgagaagaagcgtgcggcgggaacacgtgttgcggagctggagggcaagctggggaaggtgcaagaggagctcaagaagctgcgggagcagctcgcgtccgccgaggccgccaagaaggacgcgcaggtcgcgctcgaggaggccaagaagcgcgtcggtaccaagggaagcccagcctccaccaccaccaccactcctctctccccccttcgcctggggtcgaaatcgccaagaagaccgaggagctgaagctgcctcagccggcagccgaggaggagagcagcataaacgccccggcgaccgatgtgttcgaggtagtccgggccgagtcgggggacaaggagaaccagagcgcggccgaggactgcg

SEQ ID NO: 42814 - DNA, 344 bp, Zea mays
  Clone ID: LIB3062-011-Q1-K1-D1
cggcctttttcccctatttttatacacgaggagttaaaagagcgccagtctggtgatgccgaagctattacctcttgggatcttgtaatcctgcaatttatgtcttggggatccgaattcatttcatgaatttaccaaaaaaaaaaaaaaaaaaaaaaaaaaaaaaaaaaaaaaaaaaaaaaataaaaaaacgcaagcaaatatacaagaaccagcaatacaataaacatgcatgcaaagacaacagaaaatcaataaagtgacctaaatttaacaaactgacgcctgtgaaaccacggggggaccgcaaaaaccctgcctttacccaaattcatctttttgca

SEQ ID NO: 42815 - DNA, 404 bp, Zea mays
  Clone ID: LIB3062-011-Q1-K1-D10
gccgtgtaaaaaagggaaaaagaaaaaaccagagcaacgcagccgcaggctgggtgagcggcgcgggtcttcgtcggccggccccttcaccggtggcgagcatccaccagaccaccagtggatgcgcccctgccccccatgccccaggtcgagtcggccactgcctcggaggcgccgccgccgcaggacgcatggctcgtcgagctcggcagtcgcctcccgcagtgggagtcgctgcgggattcctccaaggtcattatcccgatttcaatatctagggtgaaccagtttgatgctgcaaggctagatgttgagatgtcggccatgttgaaagagcagctagtcaaagtgttctctttgatgaagccaggactcttattccaatatgagcctgaacttgatgc

SEQ ID NO: 42816 - DNA, 429 bp, Zea mays
  Clone ID: LIB3062-011-Q1-K1-D11
gccaatacatcgtcaggctgaacaagtacctggaatctagtaaaattggattcgatgtgggcatgaggtttaagatgagttttgaaggggatgacgtccctataaagaagttttctggaacagttgtcgataaaggagatctttctccacaatggcaaggttctgaatggaagacattgaaggtcaaatgggacgaagccacaaacttaaatggccctgagagggtttcctcctgggaaattgaaccgttcgatgcatccgcacctgccatcaccatgcccgtgcaaccagcaatgaaaaacaaaaggcctagggagacacctgaaggcctggatattcatgcactggaacctgctcaagaattctggctctctggaaggcctgaacagcatgagaagacaagcgtaagctccagcgaacccaaacatc

SEQ ID NO: 42817 - DNA, 424 bp, Zea mays
  Clone ID: LIB3062-011-Q1-K1-D12
cattgggcagcgcaattaccggtactttttcatgtttgtttcttcctcgactcttctctgcatttatgtatttgcaatgtcagccttgtacatcaagtttatcatggatgaggattatccaacagtatggaaggctttcaaacactctcccgcttctttggggcttctgatatattgtttcattgctctctggtttgttggtggactcactggatttcatatgtacctcattagcaccaaccagaccacgtacgagaatttccgatacagatcagacagcaggcctaacatctatagccaaggatgtctgaataactttctacaagtcttctgcagcaagacaaaaccttctaaacacaagttccgggcctacgcgcaagaggaagtgcggcctacaacggttagcttcggcagggaggtcgat

SEQ ID NO: 42818 - DNA, 396 bp, Zea mays
  Clone ID: LIB3062-011-Q1-K1-D2
cgctcagctagctagcagcagcagcagcagctctcaaacctttctttctacctccccggtcgctttcgttcgctcccagacattctagccctctcgagtagctagctcgagcggtgcatgcatctgtagctacctagccgacatgggcaaagatgaggagggcgcgcgtgcgctgcttcgtgccctctctggtgttggcgagaggccggcccagcaggcgcgccttccgcgcatggcgggacagagacgaccaaggaacggaggtggcggtgatcgtccaatccgaggctgaaggagctagctaactggtggtgtggtggtggtgctggtgtgtgtagggtctaactcgatcggcgatttcggcggcagcatacatgggaaagccaggcatttttc

SEQ ID NO: 42819 - DNA, 379 bp, Zea mays
  Clone ID: LIB3062-011-Q1-K1-D3
catgaaacatgggccattggcaatcggcatcaatgctgcctacatgcagacatacatgggaggcgtgtcatgcccatacatctgtggcaggcaccttgaccatggtgttctccttgttggatatggtgcttctggtttcgcccccattcgcctgaaggacaagccttactggatcatcaagaactcgtggggcgagaactggggggagaacggatactacaagatatgcaggggttccaacgttcgcaacaagtgcggcgtcgattccatgggctctaccgtgtccgcagtccacgcctcgaaggagtagactctggtcagcggtgataatcgtgaatccatatattggagaactataatccctgctagtaatccattt

SEQ ID NO: 42820 - DNA, 409 bp, Zea mays
  Clone ID: LIB3062-011-Q1-K1-D4
cggacgcgtgggctttttggtaaactccgccgaaattataaggcccaatttgtctatgggtgaaggcatagaaataattgtttcaggaggaatgactatgccgcaggtgatcatgtcactggaaccaacacctcggaagagccagaacgtccgtttggacagagtgaggacagtatgactgtatgaggcatgcatgaaagtgatgggtgtttcaggatggcttgttggttatggattcaaagctggggcatggagcttgagacaatcaatttgtagattgcattcagaacttgcgcattattggcagatacatgacaacctcacactaacttgcgttgctatcagttggtgacacgaaaattgcagctccacttacaattacaagcacgacatgcacttttaactgatc

SEQ ID NO: 42821 - DNA, 301 bp, Zea mays
  Clone ID: LIB3062-011-Q1-K1-D5
cccacgcgtccgctccaccgccgccaacgtcgcctggcggccgtctgcagctcggggcgtctgctcggaagttggtgaaggtttcttgaagctgagaagatggtgctgaagacagaactctgccgcttcagcggccagaagatttatcctgagaaaggcatccgatttatccgagctgattctcaggttatgctttttgccaactcaaaatgcaagctctacttgcacaaccgactgaggcctccaaagcttacctggacagcaatgtgcttgaagcatcacaagaaggatagccatgctg

SEQ ID NO: 42822 - DNA, 427 bp, Zea mays
  Clone ID: LIB3062-011-Q1-K1-C12
ccacgatcatgttctggacggtgtacgcgcagatgaccaccttctcggtgtcgcaggcggccaccatggaccgccgcgtcgggggctcgttccagatccccgcgggctccctcaccgtcttcttcgtcggctccatcctgctcaccgtgcccgtctacgaccgcctcgtggtgcccgtcgcgcgccgcgtcagcggcaacccgcacggtctcaccccgctgcagcggatcgccgtcggcctcgcgctctccgtcgtcgccatggcgggcgccgcgctcacggaggtccgccgcctccgcgtcgcgcgcgagtccgcctccggaggcgtcgtgcccatgtcggtgttctggctcatcccgcagttcttcctcgtgggggcgggcgaggcgttcacgtacatcggccagctcgacttcttcctgcgcga

SEQ ID NO: 42823 - DNA, 389 bp, Zea mays
  unsure at all n locations
  Clone ID: LIB3062-011-Q1-K1-A6
gccgcgagaacccatcctgaaggttggcgaggctagagaaaaanctcttggtgcaggtgatgtcaagtgtctatgcacangagattngatgatgnnctgagggcctggacaagaattgagaancctgcagagtccatgacaacaccgagatatatganngaaggctgtgaagatgnctggaatcctactggcntggagganggaagatganntgccatgccctcaggnctgacaatccnnccagaatggctttcaacttttgaggaacccagctccttctggttccatcaggnntggattcaacttgtggcttgaagaaatgccgcatttggaatggcccgcttgtgccgattatnngccttggcttagtgctttctgggcttaggtca

SEQ ID NO: 42824 - DNA, 420 bp, Zea mays
  unsure at all n locations
  Clone ID: LIB3062-011-Q1-K1-A7
ccaaaattcccggcgaagatggttactggcaaaacggaaaaagtggctaaagcacagcgtttgcaacgagatgatattgagatggtaccagcataacctgtccgagatgaagaggatacgtcttcatcttctggtgaatcagatgtttcggaggatgaactcgatgattacagaaaggctgaagtactagcctatgctaagaagatgctgaggaagaaacagagagagcagatacttgatgatgcttacaacaagtacatgtttgatgatgaagggttacccaactggtttgttgaggattaaaaaaggcataggcagcccatgaagcctgttacacgtgaggaagtagctacaatgagggctcagtttatggagatcgatgcccgaccatgcaaganggttgcagaggccaaggcccgg

SEQ ID NO: 42825 - DNA, 434 bp, Zea mays
  Clone ID: LIB3062-011-Q1-K1-A8
ctaggcgagagcacgcactgctggcggcgcggctaagaccgagagccgccgcgcacattattgttcgcgcgagggcagccgccggttgcattgcatggcgcagctgccgcccaggatcccgaccgaggtgcaccactggcccgaggggggccagcacggcgcggcggcggcggcgtgggcggacgacttcgccgagttcgcggcggcgcggcggggcgcgcaccgcaggtcgctcagcgactcggtcgccttcgtcgaggtggcgccggccgacggcggggccggcgagttcgacaggctcgacgacgaccagctcctgtccatgttcccacccgacgaggccggcggcagcggcggcggcggcgggtcgtccgcggccgggtccgagaacggcggcagcagcgacagcgacggcgataagcgtggcgcgcgcg

SEQ ID NO: 42826 - DNA, 444 bp, Zea mays
  unsure at all n locations
  Clone ID: LIB3062-011-Q1-K1-B1
aggaagcagccgatgaccaggaagagtctggatggaagtatatccatggtgatgtcttcaggttcccaaaggataagtcgctattttccgctgctcttggcacaggaactcaactatttgctctcacaacctttatattccttcttgcacttgtcggagtattctatccttacaaccgtggtgcactatttactgcattggttgtcatttatgcactcacttcaggaattgctggatacattgctacctctttctattgtcagttggaggggacaaactgggtgaggaacttgctattgacaggatgcctattctgtggacctctcttcctgacattttgcttcttgaacaccggtgctattgcttatagtgccacagcagcactgccctttggcactatctgngtcattgggctcatctggaccttggtcacatttcctttgc

SEQ ID NO: 42827 - DNA, 427 bp, Zea mays
  Clone ID: LIB3062-011-Q1-K1-B12
gatgagcaaagtagctgggagcagcatgttacaggctgcacctgctgtcaaagctaatagtgcagtgtctcagacaaaaccacgaagggctaagtacaggcaagtaaatgctgcagacaaatctccatgtcctgtgaaggtgaatcaggggaacagcgaagccgttagtaaggagtctctatcttgtggagaaatgctatggcagctctctgtagcagcatgtggtcttcagcagagagagaaaatcgttcctacaagtgttaacttctttaccggttttagaaagaacaaattttctagttctgatgtcaatgaggggatgcctgagaaggcagccaacactgagtccactctttcagaacagcccattgctgatcatatgcaggatgactattgggctgacattctcattaatgtggaggagccg

SEQ ID NO: 42828 - DNA, 393 bp, Zea mays
  Clone ID: LIB3062-011-Q1-K1-B2
cttaccctagtcctggaaggggtttggaccgcccaacttctcgtggtgaccgccgtggggcggccatgactgacgacaggtggactaagacgggtgttcctctcagtcctggtcgtgatgttcacatggacctgccaaatggaacatcagttgtcaactaccgtagctcaagaggtaatcatggtgttttaaggaatccacgtggccaaccatcaaatcaatatggtggtggtcttcttgcaggacctgtgcattctgttgggcctcaagtacctcgcagcggctctgattctgatagatggcagcaaaagggtctcatgccttcccctgtcacacccatgcaaacaatgcacatagcagagaggaagtatgttggtgggaaagtttctgatg

SEQ ID NO: 42829 - DNA, 74 bp, Zea mays
  Clone ID: LIB3062-011-Q1-K1-B3
cggacgcgtgggcaattttttcttgggactgaaaacaaagcccgttgctataagtggggatgggcacttcatat

SEQ ID NO: 42830 - DNA, 393 bp, Zea mays
  Clone ID: LIB3062-011-Q1-K1-B4
aatcatggttgatgatgttaaatatacagtttcacatgtcgtggagcctatggagcggagttgtacaaagataaataagacaattcatcaaatctcagaaaacgtcaagcagcttgagaagcaaaagaggaaggcaaaggacgacagtcatcttattcccctagaaccatggtcagaggaattttcagaagctcatgaccatgttgcgggcggtagtgccagtgacagcggattagctaagacaaggtacaacaggatcttaaataagccccggaagtcattcgagtccagattgcgcaaatggttctagcaaccaaccggtgctagtgggttaattgattttgatcaaaagaggcggttaaccttttcgctccggttgtttgacaaaatgat

SEQ ID NO: 42831 - DNA, 405 bp, Zea mays
  Clone ID: LIB3062-011-Q1-K1-B5
gatccatcgactcgctcgggccgcccctcccgtcgtccccgttcgaaggtgcggggggcggcaggcgagcgatttcattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgaaatagacc

SEQ ID NO: 42832 - DNA, 417 bp, Zea mays
  Clone ID: LIB3062-011-Q1-K1-B6
gagttccatgcagctcctggagagaggagggtgtctttgctgtaccttgcgaatgatggtatgcagaatagcagaaaagaaggtaatggatatatagctgaattcatgagggtcatccctgctgccttgaatggagtgttgactgtaagagatgattttgggcggaatgtcccaaaaagactgattgacatatgggaagaccgtaaaatatttgatacccaggcacaaagcctgaaagatgattttttcaggaggttaaaggacattagaaaccagttggcagtgagcagctggagaaggttgtctctagctacaaacatgtcctgaatgctcctatggatgaggatactctgatgcgaaaatgccaagcagctcttatcaattttgatgaactcaataaaacatatggaaataact

SEQ ID NO: 42833 - DNA, 282 bp, Zea mays
  unsure at all n locations
  Clone ID: LIB3062-011-Q1-K1-B7
cgtnctcggccttttggttactcatncnnttggggcttttcanngttttacttcttancgaataatnanntttcacaatgtgttgggttgttnnnttatgtacccaatgccncnnattgtgtacccatgagtnntcatanntttttcttattttgatctnnttgaanncatttcatttagtnnatgcatgtngnnactgttgcangnnattgatttgctnnngctggtaggaacgttttcttacganngaaaattggagccattattagttaatnnagtagg

SEQ ID NO: 42834 - DNA, 419 bp, Zea mays
  Clone ID: LIB3062-011-Q1-K1-B8
gtactgtacagaagcatatacttcagggaggccccaagcgtctaactttcactgtgccgtcgttagtattctcttctcttaagctggtcaggcgattacaaggccaagatggagatgtcactggggaggatgttcctgcaactccaaagaaaatattccagatattgcatcagactattgaagcactttcttgtgttccttccccagagttagctctgagactatatttgcagtgtgcagaggctgccaatgactgtgatttggaaccaagtgcttatgagttctttactcaagcgttcattttatatgaagaagaaatcacggattcaaaggctcagatcactgcaattcacctgataattgggacccttcagcggatgaatatatttggggtgggaaatagagacacccttacttac

SEQ ID NO: 42835 - DNA, 433 bp, Zea mays
  Clone ID: LIB3062-011-Q1-K1-C1
gttgtgactttctgggagggggagatagtggatgctaaaaattacacttttttcactggaaagtgggaggcatcaccagatgatgatataagacattggtccaagttcccatcatttacgcctcttctgggtcagattgagacagatggtggcaagtctctggactttagcaactatccttatatatttatgagatggaaagagcaatattttgtcaacgttggagtcgactgtgggttaaccatcgctggtttctactacgtctgcttttcttgtagcgatggctccattaatggattttattatgatccaaatagcagtccatttcagaagctcgagctgaagtgtaccaatgagaaaaaatccgggttcaccttttcatcctacgagctgcaatgacaggacagatgcccttgacagacaactttttggt

SEQ ID NO: 42836 - DNA, 425 bp, Zea mays
  Clone ID: LIB3062-011-Q1-K1-C10
ctcctttcagacgaagtaccgactttaccttgtcctggacttcataaatgggggccatggcttcttccagctttaccaccagggtttatttagggaggagcttgcacgcatctacactgctgaaattgtatctgcggtcgcccacctccatgccaacggtattatgcatagagatttgaagcctgagaacatcttactggatgctgatggtcatgctatgctgactgactttggtgtggcaaaagaatttgatgaaaacactagatcaaactcaatgtgtggtactgttgaatacatggccccagaaattgttcagggccgaggtcatgataaggctgcagactggtggagtgtgggagtccttctttttgaaatgcttacaggaaagccaccgtttgttggtggaaacagagacaagattcagc

SEQ ID NO: 42837 - DNA, 428 bp, Zea mays
  Clone ID: LIB3062-011-Q1-K1-C11
cccactagctgaacttgaacgccgctgtagacataatggcctctctctgtgtggtggtaaagaaatgatggtcgccaggctgcttaacttggaagaggctgagaaggaacgaatatacgagaaagatgttgacatgaaatatgtgcagggtgaacagcatgtggttggaagagaggacagtggtgtgaatgctcatagtacttcaaggtttggtgaaggttctaatggtgatgaattagatgtctctcggaacagtacgagagctggtaaaggacgttctggtggatctgcttctgccgaacttgaatcatttccaagcaagaagccgaaatacgatcctgttttgccagcttctaaatggagtcgagaggatgacatcagtgacgatgaagataggaaaggtggccgaggcttgggattaagctatt

SEQ ID NO: 42838 - DNA, 421 bp, Zea mays
  Clone ID: LIB3062-011-Q1-K1-A5
gggaaatccatggatctacatgtaccctaaaggcctaaaggatctccttatgatgcatgaagaacaaatacggaaacccgcctatctatatcaccgagaacggaatcggggacgttgacacaaaggataatcctctatccatgcaagatgcgttggacgactacaagaggctagattacctccagcgccacatctcagttatcaaagaatcaatagacttgggggcggacgtgcgcggccacttcacatggtctctgttggacaacttcgagtggtctagtggctacaccgagcgttacggcatcatctacgtcgaccgtgacgacggctacaggcgctacctgaagcgctcagctaagtggctgcgagagttcaacggagctgccaaaaaggctgaaaagaaagttcttacgccagctta

SEQ ID NO: 42839 - DNA, 310 bp, Zea mays
  Clone ID: LIB3062-010-Q1-K1-G6
agtgttcttccggttcttgtcctataataactgcagcttttattagtatagtacgtaggagctgtagctgtagcgagtgcgaaaaggtagcgaaaccctgctcctcggaggaagtacatctgacatataggaggagcacaagagagcaggccatcatccagtccacacactgcggcgaccacaagccagtcttttcccgttgctcagacccaaaacgatccagcggcacatcacatcacagggcacagcgagtcagcgaaccacaccctgaagagagaacacctctctcgcgctctacaataacgttccg

SEQ ID NO: 42840 - DNA, 437 bp, Zea mays
  Clone ID: LIB3062-010-Q1-K1-G8
ctttcccgccgactgatcccaccaattctgcacccgcgcagttcctgattcgagtgggaagcgcaattggccgctcctgaccagacgccggatagggctggatttgattggattggatccccaattgtgtttgccacgtccgtgcgttcgggcgggcgggggagttactttagggtttcggcgggtgcggtcgccgtgtaggcggtagggttttgccatggcggagaagggctgcctcaagcggctccagaaggagtaccacgccctctgcaaggagccgcctccgcagatcgttgctcgcccgctgcccaacgacatactggagtggcactatgtactggaaggaagtaaaggaacgccctttgaaggtaaagatcatacataatataccacattatctactgcctccaatatttgttttggtacttataaatctc

SEQ ID NO: 42841 - DNA, 421 bp, Zea mays
  unsure at all n locations
  Clone ID: LIB3062-010-Q1-K1-G9
cacaacacaagctcgtcgtcgatggcgcggtgggctgcggtgctggcgctggccgcgggcacggtcatcgccgtggcgtccgtggcgggcggcgacatgaacgcggacaagacggagtgcgcggaccagctggtgggcctggcgccgtgcctgcagtacgtgcaggggcaggcccgcgcgccgtcgaccgactgctgcggcggcctgcgccaggtgctggggaagagccccaagtgcctgtgcgtgctcgtcaaggacaaggacgaccccaacctgggcatcaagatcaacgccaccctcgcgctcgcgctccccaacgcctgcggcgccacccgcgccaacgtctcccactgcgctcagctcctgcatattcccccgggctccaaagacgccgncgtcttcagccccggcggcgacaagg

SEQ ID NO: 42842 - DNA, 279 bp, Zea mays
  Clone ID: LIB3062-010-Q1-K1-H1
agcaaagcgccggaaaccaaaccaccgccgtctcggctagctaacacgtacactagcggtgatccccatggcaatgctgccgcgtccaacagcgctcgtcgcagcggtggtggtggcggcggcgctggtgctcgggatggcgtcggcgcaggggccggccgccgcgcccgcgccgggcccggcgcccgggatcagcgacgagtgcttcaacgcggtgctcaacatgtcggactgcctgacgtacgtgacggcgggcagcaaggcgcggcacccggacac

SEQ ID NO: 42843 - DNA, 350 bp, Zea mays
  Clone ID: LIB3062-010-Q1-K1-H10
cttgatcccaagaagctcgaattgtttccaaaggaggcacatttaaacctgagaacatgtcaggcagagaacctttcatccctggaggttccagaggaaacattgttggctgtgaagccggagattgcagtccacagccattgggagcaggccttcaagatttcctgttcatcccatgggttcaatcaatctgcttccgtccttctcgtataagtcacacttatacctttattttagaaatatgttccttaagaaccttgtagctgcaaatataaatgtcatgaacttttctttattcctgttcgtttcttgctgtttctacatttcagaggatattttccttgcactgg

SEQ ID NO: 42844 - DNA, 418 bp, Zea mays
  Clone ID: LIB3062-010-Q1-K1-H11
gtcttggggttggactgagtgcgctcgtcctgtgaatctggatcctgggcaccagtcgggttggtgtagctggagcctggagccggaaaggacacacgatgaatcaggaggcgaaggactcgaggccctcaaggtctcccagcgagccaaacctcttcctgcaatggggcagccggaagaggctgcgatgcgtcaaggcgcgtgacgatggctcgccatcgccgtctgaaggtcttagacgcgccataccccgtgctactaggcccctccttggagctgacattgcggcattccggcgccctagcacctttaaccgcaggaaatcagattcactagtgaacgagtacaggcactcgatggcgctatcgctggagaaagacaagtattacacaacgaggggttcaccgttcgatggaaa

SEQ ID NO: 42845 - DNA, 432 bp, Zea mays
  unsure at all n locations
  Clone ID: LIB3062-010-Q1-K1-H12
cgagagggccattgccaacgtgccccctgcagaggagaagcgatactggcagaggtacgatatgcctctggattaactatgcactctatgangagctagacgcacaagacagagaacggacaagagaggtttacaaggaatgcctgaggttgattcctcacaagaaattcacgtttgcaaagatgtggctcatggcggcccagtttgagatacggcagagaaatctaaaggctgcaagacaaattcttggaaatgcaattggaatggccccaaagggcaagatattcaagaaatatattgaaattgagctttatctgggcaactttgaccgttgtaggactctttatgagaaatatattgaatggtccccagcaaactgttatgcctggaggaagtatgccgaattggagaagaaccttagtgagactgatc

SEQ ID NO: 42846 - DNA, 412 bp, Zea mays
  Clone ID: LIB3062-010-Q1-K1-H2
catcagcgccctgatatgagaacccctggagttgatgctcaaggccaacctattgaccctgagaagatgcaggggcaggtttaggacttctatgaggacatctatgaggagttggggaagtttggtgagattgagaatctgaatgtttgtgataaccttgctgaccacatgattgggaatgtctatgtccagttcagggaggaagagcaagcagccgcagcatacaatgctcttcaggggcgcttttactctggccgccctataattgttgagtattctcctgtgaccgacttccgtgaagcaacctgtaggcagtttgaggagaacagctgcaaccgtggtggctactgtaatttcatgcatgtgaagcaaattggcagggatctcaggaggaagctgtatgggcgttctg

SEQ ID NO: 42847 - DNA, 385 bp, Zea mays
  Clone ID: LIB3062-010-Q1-K1-H3
caagtgtgtgtactagcaaccagctagctcgttcggcagcaggcagccatcatgtcggaggggaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaaga

SEQ ID NO: 42848 - DNA, 347 bp, Zea mays
  Clone ID: LIB3062-010-Q1-K1-H5
ggcgcgccgtgtcgcccgcgtgctatgtttcatcagttcgacgagcggctgcgtgtgggcacgtgcaagcagccatgtctttttgcgtatagggtactggttgctttactctatgggctggaccgctgggccaaaatttccaaattccaatcaaggcagatggatcgtccatgatttaatcggacgatcaagtttctggtcgctctgattacgtcgttaccgctgatcagcttcacagttacgatgggtcgattaatcatgattaatggacgatctgaaaacactgcaagtaactttgtaatacagactggtgcttgtggcggccacactgcacgacacattggaca

SEQ ID NO: 42849 - DNA, 288 bp, Zea mays
  Clone ID: LIB3062-010-Q1-K1-H6
tcgccgagcttttgctggagaattcccagttatccaccgcaaatctttggctcatagttgggtttttcacaccaacacactccatgtttctgcttaaatgatccgcgtatgaagtttaactgttccttcttgcgcaaataagtgggcccttcaaaaagatcaaggcattgagctggtcttttctgcatattttgagcctgatacccgtcttcactgttgctgcaacaccattaccgcggtgctgcgtggtggcttctgccttttctttgattcggcaataatgctctt

SEQ ID NO: 42850 - DNA, 321 bp, Zea mays
  Clone ID: LIB3062-010-Q1-K1-H9
ggttcatcaatttgcaagtcatgttccttaaatgatacagcaagtcaaacagctccaagagggctgacaaacatccaagcaaatgccgtggaggagaccagcacatggcgtgctgcattggatgcgtcgattaacgaagtgctgttccagatcataaagttcgccaacgagaaaaaggaccacattcctgctatccctgacaggattttcaatcacgagatcatgatcctaagctcggattatgtatctgtatggaacacggacgtcattcgcagagttctgaatagcgggcacccatactcgctctaactgaagacgaca

SEQ ID NO: 42851 - DNA, 429 bp, Zea mays
  Clone ID: LIB3062-011-Q1-K1-A10
cggacgcgtgggtgtctgtatgaggtcgatggacagaggcccagagcacacaataaatggaggtttttatgtagctgaaggtgcaaaaatgtgtagtgtggagcaggtcagggttgcacaagctctttatgtatctggtagcctgttcaatcactcatgtcagcccaatgtgcacgcatattttctttcacgtgcgttcgtgctgagaactactgaatttataaagtccgggagcccagttgaactgtcatatggtccacaggttggcgagatgcatatttcagagagacagaagtcacttcaagagaattactacttcagttgtcaatgttcaagttgttcagagctaaacctatcagaccttgttatgaattcattctgttgtccacaaagcaactgccttggtgccatatcggaatcaacttacta

SEQ ID NO: 42852 - DNA, 445 bp, Zea mays
  Clone ID: LIB3062-011-Q1-K1-A11
ctcactcgcccctctgcatttaccactttgccctcgtcggcggcgctgaccacccgccgccgagtccggcgaaagaaccgcctgtagttccagagtagtacctcatggcggccatatcgtcgcttcccttcgcggcgctgcgcggagccgccgagtggaggccgtcgtcgacggcggcggccgtctccggcgccgtcgtgctcagcgcgaggtctcgccggggctcgcgctcggtggtgcgatgtgtcgccacgacgggtgatgtcccacccactgtcgcagaaacaaaactgaacttccttaagtcatacaaacgcccaatcccaagcatttacagtgcagtcttacaagaacttttggtgcagcaacacctgatgagatacaaaaaaacctatcagtatgatgctgtgtttgctcttggcttcgtcactgtctatgatcagct

SEQ ID NO: 42853 - DNA, 427 bp, Zea mays
  Clone ID: LIB3062-011-Q1-K1-A12
cggacgcgtgggggggaaggagggagggagccatggttgtcagcacattcactggctcggggattgggatcgggttcggtgtcggctgcgggttcggcgtcgggtgggggttcggaggaatgcctcttaacacgttcggcttgggtattggtgggggctgcggagttggtcttggactaggatggggctttggaaatgcttttggttgtcagtatcgatcttcaagagtccagctccagggcattgaatttcagaagaaggctggaggagatgaatcacaaaaagttgtttcacctgagcttgctgaaaagtctcatccttatggctagtatgcctgctaccacaaaatccacagagactgagttctgtgtgctgagttgcagtttaattacatatatgtgagttctttgttagtaatgttatgcta

SEQ ID NO: 42854 - DNA, 401 bp, Zea mays
  Clone ID: LIB3062-011-Q1-K1-A2
acgcgtacaggcgtgcatgtcggcggagatgcagctgtgcgacgtgggcacgcgcttcatcagctgggacggcgtgcacttcacggaggccgccaacgccatcgtcgccgccaaggtgctcaccggcgactactccacgcccagggtcaccatcgccaaactcgtcaactccacgctgcccaacgacgactagctggctggccgatcgatcgatcgatcgtcgtcgtcgtcattctgatgaacatactgcaggctgcaggcttcatcgatccatatccaattgtccgtagaaatctacgactagctcattgtagatctgtaatgtgggctaagagatgcatgacgatcgactatagctgcccaacatcgcaagagctgggtcaccggcctcgtcatgatcg

SEQ ID NO: 42855 - DNA, 376 bp, Zea mays
  Clone ID: LIB3062-010-Q1-K1-G5
cgtccacggcgcaagggagagtgacggaaagcgactcggcgcgagcgatgagggccaaggggaggaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctaca

SEQ ID NO: 42856 - DNA, 399 bp, Zea mays
  unsure at all n locations
  Clone ID: LIB3062-010-Q1-K1-F10
ggctgatcggcgaagtcttcctgctttgtggcgtgggggatgtgttgatgttgctggtgtggtggtgggggcgggggaggtacgatttgtacttnctgatggtgttggtaagcgtggtgcggtggatgcggggcgagggcgtggatatatggtggaaggggctgctggtaagtgtgtgcgacaactctggggttgtcggctggctgcgcccgtgccattctgtctctggtggcctttgtttcagggcagtctttggtttggtgggcgcagtcttcgccatggaagatgcagtagaatcggcgcggcggttgctcacgcccccgacccctaccacgagttccatttctgtagccctaagggggatattccttgcgacgaggggcgtcagcagcggggtgc

SEQ ID NO: 42857 - DNA, 416 bp, Zea mays
  Clone ID: LIB3062-010-Q1-K1-F11
gtgagtacatggagaagcacgccgtctcccgtttggttggtgccccacctggatatgttggttatgaggaagggggccaattgactgaatcagttcgtcggcgaccttactcagttgttctgtttgatgaaattgagaaagcacaccaggaagtctttaacatattgttgcaactgttggatgatggaagaatcactgattcacaaggcaggactgtcagcttcactaactgtgtcataatcatgacatcgaacattgggtcaccattgatccttgacacacttagaaacaccacagacagcaaggaggccgtgtatgagataatgaagaagcaggtgattgagatggcccggcaaacattccggccagaattcttgaacaggatagatgagtacattgtgttccaaccactggat

SEQ ID NO: 42858 - DNA, 428 bp, Zea mays
  Clone ID: LIB3062-010-Q1-K1-F12
cggacgcgtggggatggaagaacactctgttactgggcatgttgcgcggtttccacgcgtgtgagtaatgtagaagtcgctatggtaggtatttccataccgtcattagtggatcattgaatttttttgtaagaaggttattgcaatgccctttttccgggcatgaataagaaaaaggaaatatgcttaaaaaaaaaaaaaaaaaaaaaaaaaaaaaaaaaaaaaaaaaaaaaaaaaacaaaaaaaaaaaaaacaaaaaaaaaaaaaaaaaaaaaaaacataataaaataaaaaaaaaaagaaaaataaaaaaaataaaaatgaacgaagaattacaacgaaaaaaaaaaaaaaagggcccgccttttaagaaactcaatctttcttgcgggggtttccaaattcaaaagcttttttaatggccccca

SEQ ID NO: 42859 - DNA, 419 bp, Zea mays
  Clone ID: LIB3062-010-Q1-K1-F3
ccaagatccaggacaaggagggcattccaccggaccagcagcggctgatcttcgccggggagcagctggaggatggtcgcaccttggctgactacaacatccagaaggagagcaccctccacctggtgctccgcctcaggggtggtatgcagatttttgtgaagacattgactggcaagaccatcaccttggaggtggagtcgtctgacacaatcgataatgtcaaagccaagatccaggacaaggagggcattccaccggaccagcagcgcctgatctttgctggcaagcagctggaggatggccgtaccctcgccgactacaacatccagaaggagagcaccctccacctggtgctccgcttgcgaggtggtatgcagatctttgtgaagaccttgactggcaagaccataaccctg

SEQ ID NO: 42860 - DNA, 383 bp, Zea mays
  unsure at all n locations
  Clone ID: LIB3062-010-Q1-K1-F4
ctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtg

SEQ ID NO: 42861 - DNA, 424 bp, Zea mays
  Clone ID: LIB3062-010-Q1-K1-F5
cggtatagagctgcctgcaatccgccgctgagaagggaggatcggaagcgacgatgaggtcgtttgctggtggctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgttcggctccgggttccagtccaagagcgagtacctgttcggcaagatcgacatgcatatcaagctggtgccaggcaactccgtggcacggtcaccaccttctacctgtcgtcccagggcgacgcgcacgacgagatcgacttcgagttcctgggcaacgtgagcggtgagccctacacgctgcacaccaacgtgttcacgcgc

SEQ ID NO: 42862 - DNA, 164 bp, Zea mays
  Clone ID: LIB3062-010-Q1-K1-F6
actagttctagatcgcgagcgtccgcctgttttattttttgtttctgccgtatgataggtaaccatttaacgttccctgttttttaattggaactcgctgcgattggcatctggcagttggttgggaaaaaaaaaaacaataaaaaaaagaaaaaaaaaataaa

SEQ ID NO: 42863 - DNA, 396 bp, Zea mays
  Clone ID: LIB3062-010-Q1-K1-F7
ggcggatccagaccggccccggtcgtcctgtttctcctcgctgcgtccgggatctgcgcccagttcaccgcagtgctagctggtgatccccaaacatccaacgatgataagaaggctgaagctcagccaaagggccataccggcaaaacagttttgttcgtcctcctaggagtgggggctgtcattctggtgtcatttgttattttcaagtattggcagaagaagaaaaggcaggaacagcatgcacgtctgctaaagctatttgaagaggatgacgacattgaagttgaactaggacttccagattgaataatcttaattgtacagcaagagtatctcggctgacagggttctgctggcttgccttcaaagcatattcatgttaatgtaaagaat

SEQ ID NO: 42864 - DNA, 414 bp, Zea mays
  Clone ID: LIB3062-010-Q1-K1-F8
acgcgtacagattctccatctcttggtccagaatactgccgaagggaacgctcgaaggaggtattaatcaggccggcatcaagtactacaaaaagctcatcaacttattgatagagaacggaatagagccatttgtaacaatttttcattgggacgtccctcaagcactggaagacaagtacggtggctttttaggcgacaggattgtaaaggattacacagacttcgctaaggtgtgctttgagaacttcggtgacaaggtgaagaattggttgacctttaacgagccacagacatttacaaccttttcgtacggaacgggagtttttgcccctggacggtgctcaccaggagaaaaatgtgctcagcctattgctaactcactcaccgaaccatacattgctggccacaaca

SEQ ID NO: 42865 - DNA, 438 bp, Zea mays
  Clone ID: LIB3062-010-Q1-K1-F9
gcttgctggcgatggagaagtggaaccaaatcaagagcaggttttgcagatagcccttgagatttgcaaggagggtgttctttccctctttgttcagaatcttccttcattgggttgggaggtatgctacattcacgaattgaatgcaataacctttttttcactcagttattagcctttttggttctatgttgcaggctagaaaggatcttgtccactgctggtgtattttgttgagacagaaggttgatgaaagctattgttgtgtccagtatattgaaaatcattttgatcttttggatttccttgttgtttgctataagaacttggaagtcgcgttgaattgtgggaacatgttgcgagaatgcataaaatatcctacacttgcaaatgctctttcagatatatattggagtcaagcagcttcgagttgttttt

SEQ ID NO: 42866 - DNA, 419 bp, Zea mays
  Clone ID: LIB3062-010-Q1-K1-G1
tccacgacgcaagggagagtgacggaaagcgacgcggcgcgagcgaggagggccaaggggaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaagtgaagagcacgagtttgatgctccagacgacgcctacatccttgacgcagccgagactggccgtgtgggagtgccatactcgt

SEQ ID NO: 42867 - DNA, 427 bp, Zea mays
  unsure at all n locations
  Clone ID: LIB3062-010-Q1-K1-G11
aaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttccccgccgccgcacctaatttccttccatccgacccctacgaccgcgccattgctcgcttctgggcctcctacgtcgacgacaagttctacagcgcgtggatacccgtgttcaggggcaggacggcggaggagatggcggaggcggcgaggcangccgtcgcggcgctggagacgctggagcaggcgttcagggagtgct

SEQ ID NO: 42868 - DNA, 413 bp, Zea mays
  Clone ID: LIB3062-010-Q1-K1-G2
caaatcagaaaggggaagggaagaacggcccagcaatgccgctctgcagcttctacgcctccacctccgttcccgtcgggaagccccagcagtccgtcgcctcgtccaagccccccaccacggcggtggcctccgtggcgacaactgtgccgatgcgcagtgcagcgacggtgacgccagccgtggccacaacaacgagcctagcgctgtctctgcacctgccggagctgccgtcgcaagtgaaggacaagatcctgagcctggagctgatgggcgtggactatgggcgcgcgctggagcagaacccggcgctccgcgacgcggcgccggagtccatccacgcggtggtgtcgttcctccagtcccgcgggctccagttcaaggacctgggccgcgtcttcggcatgtgcccg

SEQ ID NO: 42869 - DNA, 408 bp, Zea mays
  Clone ID: LIB3062-010-Q1-K1-G3
ctacggtgacgtgagccgccccaaccccatgaccgttttctggtcgaagacggcacagagcatgacgtctcgcgcaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatgga

SEQ ID NO: 42870 - DNA, 427 bp, Zea mays
  Clone ID: LIB3062-010-Q1-K1-G4
acgcacgcattcgcggacgcgtgggccgaaatcatcgatttcgatgtcgtggagatcttgatcgaccgggcttgatctgcctctgccgctggcggcagctcggctgcccatacaagtgctactgcggatggtaagtcagagcggctcacgctcaagaccacggacatggaaacggtgtacgagctcgggggaaagatgattgacgctcttgggaaggagaaagtgcagagcggggatgtgattgcgcttgacaaggcctacgggaaggtcaccaagctcggacgctccattgggaggtcgcgggattatgatgctgttggcccgcacaccaaatttgtcaagtgtcctgatggcgagctccagaagcgcaaggagatcgtgcactgtgttaccttacatgagatcgatgtcatcaataacaggacac

SEQ ID NO: 42871 - DNA, 372 bp, Zea mays
  Clone ID: LIB3062-010-Q1-K1-F1
gcgttgaaggcggaaagctgcagagtgggaccagcaagccgcgccagtgtacatgtcggcggcgtcacacgtgcgctcctctcgtccatcctccacacgtgcgctcaaaccgagcttgtccgcggaccgcaccctgtctggctgtctgcacgcatctccaccgtccgatccccagccgatggcggcggagaccgcggcggacgaccacgatctccggccacccctggcggatggcgccgctgctgccggcgtgggcgacgcctccttggcggcggcggcgggcgcggcagaggcgctgatgagcgcgacgtcggagcagctcacgctggtgtatcagggcgacgtctacgtcttcgaccccgtcccgcccca

SEQ ID NO: 42872 - DNA, 423 bp, Zea mays
  unsure at all n locations
  Clone ID: LIB3062-010-Q1-K1-D12
ctatagaccacagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggnaggcgaaggcggcgccgtcgtcagctgggccatggagttcgaca

SEQ ID NO: 42873 - DNA, 321 bp, Zea mays
  Clone ID: LIB3062-010-Q1-K1-D2
tacccccgatggtaagcattctctgagatataacataagcattaagactacaccacaacctctcaagatccacgctcatatagagatgaaatgcttacagtttaatagattgctccatattaagcaagctatgaacaaagctgaagctcctgacaatgataactgtcctgtgaagattaagctacttgcttctacactttatgtttataccacacatacccttgacaatgatcaaggcatttcactcctcactactgcactcaatgcttgtacagcatagattgaaaagtacaaaggaaagttagtactgaatgaaccacc

SEQ ID NO: 42874 - DNA, 177 bp, Zea mays
  Clone ID: LIB3062-010-Q1-K1-D5
cccgaactactttggggagatattcctttggtggggagtattagtcgcatcgagccggggtatctcagatgccgaatggcttgtgattcttggacctatatccctgactcttctgcttattttcgttagtcgaatgccacttctcaagtcatctgctgattagcgctcataacgatt

SEQ ID NO: 42875 - DNA, 440 bp, Zea mays
  unsure at all n locations
  Clone ID: LIB3062-010-Q1-K1-D6
gtgacttgctgcctccgcttccctggacagctgaactcggacctgcgcaagctcgcagtcaacctgattccgttccctcgcctgcacttctttatggtcggctttgcgccactcacctcgcgtggctcgcagcagtaccgtgctctcactgtccctgagctaacccagcagatgtgggatgccaagaacatgatgtgtgctgctgacccgcgtcatggccgctatctcacagcatctgccatgttccgtggaaagatgagcaccaaggaggtggacgagcaaatgatcaatgtccagaacaagaactcgtcctacttcgtggagtggatccccaacaatgtgaagtccagtgtttgtgatatcccgccacgcggcctctccatggcctncaccttcattggcaattccacctncatccaggagatgttccgccgtgtgag

SEQ ID NO: 42876 - DNA, 242 bp, Zea mays
  unsure at all n locations
  Clone ID: LIB3062-010-Q1-K1-D7
cgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctcttccaccctgagcagctcatcagtggcaaggaggatg

SEQ ID NO: 42877 - DNA, 334 bp, Zea mays
  Clone ID: LIB3062-010-Q1-K1-E11
cgaaaatttccagatactcgtactcttttcatatggcataacacactagcattaagtcgtatgagagaccttgccaaagaattagtgcttggaggggaagaatgacctagaactgaagatggatgagctgatgtgaaaaatgaggggaagaatgacctagaactgaagatggaggagctcaggtgaaaaatgaacttgttcattgtgtgttttctgacctttttttggaattgtattaaaatatactgtaatgaattggtgtaagaatatgttggaagtagcaaagaacctgatgccttttgcaatgagaatgtctttctggcaatttatcctg

SEQ ID NO: 42878 - DNA, 390 bp, Zea mays
  Clone ID: LIB3062-010-Q1-K1-E2
cccacgcgtccgcccacgcgtccgcggacgcttgggcggcggcaacaagcggtacgtggaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctc

SEQ ID NO: 42879 - DNA, 390 bp, Zea mays
  Clone ID: LIB3062-010-Q1-K1-E4
gcgatccatcggtgcggtttgcagcctggactggccaaggtcaaatttcctggtccaggtgttggatgactctgatgatgctaccacttcggcacttatcaaggaggaggtggagaaatggcagcgagagggtgtgcgcatagtataccggcaccgggtgatccgggatggctacaaggctggaaacctgaaatcagccatgaactgcagttacgtgaaagactatgagttcgttgtcatcttcgatgctgatttccaaccacaggcggacttcctgaagcgcaccgtgccccatttcaagggaaaggatgacgtcgggttggttcaggcgagatggtcgttcgtaaacaaggatgagaacttgctgaccaggcttcagaacataaatct

SEQ ID NO: 42880 - DNA, 443 bp, Zea mays
  Clone ID: LIB3062-010-Q1-K1-E5
cttcttccctttattaagaacatgtacttactattatttaagggctcaaacattggagaagccaaagtgacaacttctgttattcgttttctaggactgttcttacccaagattttctaggttcttgccaagattttctaggttaattatcctgatcacaatcgttttaccaaacgtctatcacaaataccatctttctcatctgtgaaatgaaggaaatactaagcttctccatgaccaaagtccgcttcctataatctcacgtgagcctggcacgtagtaagcgctatagacattttaagtgtcacacgaagcttgaaaaaaatgagacgtgtgacattttagctatgactagtatttttttctacaatggaatcgttcaagatacactgctagaaaccgggtttcccgtcgtgcctaaaagtctcggtagcacgtgtctg

SEQ ID NO: 42881 - DNA, 455 bp, Zea mays
  unsure at all n locations
  Clone ID: LIB3062-010-Q1-K1-E7
cgaccgacgcgttcggcgttgagggcggaaagctgcagagtgtgacttgcaagccgcgccagtgtacatgtcgtgcacggtcacacgtgcgctcctctggtccatcctccacacgtgcgctcaaaccgagcttgtccgcggaccgcaccctgtctggctgtctgcacgcatctccaccgtccgatccccagccgatggcggcggagaccgcggcggacgaccacgatctccggccacccctggcggatggcgccgctgctgccggcgtgggcgacgcctccttggcggcggcggcgggcgcggcagaggcgctgatgagcgcgacgtcggagcagctcacgctggtgtatcagggcgacgtctacgtcttcgaccccgtcccgccccaaaaggttcaggctgttcttttggtacttggagggtacgagattccgnctggtttggtaaacatggct

SEQ ID NO: 42882 - DNA, 440 bp, Zea mays
  Clone ID: LIB3062-010-Q1-K1-E8
cggacgcgtgggtgtatgagcttatataagctttcaattcagcatgaaaagaagacggatgatatactggtaaaacaattaggggaaaatgactcacggactgaagactcaaaaaattggttgaatacatttaagcttcgagaagagcaggtcaacgcccagaagcagaagggccaggaagctaatgcatccgataacgctgttaaattcttgaaggcaaaccctgcagttttacaagcaatgaaggctgctgcgatccaatcaggtggtgtgtcagcaaatgtcaacaggtcgctcaatgctgcagtcgttggagaaggtgtaccacgactgagaggagtggatgagcgagctgctcgagcgactgcagaagcccggaagaaagctgctgcaagaggccttaatgtccgtaatggccctgtggcaaaccatgcgtctga

SEQ ID NO: 42883 - DNA, 425 bp, Zea mays
  Clone ID: LIB3062-010-Q1-K1-D11
agcgaaagaaaaggtggccttttcgaagccgccggacggagtgtagcgctagctagctgcccaggccggagaggaggatggtgggacgaggagcggcgacggccctcgtgtgggcggcggtggtggcggtcgcgacggtggtgtcgcgggcgcagcagctgcaggtggggttctacgacacgctgtgcccggcggcggagatcatcgtgcaggaggaggtgagcaaggcggcgtccggcaaccccggcgtcgccgcgggcctcctgcgcctccacttccacgactgcttcgtcagggggtgcgacgcgtcggtgctgctggactcgtcggcgggcaaccaggcggagaaggacgcggcgcccaacgccagcctgcgcgggttcgaggtcatcgacagcgccaagacgcggctggagcaggcctgc

SEQ ID NO: 42884 - DNA, 426 bp, Zea mays
  unsure at all n locations
  Clone ID: LIB3062-010-Q1-K1-B7
atagtgatgagtcactattgcaagaagacaattcactgtcagctgatctaagcagcagcctccactttggagatgcaactggccaagaccacatctttgctacatctaaccctgtaccgacaaaccaaagaggagatcaattatttcatgtgtcctctcaaggagtgagtgcccattccagtgttctcatcaactacggtggttacaaccctcaaaattatcctcagcaaaatgcccgtcctcgtcatggacagccaattctccatcagcgatataatcaggcaacttccagtccaatgcggccaatgggaagccatcacaatgggcagcctgcgtggcctagtagttttggcatgggcgatggagtgccctggggaggaacaagagggcactcatttnacgacaaggaaggattatgggagcatc

SEQ ID NO: 42885 - DNA, 422 bp, Zea mays
  Clone ID: LIB3062-010-Q1-K1-B9
cagatcagcatctacgaccgccaggtgacggaggaccagatccagcgggacctagccatgaacaagttcgactgggaccacccgatgcacctgcagccgacgagcccgacggccgtgaagcaggtgagctgcgtgtgggacgcgtacgaggccaccaagggcgcccacgggctgtgcatcctgaccgagtgggacgagttcaagaccctggactaccagaagatcttcgacaacatgcagaagcccgccttcgtcttcgacggccgcaacatcgtcgactccgagaagctgagggagatcggcttcatcgtctactccatcggcaagccgctcgacgcctggctcaaggacatgcccgcggtcgcctaatcccacccccctcacccatggattggattccgggaaggaagaggagagaagct

SEQ ID NO: 42886 - DNA, 316 bp, Zea mays
  Clone ID: LIB3062-010-Q1-K1-C1
cctaccacaccctatcgcattaatacactgcactgtcagctaaactaaacgcagggcttcatctaacgatgcataccgccaataccacatctttcttacatctaacactgaccaccactacctcaacaacgactaacaaacctacggctatttctcgagtcaaagatcattctcaatctctaaacacctacgtcccttacatccctcaaaatcaccctcaccacaaagcacgcgattctcatcgacatccaattcatcatcagcaatgtactcaaccaactcaacatcacacgcaaccaatcccaatccatcacaa

SEQ ID NO: 42887 - DNA, 413 bp, Zea mays
  Clone ID: LIB3062-010-Q1-K1-C10
cggacgcgtggggttttgtggtacgacatatcaagtttgctgagaactaccgtatttagtctcgaagccattttgtgaaagggatggaggttgcacttttgttggtgatcttcctagcgtatgggtttaacaatggtggagcagttggctatattttactctctataagcagttggattatggcattgtcttggctttttgctccctatttatttaacccatctggatttgaatggcagaagattgttgaggatttcagagactggacaaattggctgttttatcgaggtggtattggtgttaaaggagaagaaagctgggaagcttggtgggaagaagaactgcaacatatttacagcattcgagggaggatactggaaaccatattaagcctgaggtttttcattttccaa

SEQ ID NO: 42888 - DNA, 416 bp, Zea mays
  Clone ID: LIB3062-010-Q1-K1-C11
cggagggcctccattgtgatgcgatgcgaaggctgtggacagaaaataggaaaacgtgtggggatttgtctcgtctgtccgctccgctccccctacatttctttgctgtttagtacataattctagatttacagaaaagacaaagtttactcttttctggatcatatgttttgtgctacttattgctgctctggccgcattgggccagcatgcagttattcacgggttcaacctgacaagcgctggctgcagcagcgaggtgtttgtaggtttcgcggtgattcgtctacccaaatctggaaccgtactgatactgaagaccgtactgatactgaaggcattatccggcgtgaactgctaattcaaacattattacacgaatgcataaggctgagcacggcttttgggcttgaact

SEQ ID NO: 42889 - DNA, 421 bp, Zea mays
  Clone ID: LIB3062-010-Q1-K1-C12
cggacgcgtgggcggaaatcatcgagggcgaggtcgtggagatcttgatcgaccgccgtttgtcggcctctgccgctggcggcagctcggctgcccctacaggtgctactgcggttggtaagtcggggcggctcacgctgaagaccacggacatggaaacggtgtacgagctcgggggaaagatgattgaggctcttgggaaggagaaggtgcagagcggggatgtgattgcgcttgacaaggcctccgggaaggtcaccaagctcggacgctccattgggaggtcgcgggattatgatgctgttggcccgcacaccaagtttgtcaagtgtcctgatggcgaactccagaagcgcaaggagatcgtgcactgtgttaccttacatgagattgatgtcatcaatagcaagacacaaggttt

SEQ ID NO: 42890 - DNA, 425 bp, Zea mays
  Clone ID: LIB3062-010-Q1-K1-C2
gatgatcaagggctgctgtgtgggtccaaagaagagggtggtgaccctccgccagtcgctggtgaagcagacttcccggctggcgctggaggagatcaagctcaagttcatcgacacatcgtccaaatttgggcacggtcgcttccagactaccgatgagaagcagaggttctttggcaagctcaaggcgtaaggtgctgcggtgcagcgaagtcccatttctcaaaatcatcaaactgtgatacttttgtttgtaaccttgctgtaccaagttttgtagccatggtccggtcgtctatggattgttccatgcttcagaactgcactgtctatgttttgtgctattttggttgtttaatggcccaatcattgcatatagattctaattgtcatggcgtttgatgatcaatataactatttatact

SEQ ID NO: 42891 - DNA, 442 bp, Zea mays
  unsure at all n locations
  Clone ID: LIB3062-010-Q1-K1-C3
tgaaaactgtcgaaagagaagcaaacacattgcattttatactatagattgcaaggatgcatgtggtgaaatatttgttgacttacagaagcatagctatgttcagaaaaagcctggaggagcaactgaacaacaggagttgacatattctagtcttcaggaagctatctctgtgccttggaatagtctaccgaagaagacggcaaaattatactttgctatgagagtactggaggattatgaattatctgaagggcgcagccctggcgaaacaacactttctgacatagatgcagttctggctcgaaggaaggatatgtgtgataaaatgtctttgaatgagtctcgtattcctactactctcgtggaacgactgctagcagctggaaagaaggagcatcctnctgtatgtgctatccttggtggtattcttggtcaggag

SEQ ID NO: 42892 - DNA, 423 bp, Zea mays
  unsure at all n locations
  Clone ID: LIB3062-010-Q1-K1-C5
cgaaagagaagcataacactattttattttatactatangattgcaaggatggcagggtgttgaaatatttgttgacttacagaagcatagctatgttcagaaaaagcctggaggagcaactgaacaacaggagttgacatattctagtcttcaggaagctatctctgtgccttggaatagtctaccgaagaagacggcaaaattatactttgctatgagagtactggaggattatgaattatctgaagggcgcagacctggctaaacaacactttctgacatagatgcagttctggctctaaggaaggatatgtgtgataaaatgtctttgaatgagtctcgtattcctactactctcgtggaacgactgctatcagcttgaaagacagagcattcttctgtatgtgctatccttggtggta

SEQ ID NO: 42893 - DNA, 431 bp, Zea mays
  unsure at all n locations
  Clone ID: LIB3062-010-Q1-K1-C6
caagccttcagggtggagtcattccacagaaagaaagtcgtggaatacggagatgacacctgtggattaggtggggaatgcacactttcacttgtttctcttaaaaatgtcaaaccaggacaacatgatacacatctgcattctgctgctgttcgcatccagaacaagtttcgcggatggaagggaagaaaggaatttatgatcattcgccagagaattgtcaagctacaggctcatgtacgaggacatcaagtgaggaagaactatcggaaggtagtctggtcagtcggtatcgtcgagaaagtcatactgagatggaggagaaagaggcctgngttacgcgggtttcggccccagaaacaactagaaggtccatcgcanatccaacctgcaaaggctgaagacgaatacgatttcttgcacgacggcag

SEQ ID NO: 42894 - DNA, 408 bp, Zea mays
  Clone ID: LIB3062-010-Q1-K1-C7
cggacgcgtgggcggacgcgtgggctcacagaggttcgcaagaatggaacctgcccgtggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgccggcctcactggccggaagatcatcatcgacacctacggtggctggggagcccacggcggtggcgccttctccggcaaggacccgaccaaggtggac

SEQ ID NO: 42895 - DNA, 443 bp, Zea mays
  Clone ID: LIB3062-010-Q1-K1-C8
cacctatgaggagaaggaggtcggcccggatggccaggaggtgactaaggtggtgcctgctgtcacccccgaggttaaggattctctggttaagaacataaggaggaggatgacaccacagcctctcaagatccgtgctgatatagagatgaaatgcttccagtttgatggagtgctccatattaagcaagctatgaagaaagctgaagctgcgggcaatgataactgtcctgtgaagattaagctagttgctcctccactttatgttttgaccacacagacccttgacaaggatcaaggcatttcagttctcactactgcagtcaaggcttgtacagcagagattgaaaagtacaaaggaaagttagtagtgaaggaaccaccaagagctgttagtgagcgggaagacaagctattcctcgaccagattgattccctaatgg

SEQ ID NO: 42896 - DNA, 439 bp, Zea mays
  Clone ID: LIB3062-010-Q1-K1-C9
ctcatccctgacccccgtaccgcagcgtaaaccctagtccccggcggcgaccttgcggcctccgctgcgctctgactggtgcgcgcttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcaccgcattgatgagagggtatctgcctttggca

SEQ ID NO: 42897 - DNA, 430 bp, Zea mays
  Clone ID: LIB3062-010-Q1-K1-D1
gcttatgacgacaatagtcgctggctccccatatcactggccgttcatccatcccgggcctatgtgttgtcgtggtgtcgctacgatagtgagataataatgaagctttgggactgggacaaaggatgggagtgcgcacgcacattccgaagtggaggcattaatgtagatcatatcgctttcgatccaaaggagaccaaccgctttgttgctaccgattgcttggatggcaaagtgatgatttggagcctcgactctcccgaacctgaatatcatctgcctaagacggattttaagggtatcatgttcctggaattcttcacacgttatggtcggcagtgtttgattattgctcatgaagatcataaagcacacgtatgggacttttcgttgcgcaaatttgtttctgagaagcgaaaattattatctc

SEQ ID NO: 42898 - DNA, 419 bp, Zea mays
  Clone ID: LIB3062-010-Q1-K1-D10
cggacgcgtgggaactcggtctccctctagctcgggaccaaaccaggatgcttcttggggacgggcacgaactactccgcagggacgaggattgaagtcaactgcaagagttcccttgagagcattggcgggatactcgagcaggcggcgagcttttcgcaaactgacccattgaggcagtatcacccgatcagctttgtcgcgaagggggtggccaggaacttcctccttgagccattgtacagtttgagggacgaattctacacggtttacttcaacgtcagggtctgagtcctgacgcttacacttgcagtagaagtaatacagaataaataatgtgcgcgacctttttcttctcatacactgtagcttagaacagccaatgaagaagcaattgggttggttgaacttgttatgca

SEQ ID NO: 42899 - DNA, 472 bp, Zea mays
  Clone ID: LIB3062-010-Q1-K1-B6
ccggtctcggattcccgggcaaggcgatgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtgtctctggccgccgcagatgaggttttaggcaatctgcaggccgccggcccatgtgtattaagtaggttttgctcagttgttggccctggacttcgccggcgtttttgtgaccggcgtccccgagtgcactgcattggtgtactg

SEQ ID NO: 42900 - DNA, 247 bp, Zea mays
  Clone ID: LIB3062-010-Q1-K1-A12
tatattccacatagatccaccaataaacactcatctttacattgattcttttcacactccttccaaaagttactcttaagaattcctacaacattatgaatacttctaaatcacaaatcttccttccaagacagtacattatatctacaaagttacatctatatcactgaatccaaacattcctatgcaaatttttaatctaataatgattaaccctcctaaacctttagatatctcttaccttaac

SEQ ID NO: 42901 - DNA, 437 bp, Zea mays
  Clone ID: LIB3062-010-Q1-K1-A3
cccgggcgcctgccccggcgtcgtctcctgcgccgacatcctcgccctcgccgcagagatctcggtcgagctgtccggaggaccaaagtgggcagtgcttcttgggaggctagacagcaagaaggccgacttcaagagcgcggagaacctgccgtcgccgttcgacaacctgacggtgctggagcagaagttcgcggccgtgggcctccacaccgtggacctggtggccctctcgggggctcacacgttcgggcgggtccagtgccagttcgtcacggggcggctgtacaacttcagcggcacgaaccggccggaccccacgctcaactccggctaccgggcgttcctggcccagaggtgcccccagaacggcagcccctcggccctcaacgacctggaccccacgacgccgaacctgttcgacaaccactactaca

SEQ ID NO: 42902 - DNA, 340 bp, Zea mays
  Clone ID: LIB3062-010-Q1-K1-A5
gttctagatcgctgagcggccaaggtcgttaggatctgatccacgacggcaaggaggggcacaacacaaaggctcgcagggcggctaaagagagaaaggcgcgcatacaagagctccggaaacattaccatacccttcgacaacctgactgtactgcatcataactacgcggccgtgggccttcacaccgtggacctagtggccctctcggaggctcacactttcgagcgggtccagtgacagttcgtcacggagcggctgtacaacttcagcggtactaaccggccggaccccactctcaactacggctaccgggcgttcctggcccatatgtgccccc

SEQ ID NO: 42903 - DNA, 407 bp, Zea mays
  Clone ID: LIB3062-010-Q1-K1-A6
cttgttttccctcctctttatctccagcgcatcgtaaagggaggagcggagcggcgagttcttgtggtttcccaagatgtcttctccaagcaagcgccgggagatggacctcatgaagctgatgatgagcgactacaaggtggatatggtgaacgatgggatgcaggagttctttgttgaatttcgtgggcctaacgaaagcatttatcaaggaggtatatggagggttagagtagaactgccagatgcgtatccttacaaatccccatcgattggtttcatcaataagatatatcacccaaatgtcgatgaaatgtctggttcagtctgtttggatgtcatcaaccagacatggagcccaatgtttgatcttgtcaatgtgttcgaggtcttccttccacaacttc

SEQ ID NO: 42904 - DNA, 418 bp, Zea mays
  Clone ID: LIB3062-010-Q1-K1-A8
gttgtggcaggcggatggcctgatactcgtctgcggcacgcatgtccagcacgccgcggccaagacgagcagcaaagcaaacagtatttgtcccgcggcggcctcttcgtcccgcaaggtcgccccacctagatccggccacgccgcacgttccccttttccgccgcagcgatggtgtacgtggattcctgggacgagttcgtggagcggtccgtgcagctcttccgcgccgaccccaacaccacccgctacgtgatgaagtatcggcactgcgaggggaagctcgtgctcaaggtcactgatgaccgcgagtgcttgaaattcaagacagatcaagctcaggacgcaaagaagatggagaagctcaacaacatcttttttgctctgatgactcgtgggcctgatgctgatatcagtg

SEQ ID NO: 42905 - DNA, 422 bp, Zea mays
  unsure at all n locations
  Clone ID: LIB3062-010-Q1-K1-A9
cgccgcatcactccctcgccactcgcgcgcccgggctccttcccgccacgctcacgacgatgccttcaccgacgtcctatcttctcctgaatccctccaaaccctcctccttccgccgactctcggccccgcgcctgagccggtttcatgtctcctgcgacacgccacggggcggcgggaggagtggcggcgggaggcgcgaggtcatccccgccggtgccagcaaggccaagaaacagatcgtattcttcgatgccgccccgccggtgtcccaggagggcgggggcgccgtggagaaggcggggagcgagaagcttacccaggtgggcagcggcaacgcagcgctggcgttgttgaggagggcaaccaagaggacgctctcggtgctgtccaacctnccgctcgccatctccgagatgttc

SEQ ID NO: 42906 - DNA, 258 bp, Zea mays
  Clone ID: LIB3062-010-Q1-K1-B1
tcccgtcccgacgcacgcgtccggagccaggacaaggagggcatcccaccttactagcagcgtttgatcttcgctggcaagcaggtttaggatggccgcacccttgcggattacaacatccagaaggagagcaccctacacctggtgctccgtctcaggggtggcatgcatatctttgtgaagacacttactggctagacaatcactcttgaagtggagacctcggataccatttacaaagtcaaggctaatatccag

SEQ ID NO: 42907 - DNA, 426 bp, Zea mays
  unsure at all n locations
  Clone ID: LIB3062-010-Q1-K1-B10
aatcgatcaatctgccggtaggtcgatcatagagagcgcgctccacgtctccgttccggtgcggggaaggaaggaaggatagagagagagagagaggagcgatggcgtccgggtaccgcgcggaggaggagtacgactacctattcaaggtggtgctgatcggggacagcggcgtggggaagtcgaacctgctgtcgcggttcgccagggacgagttcagcctcgagaccaggtccaccatcggcgtcgagttcgccaccaagaccgtccaggtcgacgacaagctcgtcaaggcacagatctgggacaccgncgggcaagagaggtacgcccttctttgctgttgtacgctatgcaggttgcagcagatgcagttctaggatctgtgcaccatttttcagagcttcctggttagtaaggatttaa

SEQ ID NO: 42908 - DNA, 420 bp, Zea mays
  unsure at all n locations
  Clone ID: LIB3062-010-Q1-K1-B11
cgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcagcc

SEQ ID NO: 42909 - DNA, 412 bp, Zea mays
  Clone ID: LIB3062-010-Q1-K1-B12
cttctcttattaactacatggttgatgcgcggaaaggaaagaagaatgccagccaaatggaaaatatccaccaagtgcgtttattgcacaatagacatttacagtggctctttataaatgcttatgcagaagatgctttatcttttcaaaaggctactgttgagaataccatgtataatgtttggaggaatactgtaaacctgcgggattctggtaatatgaaaagaataatggtgcaacactttcaacaagaactcaggctttacaacattctgaaagagcagattgcttaccttgaacaatggccaacgctagaaagggagaatagtatctctttactaggggcaactgaggctctgaaagcaagcaccctgcgcctgccagttacattgggagcaaaggctaacacaat

SEQ ID NO: 42910 - DNA, 361 bp, Zea mays
  Clone ID: LIB3062-010-Q1-K1-B2
gaattaccggctcaccatcaattcacgtgaatctaaaccacaaaaaagaagctttatgaacataaccaattaccaatgacactagctgatactagtagtattacgcatgcatgcagtagctatgtgtgtcgtcgtagtcgtagtatagctgccagtgtccggacgcggacggatcaatggcagattagcagctagccagctgggattgagatggatggatggatggatggaggtcgaggcacgccacgcgcagggcctagttcctgttgaccatggcgaggatggtgcagatgctctcggagctcaacaccgacatcgacgcctacgtcttcatcgactccaactacaacctaatcagctt

SEQ ID NO: 42911 - DNA, 434 bp, Zea mays
  Clone ID: LIB3062-010-Q1-K1-B3
ggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctaccgcggtggtcgtggaggctacggcggcggtggg

SEQ ID NO: 42912 - DNA, 430 bp, Zea mays
  Clone ID: LIB3062-010-Q1-K1-B4
ctgaaaacagaaacaagaactatagccagggccgatgttgcagaagtttgcatacaggcattgctattcgaagagtcaaagtttaaggcatttgatctggcatcaaaaccagaaggtgaagggacgccaactacagactttgactcttcgaatatcaatcacccgctaaacaagttaggaaatgcaaatatactggtgtggaagcgcaaggcagaacagtacctagcagactccggtcttccatatacaattataagagctggcggtttacaagataaagatggtggcttgcgagagttgattgttgggaaggatgatgagatcctgaaaacagaaacaagaactatagccagggccgatgttgcagaagtttgcatacaggcattgctattcgaagagtcaaagtttaaggcatttgatctggcatcaa

SEQ ID NO: 42913 - DNA, 443 bp, Zea mays
  Clone ID: LIB3062-010-Q1-K1-B5
aacacctcacactccattcacgccagggatcgatcgcgccgctatagctgctgggccggcacgctttgcctcttcttcgttctctgccgctgcgctagctagctgcggctccgagcctccgacgcaggaagtctaatgtggaagtctctcagaactgagtacttttgttagaacaaagattcgttcaatcaagctttgcaaattatcatcatagtttggatgatatccatgggtactttaatgagtttatggagccctggttgccgagcttatctgggatctctgacactggaactgtaatatttgcaaaagaacctttcttgtattggaagaaagtttcaagagcggttgacaactcataagtgtaagcttgatgacgtgttcatgagggcaaagcgggagagcaaaatttcttcgcatgcagatgtcaacaggctctaacc

SEQ ID NO: 42914 - DNA, 443 bp, Zea mays
  Clone ID: LIB3062-010-Q1-K1-A11
cggaattcccggaccaccggtccacacacaagaagagagccgagagctagctacctatcgcgcgatggcgatgtccgcttccaagaggatggcggtcgccgccgctgcgctgctagccctggtcctggccgcgtcgaccgcggaggcgaggaacatcaagacgacgacgactacgacggagaagaatgacgatgcggtggtgcagccgcagaccttcccgcccttcgaccgcctcggcggcggcgcgtccccggcgtccggtggcctccccggcacctcgtcgggcggcagcagcattccagcgttcagcatgccgggcagcggcagcagcctccccggcgggtcgttcttgcccggcagcagcggcagcatcggcagcatgcccctcttcagcggcggctccccggccttcagcggcttcggcggcatgcccggatcccccg

SEQ ID NO: 42915 - DNA, 423 bp, Zea mays
  Clone ID: LIB3062-009-Q1-K1-G6
ctagaagaacgcgcccgcgcctagccagatctggtcgagccgcccagggcgagcagggcccacgtgggggccgggcgacggcgcctttgcgcgcgggcagtggccgaagcttacgccggacgcgcccgctgccggtccgtcaccgtttgcagcccgaaccgagaagccggagagcccagcccttgcgccggagcgccagcagcgctcgcactcgatccaggtggccgagcaacgctcgcagtcgcgccatggggggagcgatccaaccgtggtcgactagccgtgccgtcgcgcacacgtctgtgctagccgagccaccgaaccgcgaacgaggctgaggcctgccgtgcaccacggccgaccgagccgaggctgatgacggacgagcacgggccggtaggcggacgtagagcccgcttgccc

SEQ ID NO: 42916 - DNA, 429 bp, Zea mays
  Clone ID: LIB3062-009-Q1-K1-G7
gtcgtggccccggggttcgggcggctgccaaagaatcagtggccatgggatctggtaggctcaacagcattgcccccgaggagcctaaagtggtcgtgccagagtacggtgagacggctgatatccaggacaaggaagttagtatggaacagctctgctccataagcacctatgatcagtggacgccactctctgtttctggccagcttcccaaaccacgctataagcatggagctgtggtgattcagcagaagatgtatgtctttggtggaaaccacaatggccgttaccttggcgacattcaggttttggacttcaaaactttgtcatggtcaaagctggaagctaaatcacaagcagaaccatcagaatcagctggagcagttccgttttctgcatgtgctggccattcagtgattcaatggggaa

SEQ ID NO: 42917 - DNA, 416 bp, Zea mays
  Clone ID: LIB3062-009-Q1-K1-G8
gctcgcactcactccaccgctgcccacttcttgtttgtattgtatccagactccagaggaagccgagagggccaatgaggcaaggcatgagctccccttccgccgccgcggcgctcgtgctcctcctggccctgctcgccggaggccagtgccgagaggcccagctcgacgccgcggacgccggcaccggcacggagaactacaccgccagcgacgccgccgtgtactggggcccctggcagagggcccgggccacctggtacggccagcccaacggcgccggccccgacgacaacggtggcgcgtgcggattcaagcacaccaaccagtaccccttcatgtccatgggctcctgcggcaaccagccattgttcaaggacggcaagggctgcggctcctgctacaagattcggtgc

SEQ ID NO: 42918 - DNA, 426 bp, Zea mays
  unsure at all n locations
  Clone ID: LIB3062-009-Q1-K1-G9
tcggagggcagctcttgggttggataccaattacttcaacgagggccaacttgatgacctaaggatcattaaggagaccctacgagtgaaagattaaggattgcaacatttggcttaaggtattcggtcccgaaattcttccattaaaggaattaccggccaacctaccaaaacctgttaaggttgaaaaacttgttgcttttgcacttaatccaatggatgaacagaggcagcttttgtgtttggagaatgagcgactaaaacaagccttgggaagacaaatagaacaatcaatggttaaagcttaaacatcccaaaaggagggtatcagcctgagcaaagagaaggagccattgatgaaggaaagagatgcttgatttcaggaggctcatatgntgcgcattgaactagtaaaagccagggagc

SEQ ID NO: 42919 - DNA, 429 bp, Zea mays
  Clone ID: LIB3062-009-Q1-K1-H1
cggacgcgtgggcgcaggcgcacgccgttgccaccaaccacgccaacttcgtcgagtggaccgatgccgacctcaacttggtctgctccgactgcggcaagccatgccgctcccagaccgaggtggacctgcacaccaagcgcacgggccatacggagttcgcggacaagaccgcggaggcagccaaacccatcgatctcgaggcgccgcttaagccggcctccgaggatgtcatggacgtagacacgtcggcttcggcgagtggggagccacaagagatggttgtcccggaggtgaacaaggagatgctcacggaccttgagggcatgggtttctcgacagcgcgcgccaccagggcgcttcacttctccggtaatagcaccattgaaggtgctattaactggctttctgagcaccaagaggacatag

SEQ ID NO: 42920 - DNA, 365 bp, Zea mays
  Clone ID: LIB3062-009-Q1-K1-H10
gaaactcagagagtacaaacccattacttgcacgtacatgatgtaccaagctggggcaattctagactactcggacaattcagactatactacgacgacacatagctcaccctctctctcccggtctcctccggctcccagcccgtcgccgaccgcaagcgcgcccactctgaccacaacaagccgtcatgcccaaatgcgcgctccgtacactgtccgactgtacaaacgtaccggcgcaacgcgctacacgaccaaggcaccaatctcgtaaaagtaaccaatgaccaatcaccgtaccttcctaaagatgacctcataacacacgacgggtactcacaccttcttctctcgctccacagcat

SEQ ID NO: 42921 - DNA, 444 bp, Zea mays
  unsure at all n locations
  Clone ID: LIB3062-009-Q1-K1-H11
cggctagggcggggaaggaaattgcgggaggatgcgaagccattggtgtattgcatatggtggcaccaagcatgaggcangaactgcattacttgcaagaaagtcacaaaatccattgcaagatcatacttgtggctttcttgcaagttgtgcagttgttgcctcaagcttgctgcctccctttgccagagctatcggtaaaacaggaagtactgtcagtttccgagctacaaacaagctataagtttagaaaaataatttagaaatgtacaacaaagtctagtaatacattgctaaagataaatcaatactcaataagttcctcatgctttggatttggggataacatacctggtttatttacatgctaatatttggaccaacaaaaaataccttaggaacagccatttgagaaaaaaacaaagccttttagtcctaagcaag

SEQ ID NO: 42922 - DNA, 349 bp, Zea mays
  Clone ID: LIB3062-009-Q1-K1-H4
acgcataacgcgttgcacgaaccactggcaagcaagcccgtccgtccaagtcctaggttgggcaaccaccattggcaacgggcctttctttaaccgccttgcaatgggccggcctcttgtccgtgtggtccgtcgtaacctaccgggctcgcgcccagcagcagcccagccacaacgcctccgagtcgtcgcaggacaggtccttgttgtcctacagcagtggctggctgcccgccaaggccacctggtacggcgcgcccaccggcgccggccccgacgacaacggtggtgcgtgcgggttcaagggcaccaaccagtacccgttctcgtccatgacgtcctgtggcaa

SEQ ID NO: 42923 - DNA, 419 bp, Zea mays
  Clone ID: LIB3062-009-Q1-K1-H5
gagaactcatttatgcatatgctaagattgacaggctcagtgatattgacgaatgtgaggcttatgccaaacgttgctaaccttcaaaatgttggtgaccgtctgtctgacgaagaactatatgaagctgcaaaaatcttctatgcttacatctcacactgggctaagctagctgttaccataggtaagctgtatcaagttcacggtgctgcgaatactgtctacatggctatacagtgccaaaacatgtaacgtggtctgctgtgcttgtgttgacgccgaggagttccatcttgcacagatttgctacctcaatgttattattcatgttgattacttgaaagaagtcagttagtactaccataatagaggacgcttcaattaactcattgctctcatggatagtggtcttgcacttg

SEQ ID NO: 42924 - DNA, 432 bp, Zea mays
  Clone ID: LIB3062-009-Q1-K1-H6
caaccccgtccgcacccaggcctccggccgcgacgggccctacacgctcaacatcacggccaccgccaacaaccaggtcaacgtctcctcgggcgtcgccgaggtcaccatcaacagcgcgctcagcgccgtcaagcccctcgccgtctactccgtcgacaaggtgctcctgccgctggagctgttcggggccaaggcgcccgccgccgcgcccgccgcgtcccaggggaagcccaagaagggcgggtcctcggacgctccctccgggtcggccggctccgacgacgccgcgcccacgggcgccgccggcgccagggccgtcggctggagcttcgctggcctcgccgccgtccttggctgcctgttgtgagagtgagaccgtgcgtcatttctagggacggaggacggacggacgacaagctagttgaagat

SEQ ID NO: 42925 - DNA, 213 bp, Zea mays
  unsure at all n locations
  Clone ID: LIB3062-009-Q1-K1-H7
nctcgcgatggcgcgcatgcggtgccgtcaccggagcgcggcgagatggacgaggtggtatacgcggacccggatacggaagcggaagatcaggatgagaggtgggcgaggctgctgccggagctgctctgcgacgtggtgcggcgcgtctaggcgtccggcggcgagcggtggccggcgcggaaagacgtagactcctgcgcctgcctgtgc

SEQ ID NO: 42926 - DNA, 432 bp, Zea mays
  Clone ID: LIB3062-009-Q1-K1-H8
attaaagcgtaatgcacggaggagctctgcagtgccatttgaaccttctcaaacaaacgactgccattgaaattgagaagacaagacggaatccaaggaaattaagtagcactcctgctgagtcagttcctgatggccagttaacagaacttgagaaggttaaacgtagccttaggaaggttactaattctgtggctgaaacctcgaaggcacctagtccaaaaactgagattcctaaccatcaagaggtccaatgtgagagaccactaagaagagcaaaacaggttccaattcatcttgagaatcaagagcctgataatgttaatctgttggacaatgcaaagatggatattctggtacctgatatccagcctgatgtggaagttgcttcagatccagtcaccatcactaatgaagaaaatgttgatgaac

SEQ ID NO: 42927 - DNA, 420 bp, Zea mays
  unsure at all n locations
  Clone ID: LIB3062-009-Q1-K1-H9
tcgcagaaactcagagaggagaaacccggaacaagcgccttcagtgatgtccgccaacttggggcacttcgcgggtttcccgggcgtgttccggcttgacttccaccaccccgggcttaaccttgggcttcccggcttcttccgccgccaagcccgccgccgacggaaggcgcgcccacgccgaccacgacaagccgncatccccaaaggcgcgggccgtgggctggccgccggtccgcgcgtaccggcgcaacgcgctgcgcgacgagggcgccaggctcgtgaaggtggccgtggacggcgcgccgtacctgcggaaggtggacctcgcggcgcacgacgggtacgccgncctgctccgcgcgcttcacggcatgttcgccttctgcctcggagccgacggnngcgggcggatcggca

SEQ ID NO: 42928 - DNA, 409 bp, Zea mays
  Clone ID: LIB3062-010-Q1-K1-A1
ccgcaaactcaggggaggcgcgcgcaagcaagaacacgagggagcagcgggcaggcagccagccatggggaggtggccgtgctgcgagaaggcgcacacgaacaagggcgcctggaccaaggaggaggaccagcgcctgatcgcctacatcagggcgcacggagaggggagctggcgctcgctgcccaaggccgcgggactcctccgctgcggcaagagctgcaggctccgctggatgaactacctccgcccggacctcaagcgcggcaacttcaccggctacgacgacgagctcatcatcaagctccacgccctgctcggaaacaagtggtcgctcatcgcgtgacagctgcccggccggacagacaacgagatcaagaactactggaacacgcacattaagcgcaag

SEQ ID NO: 42929 - DNA, 376 bp, Zea mays
  Clone ID: LIB3062-010-Q1-K1-A10
aaaaagaatggagcgagctcttcaccaaagcagggttcagcgaatacaagatcctgaaggaatttggagctcgtgttgccttcgaagtctatccgtgagatatatatatatatttacatacatatatgtatgtgtgtgggtgccttgcgtggcttggcgtgatgatgtcataaataaagagggtgggtgtgcttgcggtattcatggatggccatggatctgagcacatgacgttggatgctttcttaaggctctcgtggatcttctatatttggaagaagctgtaaaataatatatcgccatctagtgttggcgttggcttgtatgtactttgtacctgctttattattttgtgcaatatcgagtaacctaatgt

SEQ ID NO: 42930 - DNA, 344 bp, Zea mays
  Clone ID: LIB3062-009-Q1-K1-G5
cacggaccagctgagcaagcccgtctcgcccgagaacattctctactaccacaggatcggcgagtaccagaccgaggagtgcatgtacaacgccgtgcgccgcttccgcaaggtgcgctacgacacgctgcgcctgccgaacaaggtcgtggcgcggtaggccgactgctccgtcaagttcggccagagctagggctcctcctacctcttatacccggacatctacacatacaggaggatctccgtgcaaggcatcatacaaccgtgctcggctgcgcccgacgacactatggccacgcatacagtctgaccttaacaggaagcttgccgccatggtaaatgac

SEQ ID NO: 42931 - DNA, 432 bp, Zea mays
  Clone ID: LIB3062-009-Q1-K1-F10
acgcgtccgatcgttgagcttatctacaagcatgctgttcctgttccgaagtctgaatgcagcaaggggtcccatttgaatattagcggtgctggtagttacattgccggtgtcttctgcgctattgtttctcacccggctgacaaccttgtgtctttcctgaacaatgccaagggagctacaatgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctgaattgaaagccagtgcttgattttttcttctgtgttccctgagatcatatttggtggagtggaattgtatc

SEQ ID NO: 42932 - DNA, 421 bp, Zea mays
  unsure at all n locations
  Clone ID: LIB3062-009-Q1-K1-F11
gcgggttcctatgacatattggggataaattactatacctcaaggttctctaagcacggggacttctcaaaagactactcacctaagctcaacgccgacgacgcctatgccactgcagaaatctttggacctgacgggaattctattggtcctcctatgggaaatccatggatctacatgtaccctaaaggcctaaaggatctccttatgatcatgaagaacaaatacggaaacccgcctatctatatcaccgagaacggaatcggggacgttgacacaaaggataatcctctatccatgcaagatgcgttggaccaactacaagaggctagattacctncagcgccacatctcagttatcaaagaatcaatagacttgggggcggacgtgcgcggncacttcacatggtctctgttggac

SEQ ID NO: 42933 - DNA, 188 bp, Zea mays
  unsure at all n locations
  Clone ID: LIB3062-009-Q1-K1-F12
ccgacgcgtccgtctagcttgtgtgccttacttgctagagctnnncaccattanccttatgctttctaaaactagagcggctcaccaatacgccgtcgtatgcttagtaccgctgcttcgtcggcggcctcgcctgggactcctgtggacctcttcactgaaaatcccttgatcaactttctccttaa

SEQ ID NO: 42934 - DNA, 430 bp, Zea mays
  unsure at all n locations
  Clone ID: LIB3062-009-Q1-K1-F2
gaaatttctaagtcgtcgtcgtcgtcgtcgttcgggtcggaccggatctgangcgacgatggctggaggcggcgggatctcttggtctgcagtcctgcttcacctcgatggatgatgtctctgcgctgataattattggatcaatttcgataattattagtagatctatgagatatgccgcctggaagaggcgaggtaagctgcagcatgtaaaagtctgcgtgcgtcgacagcaaaaaagagaaaaaaagatgtgacatcctagaggaggcctttgccatgatgggtgcgctcgcatggcaggccaggtattaataaaaagatgattattgtgtgccgggggaggagatcgcacggnggttgatgtttttggccccggggtcttctccctcatcttgttccgtgttcctgtatccgttgtttccgcgcc

SEQ ID NO: 42935 - DNA, 327 bp, Zea mays
  Clone ID: LIB3062-009-Q1-K1-F3
cggaattccaggcctacgacccacgcgtacgtctagaacgcatgcatctgcctatcttaagattatttcatttgttatacatggcttcggaacaattatctcatagggacaaatttcaacattacaatggacatattcctgagcatgaccagagccaaatttggcttactgattcatgccactcttactgcaaaggcggtttaaacatacagccatttcaaatactactctggcattacctattgctactgctcttcagatttaggcttcttacctccagatttaagcaaatctggtctgctcgatccttcaacatattgtgactat

SEQ ID NO: 42936 - DNA, 431 bp, Zea mays
  Clone ID: LIB3062-009-Q1-K1-F4
gaggtgggctggcttctccttccccctcttaccaagtcctcttcgggttagggttactgagggtgttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtgg

SEQ ID NO: 42937 - DNA, 329 bp, Zea mays
  Clone ID: LIB3062-009-Q1-K1-F5
aaagtactggctgctcatggagctgcaaaggtcagtgcatatgtgacacatggcattggccccaatagctcatgggagaaatttcagcatgacaatggacagggtccggagcatggcctgagccacttttggcttactgattcatgcccccttactgtcaaggcggtgaagggcagacggccatttgaaattctaagtctggccggacctattgcttctgctctccagatttaggcttcttacctccagatttaggcaaatctggtctgctcgatccttcgggatatctgtgactattcagatagttcttgtctcctgagctgctgttg

SEQ ID NO: 42938 - DNA, 448 bp, Zea mays
  Clone ID: LIB3062-009-Q1-K1-F7
tcgacccacgcgtacgcctagctctagaaatcatgcatctgccgatctgaagattgtgttccttcccctgttggcctttgaagcaataatccttattgacaattttagaatgtgtagagctttaatgcctggggatgaagaaagcatgagtgatgaagctatttgggagacacttcctcatttttgggtttcaatttcaatggtgtttcttatagctgctacaacattcacccttctcaagctgtctggtgatgttggtgctttgggatggtgggatttgtttataaattatgggattgcagaatgctttgcatttcttgactgtacaagatggtttaatcccatgattcacaagtctgccactcatggggaggctagctcatcatcagcgattagataccgcgattgggaaagtggtcttgtactcccatcactacgacgatcatga

SEQ ID NO: 42939 - DNA, 424 bp, Zea mays
  Clone ID: LIB3062-009-Q1-K1-F8
aatttgtgcaggactgtatccaggtgtttcctctgttttgaacaaggagaaatccatggccctcaagacaatggaagatggacaggttatgctttattcgagttcagttaatggtaaagaaaccaagattccattcccctggctagttttcaatgagaaggtgaaagtgaattctgttttcctccgggattcaactgctatatctgattctatactgttgttattcggaggctgcataaaacaagggggcttggatggacacttaaaaatgcttggaggttatcttgagttcttcatgaatcgcgatcttgcttcaacttatgtgagtttgaagagagaacttgagaatttaatccattgcaagctccaaaacccaaggatggatatccaaacgagtgaagagctgctatcagccatccgtttg

SEQ ID NO: 42940 - DNA, 384 bp, Zea mays
  Clone ID: LIB3062-009-Q1-K1-F9
tcgatcggtgagcttatctaccagcatgctgtgcctggtccgaagtctgagtgcagcaagagtgcccagttgggtattagctttgctggtgggtacattgcccgtgtcttctgggctattggttcttaaccggctgacaaccttgggtctttccttgacaatggccaaggaacctccatgggaaaatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctgaattgaaagccagtgctggatttttttt

SEQ ID NO: 42941 - DNA, 415 bp, Zea mays
  unsure at all n locations
  Clone ID: LIB3062-009-Q1-K1-G1
cggacgcgtgggcgcaggcgcacgccgaggccaccaaccacgccaacttcgtcgagtcgaccgaggccgtcctcaacttcgtctgctccgactgcggcaagccatgccgctcccagaccgaggtggacctgcacaccaagcgcacgggccatacggagttcgcggacaagaccgcggaggcagccaaacccatcgatctcgaggcgccgcttaagccggcctccgaggatgtcatggacgtagacacgtcggcttcggcgagtggggagccacaagagatggttgtcccggaggtgaacaaggagatgctcacggaccttgagggcatgggtttctcgacagcgcgcgccaccagggcgcttcacttctccggtaatagcaccattgaaggtgctattaactggctntctgagca

SEQ ID NO: 42942 - DNA, 428 bp, Zea mays
  Clone ID: LIB3062-009-Q1-K1-G10
gagagaccaagaggacacgggagagaggacgttcatttccgcgtcgtctgcgcccgcaggcggcagccccaccacccaccacatggccgacatgccgggtggagcccacggcgccggcgccgcggacccgatgcatgtggaccagccgctcccccctgccgtcgcaggcacagcacacgctcccgccgacgccaagcatgctggttctatgattgaagggagtgatccggtcacaggccatataatctcgacaaccattggagggaagaatggagagcctaaaaggactatcagctacatggcagagagagttgtgggaactggatcatttggaatcgtcttccaggcaaaatgtctggagactggtgagactgttgcgattaagaaggttttgcaggacaagcgctacaagaacagggagctacaaa

SEQ ID NO: 42943 - DNA, 165 bp, Zea mays
  Clone ID: LIB3062-009-Q1-K1-G11
cttccactagttctaaatccccaaccgcttcccttttttttttttttttttttttctttcttatgcgttatttttaatacccatcagattttctatattccatttcaacaccactctaccgatatctttgacccaaatcccacaaaccagccaatcccccaaaaa

SEQ ID NO: 42944 - DNA, 420 bp, Zea mays
  Clone ID: LIB3062-009-Q1-K1-G12
cttccgatgatgattgaagcctttggcaatggtctacctaatggcttactggcattccttaatgggaggtatcctggctagccctggcttaattaactgaatggggtacctttgaaaggttggagggttaaaaggaaggaagagaggaattatatggagtgattagatatgaaggctattaatatctaacctagtaacctgtatgaggattagacacaaacggggattagaaggaaaactcttctttcttgttcggttgcgggcaaggcccccagtcggcctcctctctccttctaaaccctagctactgccataacatctggtataggagattgccaggttccaatgagggcggcaaacagtcgaaggtgcccacccctgccgccgtggcatgtatctatgcgtgcttggaatcctggc

SEQ ID NO: 42945 - DNA, 455 bp, Zea mays
  Clone ID: LIB3062-009-Q1-K1-G2
aattcccgggcaagaagagagccgatcgaccgagagctagcacgcgatggccaaggctttcaaaatgaagggggccggaactttggttggccctggccctggcgtgtcgaccgccgaggcgaggaacatcaagacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagccttcccgggttcagcttgcccggcagcggcagcatgcccctcttcggcggcggctccccgggcttcagcggcttcggcggcatgcccgggtcccccaccgccggctccgtccccgagcacgccaacaagccctgaactccgtctgtccgtccgatccgtc

SEQ ID NO: 42946 - DNA, 431 bp, Zea mays
  Clone ID: LIB3062-009-Q1-K1-G3
cccacgcgtccggcggtgacttctgtggcgtgagcatcaattggcatgtctcaacggagtacaacaagggctggagtgctcgggtgacattgttcaactgggaggatgtcgacatggccaattggtttgctgccatcgtcatggacaaggcgtatgacggctttgagaaggcgtactcgttcaacggcactgcagtgggcaagaacacgatctttatgcagggtctggaggggcttaattacctggtgaagcagaccaacatgagcgggtccgactaccttgttcctggcaagcaacagtcagtcctctcattcaccaagaagctgaccccggggttaaatgtcgttgctggagatggcttcccaacaaaggtcttcttcaatggcgacgaatgcgctatgccacagagaattccgatcagcactggattt

SEQ ID NO: 42947 - DNA, 416 bp, Zea mays
  unsure at all n locations
  Clone ID: LIB3062-009-Q1-K1-G4
ngggcttataattagcatttttaatgaccggtctttcattactattttttattattgaggttagccaatttcaatggcccatctgtggaaatctcaacgaggatctttgatcaggcatggcgcttgcaagctaccttgctctgatgactgccattttcttatgggctatgcacaatactcgatttcttatcggacaaattcgatgatgacgtcgatcatgtacagctatcatgaaatgatctccggcctatacctctaactgagtatcatgagccaggctgtgatcttagtcacctgataccgtaactagaccttcgtggaacgccctggtctggttcttgtcaccgagttcctgcttgataaacttgccgtcagcttgctctatgtctacgccaactggggctatgacaggatca

SEQ ID NO: 42948 - DNA, 209 bp, Zea mays
  Clone ID: LIB3062-001-Q1-K2-B3
aaaggctttagagctaatgatcaacatcacgtaggaaacgacttcaacttcgcatcggaagatggagagattgcatagtcttgaggaggaacacatgaatgctcttcagagagcacagaccctggatgaaactcatgctgctgacctgtctgaagaggagattcatgaggatagcactgaaacatcctctgatactcatatctaaacaa

SEQ ID NO: 42949 - DNA, 427 bp, Zea mays
  Clone ID: LIB3062-001-Q1-K2-D11
tggattaagatcccctacccactgcaatggggtgcgccgaccttcaacgccggccagtcatttgggattgtgtctgctgttttggtctcgctggtagagtccacagcctgctacaaagccgctgctcggcttgcgagtgcgactccacctccggctcacatcctcagcagaggcattgggtggcagggaatcggcatcctccttgacgggctctttggaacggggactggctccactgtctcagtggagaacgtcgggttgcttgggtcgacaaggatcgggagccgacgggtcatacagatctcagctggcttcatgatctttttctccatgctggggaaatttggagccttgttcgcttccatcccgttcaccatctttgcggccgtgtactgcgtcctgttcgggctagttgctgcggtggggc

SEQ ID NO: 42950 - DNA, 388 bp, Zea mays
  Clone ID: LIB3062-001-Q1-K2-H1
aacctaaatctggaaagagtaaaatggaaagcaccactgttctgttcatattgtgacgaactggcagcctggcatgcttgacatcaaacaccactgcgactggcaccaaagaccttaaaccaagcacaacgccgttgaactttaacagcctatcaaagcaagctccaacatcagggagatgtttaggtatcctacccctgtccgttccttcttttatcaagcaatcgttccttcttttatcaagcaaagtttacttcgagtaatacttgaattaaaggtgtcggtttacaacaagtgcagctggtacccacagaagaaaaggcaccagtgctgctatgtctccccaatccaaaactgtcaaatatgccctcggcgtcgttgattccat

SEQ ID NO: 42951 - DNA, 346 bp, Zea mays
  Clone ID: LIB3062-002-Q1-K2-A1
aagcaacaccgcacaaggcgcctcgagccacttaaacagagcaagccgccgcggcggcgaccggccgaccgacgccgaggctgcgcgccctgcgccgggatcgagaggggaaagggaaggggaccagccggctcgcttggaggctggagctcgccccggcgggcccatggggggacgcctggtgtccatgctccggtggccgccggacctgggcctgcccagcctggccgcgctgctccccgcgccgcccgcgcacctccgggtccaggtccaggagtggtggcagtggcagcggtcgcggcccgagcagctgggcgcggcggcgcggcggtggcccgagctcgtg

SEQ ID NO: 42952 - DNA, 389 bp, Zea mays
  Clone ID: LIB3062-002-Q1-K2-A5
tgaaaagtagcacgtctcagaaagatctccaaaagcctaatgcttcagagcttccttcacaaggaaaagctgcatcagaattgacacttgatgggtgggatagtattgctctggaatattctattgactggcctctgcagctcttcttcactcctgatgttctgtccaagtatcgcaaggtttttcagtatctcatccgattgaagaggacacaaatggaacttgagaaatcctgggcagctgtaatgcataaagaccatgctgatttttctgattattgcaaggatcggaaaaataactctgcaacacaactgcgtcgacaacggtctaagcctttgtggcgagtaagggagcatatggcattcttgatcagaaacctacaattttac

SEQ ID NO: 42953 - DNA, 376 bp, Zea mays
  Clone ID: LIB3062-002-Q1-K2-C11
gtccgaaacatattactcaacaaactctgctaaaagctaagccacagttgaaacacaacgttcttcaacatgtacagctctacagctgattctattctcaactgttgcaaggtttccagatagcagggcacacaccattctgacacacgcaaattttgcttgttaagtgttacatgatccaggggcctaacaattgtcaagatccaaggagtttctagttcatctaccaaggttctatatatcctgattgaatgaagtccgatatgacatatggtgaaggagatatcaccctgatgggatggctgcccgtctatgcccaggctgccgccgtcctggtcagccagatccgataattttaaacacgataattttaaac

SEQ ID NO: 42954 - DNA, 413 bp, Zea mays
  unsure at all n locations
  Clone ID: LIB3062-002-Q1-K2-C12
tagcaatcgtcggcgggggaggaggggagagattgctgctcaagtttcaggctctgttgtttgaaacgtcaagatggttaatttcggaaagaaattgatggctgatcaagtggaagaatggaaaggatactacatcaattacaagctgatgaagaaaatgttaaagcgatatgtccaacagactcaacatgatgggaaagaccgcgaacaagttcttaaagacttttcaaggattcttgatgaccagattgaaaggattgtgctttttctgctacaacaacaaggccatcttgctagtaggattgaggaattgngagaaaaacgcactgttcttctggaagagtatgacatatcacaagtttatcagctacatgatgcatacagaaaagtcgggcttgatctcataaagcttc

SEQ ID NO: 42955 - DNA, 421 bp, Zea mays
  Clone ID: LIB3062-002-Q1-K2-E10
tgaaaagtgtgtcacttattgtgaaagtcatgatcaagctcttgttggtgacaagacaattgcattctggttgatggataaggatatgtatgatttcatggctctggacaggccttcaacgcctcgcatcgatcgtgggatagcattacataaaatgattaggcttgtcacaatgggtttaggaggtgaaggctatctaaatttcatgggaaatgagtttgggcatcctgaatggatagattttccaagaggtcctcaaagtcttccaaatggctccgtcattcctgggaataacaatagctttgataaatgccgccgtagatttgaccttggagatgcagattatcttagatatcgtggtatgcaagagtttgaccaggcaatgcagcaccttgagggaaaatatgaattcatgacatct

SEQ ID NO: 42956 - DNA, 404 bp, Zea mays
  Clone ID: LIB3062-002-Q1-K2-E12
tgccctcttctgttattaaatacaatataataggctgttgggtaccagtttgattacgatgactaccacagctttgttcatgggaggttgtcttatgacaaaatcaagcctgatcctgtgcttaggaacatcctcctcagcttacccattcgcaaacttgtgttcacaaacggtgacagaacacatgcttcaagggccctcaagaggcttggcattgaggattgtttcgaaggagtcgtgtgctttgagacactgaacccgacatctcctgctactcctgtcccagctcatgaacttgaaatctttgatctaatgaagcatctggctcatccacagcccgcggtgcagctaccataatcacctatcctatgcaaaccgtcaagggaggccatgctgcaggctct

SEQ ID NO: 42957 - DNA, 373 bp, Zea mays
  Clone ID: LIB3062-002-Q1-K2-F6
aatagaatgatgttgagtaggtcagtagaaaaacaataattatcctctagggatgagcaaacacataacagaaaccattactaaccaagtaaaattacatgagagtacacatcaaacctgttaacattcaaggcattagaacctccatctggaatccagattctggatggtcatgtacatcaatggtcagcattccatcaaatttactagagatgtcatttgtttgtttaacatcattactgtcctttgcacgtccagaaaccttcacagttgtcgtatatccacaatgcttgacaatcaccaccccgagtgttgaagaatcctggatgcatataaagagaggcatgcaatatccatagcacccgtttgacag

SEQ ID NO: 42958 - DNA, 408 bp, Zea mays
  Clone ID: LIB3062-002-Q1-K2-G6
tggtcatggtggagctaaggtagcagagtatgttaaagaaaacctgttcaacaagctggttagtcatccaaagttcatcagtgatactaaagtcgctatagatgatgcttataaaagcaccgacagtgaattcttagaatctgacagtagtcaaaatcaatgcgggtcaactgcatcaactgctgtacttgttggtgatcgtctcttcgtcgcaaatgttggtgactctagggctatcatatgcagggaaggaaatgctattgctgtttcaaaggatcacatgcctgatcaaactgatgagcggcagcgtattgaagatgctggacgttttgtgatgtcggcaggaacatggcgcgttggtggtgtacttgctcgttcgcgtgcttttggtgacaaactcttaaagca

SEQ ID NO: 42959 - DNA, 443 bp, Zea mays
  unsure at all n locations
  Clone ID: LIB3062-003-Q1-K1-C4
tttcctcctccctccacggctccaccgagctccccgatccctccgccccaaatcccacacacccggttggccaccgcctcgctatggatttggatctgtggatctccaaggtcaaggagggtcagcacctcgcggagcacgagcttcagtccctctgcgaatatgtgaaggagatcctcatcgaagagtcgaacgtgcaaccagtgaacagccccgtgacggtttgcggtgatatccatgggcagttccatgacctaatgaagctcttcgcgacggggggccacgtcccagagacgaactatattttcatgggtgattntgtggaccgtggcttcaatagtctagaggttttcaccatcctattgctactaanagcgaggtatcctgcacacattacccttctgcgtggaaatcatgaaagtaggcagttgacacaggtgtat

SEQ ID NO: 42960 - DNA, 272 bp, Zea mays
  Clone ID: LIB3062-003-Q1-K1-D11
aagcaacatagaaagtggaatccagtagcaacaatagagcaacaatggcgaccaagatatgtggggtccttatgctccttgctctttctacatgtgttgctaacgcgacaattttccctcaatgctcacaagcttctatagcttcccttctttccccatacctttcatcaattatagcttcaataatggaaaaccccacttttcaaacacttagggcttaaccaggcatttgaacaaggcacataaccttaacggccttggtggtttaacca

SEQ ID NO: 42961 - DNA, 83 bp, Zea mays
  Clone ID: LIB3062-003-Q1-K1-F8
aaaaaaaaaaaaaaaaaaagaaaaaaaaaaaaaaaaaaaaaaaattaaaaaaaaaaaaaaaaaaaaaaaaaaaaaggggagga

SEQ ID NO: 42962 - DNA, 411 bp, Zea mays
  unsure at all n locations
  Clone ID: LIB3062-004-Q1-K1-A11
tgaatatgtttttagtggccatcggttcaaactaacaattcctaaggagacttgcagtgttggcttctcattatctggtgttcggtgtcctggtaaaggcgagccatactcagatgaagctattgctttgatgaggagaaggatactacagcgtgatgtggagatagaggttgaagcagttgaccaaaccaggaacattcataggttcgttgtgggagtccaagaccaacatgggctctgtacttctggaagctgggctggcgaagctgagttcttttggcttggataggatgtcagatgctcatgtcctaacaagagctgaacagtttgcgaagcaacaaaagattaagatatgggagaactatgtcgagggtgagaatgcttcanatggatccacacctgaatcgaaac

SEQ ID NO: 42963 - DNA, 171 bp, Zea mays
  Clone ID: LIB3062-004-Q1-K1-C5
acagtatatggtgaacaactcggggatacaggaaatatacatgaatatactacggaaaccgtatcaacacgcgatgacgaactcactaaagactagtgagcaaaatggccaaagtgggacgatgagcaccttgcgcatgtctaatctactaacctatgtcggacaacttca

SEQ ID NO: 42964 - DNA, 222 bp, Zea mays
  Clone ID: LIB3062-004-Q1-K1-D2
tgggcgcagagaatccccaagcaaacaaacagggtagagggagaggagaggagaggagaggagaggttgggtctgggacaccatggctccgatgaagctgtacggtgcggtgatgtcgtgtaacgtgacgaggtgcgcaacggctctggaggaggctggctccgactacgagatcgtgcccatcaactgagtcaccgacgagcacaagagccccgagcacct

SEQ ID NO: 42965 - DNA, 262 bp, Zea mays
  Clone ID: LIB3062-004-Q1-K1-G4
tcgaaaacggcctggttgcacacaaaaatggccaactaattggaacccaaagtttgaaatcatggatcggagaagacaagctgaaggaatttattaacttcactcttcattatattgctgacttggatatcccaattaaaaggggtacattcatagagttccgaagtggaatgattaatgtatctcctataggaagaaactgtatccaagaagaacgtgatgaatttgagaagtacgataaggtgcataacatccgacctta

SEQ ID NO: 42966 - DNA, 422 bp, Zea mays
  Clone ID: LIB3062-005-Q1-K1-A1
tgctggtcctgatcagagatctggaaaggttgagcttcagtatttgcatgattatgctggagtgaatgcaagcgttagtctgacagccaatcctgtagccaacctctctgctgcctttggcactaaggctctcgcagttggtgcagaaatctcatttgattctgccactgggaacttcaccaaatacaatgctggattgatgttcactcatgaagaccttatcgcatcccttaatatgaacaacaagggagacaaccttactggagcttactaccacaaggtgagcgaattgacaaacacagctgttggggcagagcttacccacagtttctcgaccaatgaaaacaccctcacctttggcgggcagcacactctggacccactaaccggcttgaaaggacgcattaacaacttgggcaaag

SEQ ID NO: 42967 - DNA, 343 bp, Zea mays
  Clone ID: LIB3062-005-Q1-K1-D7
tgctttggtacggttatgatcgcaagaatggtgtccattcactctgtccagctatgtggtcaagacataggagatggttgatgatgtcaatgatgtgtctcaatccaatagcttgttcgtttatggatttgcaattccctaatgggcaactaacatatgttgctggtgaggggatatcagccagtggttttcttccgttatttggtgggttgcttcaagctcaaggaaaatatcctggagaaacaagagtgagcttttcttgcaagaataagcgtggcacagggtttactcctatgtttcaatggcctgacaagtctgtttcgttaggagttcctcaagcctt

SEQ ID NO: 42968 - DNA, 155 bp, Zea mays
  Clone ID: LIB3062-006-Q1-K1-A1
cgtccgtatgggagtcacatccatggggtttatatttttatgcagatccaaaaattatggcagatttgtggtggtgtaggagttgtatggttaagacttataagacttaagacttatgtatcgtgtggttgagagttgaaacttatttgtggatt

SEQ ID NO: 42969 - DNA, 469 bp, Zea mays
  Clone ID: LIB3062-006-Q1-K1-B8
cacggcggcgagtcgcgggtggtggaggtggcggaggacgagacgatcctgtccggcgcgctggacgagggcctggacgtgccgcacgactgcaagctcggcgtgtgcatgacgtgcccggcgcggctggtctccgggacggtggaccagagcgacggcatgctcagcgacgacgtcgtcgcgcgggggtacgcgctgctctgcgccgcgtacccgcgctccgactgcaccatccgcgtcatccccgaggacgagctgctcaaggtccagctcgccaccgtcgacgactgactgacgctccgtcgatgaccagcggaccggccagcaggcatcaacctccggcggtgtaatgatgtccctgagacttgtacaccattgttgactagtagcactagtgacagagcttttctcgagaatagatgctgtgtgatatgcctctgccaaatttctggtatccaaatcgagcatt

SEQ ID NO: 42970 - DNA, 288 bp, Zea mays
  Clone ID: LIB3062-006-Q1-K1-D2
gcggtagtgtgtggtctaaatcttgcatgtgcatgtagagactgtttcttcggtctgtgcaggctgtgcagttttgagcttgtttcttgagtcgtttcagacagttttttcagttttctgtgcagacatgtgctcgtctctactttgtcaaaaaaaagatagaattattcagactgcagttttcagcttgtttgttgattgggtttattgagttttcagttttcaaaaaaaaaaaaggcaaaatgctgcaaaatataatgcttcatgaagtcaataaatacatattta

SEQ ID NO: 42971 - DNA, 226 bp, Zea mays
  Clone ID: LIB3062-006-Q1-K1-E3
gtagtcttgtagaagaagtatcatcaattagtaatcttgtagctgtgtgagtatgttcatatgcggatgccggagaggtggcgatggcttgtaatcaaggatctgccgccgtacgtcccttgacgactcctcttcccgtggtcggaggatgagggatcggccaagaggaaatgtttccattccgaaagcttacacgcctaatgctgcttcatccacaacaaagaat

SEQ ID NO: 42972 - DNA, 313 bp, Zea mays
  Clone ID: LIB3062-006-Q1-K1-E5
tttattttttttttgtggtttactcatatttactgtaacagtacaagtggttttcacatttggttgtgcataccaaaaaattgggaagatgtaatgaagccctgtaagcctgtactgtggctgtgttgtcacttaacaaacattcatgcttcagctaaccgtcagccgttcagaattggttactagtgtcgtgaaaactcttgctggatctgatggccgaatgagttggtttcagcaacttgcctgtgctcggacatccgctgctgacactcactacaaccataaggggtggatttgtacggcgacgatgtgc

SEQ ID NO: 42973 - DNA, 248 bp, Zea mays
  Clone ID: LIB3062-006-Q1-K1-H1
tatgattccaaacaacatatattctccttgccatttgttgtgattttcggtgccaaaaggttactgtttcctggaatcatatattctgcttgccatttgttgtgattttcggtgccaaaaggttactgtttcttgaacaagtactagcttcatattataattacaggaaacaataatgataatatgtatctagtactcgatcatgaaattgaacagctacaatgctacttgtctaatatagaaactcc

SEQ ID NO: 42974 - DNA, 98 bp, Zea mays
  Clone ID: LIB3062-006-Q1-K1-H6
ggtatggttaatttgaagaatccttatgtactgaatctctgcaaaaagctatgtggtggacagaagtgtaacgtgccggaaaaaaaaaaaaataaaaa

SEQ ID NO: 42975 - DNA, 249 bp, Zea mays
  Clone ID: LIB3062-007-Q1-K1-A1
tccatctgccctcaatggtgtaaagaactaggagaggcgtggaagctcctctccagcgtctttgagtgccctcaatggtgtcaaggtgtggactcaagtcaatagcttcgctgttctgatgatgctctgtggaaactcgaatcctttccacctgaaaaccaagtagtatgtcttctagtgctggaattaaccctagtgcatatatacatatgaaataaaaaaaaagccaaaaggaggagtaacttattt

SEQ ID NO: 42976 - DNA, 162 bp, Zea mays
  Clone ID: LIB3062-007-Q1-K1-B8
ataaaccttatttgggtacatggggattataaggattgaagaggataaaatctacttcaagtccatcaaaatatctgtgctccgctttatctccttggagaaaggactcccctagatattgaaccacagaataactatggaataactgagtacccaaacgca

SEQ ID NO: 42977 - DNA, 167 bp, Zea mays
  Clone ID: LIB3062-007-Q1-K1-B9
tacaactccccaaacgggatgcgcctgtccggaggcgcgcagaccgtgcgcatgaacgcgccgagcgtggggggcagcttcgccgtttggggcggcctcttctccaccttcgactgcgccatggtgtacgcgcgccagaaggaggacccttggaactccatcgttgc

SEQ ID NO: 42978 - DNA, 302 bp, Zea mays
  unsure at all n locations
  Clone ID: LIB3062-007-Q1-K1-F9
gagcagtcgcacgcaagtgtcaagagacgaaacggtcgacatggctcgcacgcaatctgccgtagcggtcggcgtggtggccgcggtgctgctgctggcagcggcggcgacgacctcggaggccgccatcacctgcgggcaggtgagctccgccatcgcgccctgcctctcctacgcccgcggcacggngtccggcccctccgcgtcctgctgtagcggcgtcaggaacctcaagagcgccgncagcaccgncgncgacaggcgcgccgnctgcaactgcctcaagaacgccgccaggggcg

SEQ ID NO: 42979 - DNA, 334 bp, Zea mays
  Clone ID: LIB3062-007-Q1-K1-G12
tttttgagatatttaatactatttatataaagtttgaaatagaggatgaaataagggatgtaagaggacatgtactcgagatggccttaatagctacccgcaaccaagaactcttccggcaccttcataaatcaagtccagctacaagctgcggcggcggcggcgcactgtggctgggtgcagtctcagcaacagcaaggtactgtggctcagcagccgccgccgccgttcaaccgcagccgtacgggccatacttgaagcaacagtaaatatgacattattacactagaatcacggaacgacaggagtaaaacggcaagagtaggcttatgca

SEQ ID NO: 42980 - DNA, 301 bp, Zea mays
  unsure at all n locations
  Clone ID: LIB3062-007-Q1-K1-G5
tggagactgccaagaccagctcttctgttgagaagagctacgagctgcctgacggacaggtcatcgccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagncaggaaatcaccgccctggctcctagcagcatgaagat

SEQ ID NO: 42981 - DNA, 431 bp, Zea mays
  Clone ID: LIB3062-008-Q1-K1-A2
atgcaggggcgctcgcgcgtcggtgtgggagaacttcaaggacaacccgctgttcgacatctcgacggagcacccggcgacgtactacgaggacatgcagcgcgccatcttctgcctgtgcccgctggggtgggcgccgtggagcccgcggctggtggaggcggtggtgttcgggtgcatccccgtgatcatcgcggacgacatcgtgctgccgttcgcggacgccatcccctgggaggacatgagcgtgttcgtggcggagcgggacgtgccgcgcctcgactccatcctcacctccatcccgctgcccgacatcctgcggaggcagcgcctgctggcgagggactccgtcaagcgggcgctgctgttccaccagcccgccaggcccggggacgccttccaccaggtgctcaacgggctggcgcgcaagc

SEQ ID NO: 42982 - DNA, 348 bp, Zea mays
  Clone ID: LIB3062-008-Q1-K1-E12
ttcaactgaacagcaagcgcacctaccctacccgccgccgccgaaggcgaaggcctagctcccggtccggcgcgatggctgccgcggcccgccgcggccccggggcgctcctcctcgtggcgctcctcctgctggcgctggtcgtctccgggcactgcctggacgcgcaccaccgcgggctgaagcgccgccggcggaagcacgagattcactctccgatcaagacggtggtggtcgtggtgatggagaaccgcagcttcgaccacatcctcggctggctccgccgcacccgccccgacatcgacggcctcacgggccgcgagtccaaccgcctcaacgcctccgacc

SEQ ID NO: 42983 - DNA, 437 bp, Zea mays
  Clone ID: LIB3062-008-Q1-K1-E3
tgcatcaacacctgccgactgctgcaggcaagtaaaggtactcctctcctcccctctgctgcagtccggtgcccgctgcagatcatggaggaagaagcatggcaagagtgtctgcatgggtcctgagagtcgcgtgagcagcgaagcagttcacggatggttggatggagggcaatgaccagctgctgagctgctgctgctcctcctggtcgaccatcagtttgtatttgtccatgcctcgtgtagccggccgtcttcttgccctggcttgtccagttccggaaggcgggcaagcccggtgaggcgtggacagagaccggcaagtcagaaatcggcaatagtgaactccagcaagagcctacttgtactccttatttacccgttttaaagttcccttcttcgtgctgttcctcgtcttccttccgttcttcttgtct

SEQ ID NO: 42984 - DNA, 429 bp, Zea mays
  Clone ID: LIB3062-008-Q1-K1-E4
caccgctgcaggctatatagctagtctgcagagatgcttgggaggagcaggaggaggagaggcggggcctcgccatccaagtcgcaggaacccaccaacaccggcgcggccgtcactgctgacgccggccagggcgcggcgaccggcgcctcgcggtcgcagctcgtcacgcggctcgatgagtctgccacgacgaggctgcaacgcatgagccacaggctgagcactgctcgagcagcacatggaaacactggaggccgacgttgccaaggccagcacggactcgtacgagtagagtactcctaggtagcatatcttagcagacgaacgagcttgtcacgctccagcgtcggattcagcatggctactccaccagccagtgctatctattgctcgggcggctaagtatataatttttaagaggatcat

SEQ ID NO: 42985 - DNA, 407 bp, Zea mays
  unsure at all n locations
  Clone ID: LIB3062-008-Q1-K1-E7
ggtatctgagcattccaagtacttttgcgagttctgtgggaagtttgctgtgaagaggaaagcagtgggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaagcatgttgtgggggccttatctagtggaaatgtggaatcactgtactgggctgtttgccgagacaatgctccttatatttggtttatgcctttaggacctaaaagtggggtggtgaaaattggccttgggtaccggtcttgattttgccaatggatattgatcctgntgcc

SEQ ID NO: 42986 - DNA, 435 bp, Zea mays
  Clone ID: LIB3062-008-Q1-K1-G2
ttgcttggctctgtctgaatgcaccaaagagtccaatcattgcttcagcctggcttacagttgctggtggattggaatccttcggccactcaggtttcttagtaaatctacaggagattgccccacaatatgctggagtcctacatggaatgtcaaatacagctgggacatttgctgccattctaggaactattggagcagggttttttgttgataggatgggttctttccgtggatttttgatattgacgtcgctcttatacttcagcagtgctcttttctgggacatctttgctactggagagcgtgttgattttgatggcactggctagcaactcagaggaactctgcggttttctgtccttaaaacacataatgttgattcaagacaatgtttttaccggcaaccatcaagaagttatttgcacctgatga

SEQ ID NO: 42987 - DNA, 279 bp, Zea mays
  Clone ID: LIB3062-008-Q1-K1-G5
aacgcctgcatcaccaacagcaacaccgccatctagatcagaaacttcctcggcgagaagaaggtcaggaaggtggacatgcttgatggcgtgaccatcctccggtccgagaaggtcaaggatgagctcatccttgacggaaacgacgtcgagctcgtatctcgctccgacgacctcatcaaccagaaatgccatgtgaagaagaaggatatccgaaagtttttggacggtatctatgtgagcgacaagggcgtcatcgaagaagaacaatgagcgaca

SEQ ID NO: 42988 - DNA, 352 bp, Zea mays
  Clone ID: LIB3062-008-Q1-K1-H10
aagcgtgatcagctcggtgccaacaaaacctcatcaaccaagtgtcatgtctgatctggacgatgagcttgcatctgcctttgatccgtttgctgaggcaaatgctgaggactctggagctggtcctggaacgaaagattatgtgcatgtgcgcatccagcagcgcaacggcagaaagagtctgactacagtccagggtctgaagaatgagttcagctataacaagatcctcaaggatctgaagaaggaattctgctgcaatggtactgtagttcaggacccagagctaggccaggtcattcagctccaaggtgatcagcgcaagaatgttgctactttcctagttcaggct

SEQ ID NO: 42989 - DNA, 369 bp, Zea mays
  Clone ID: LIB3062-009-Q1-K1-B5
aagccgtgggggtggcggctgtcgctgggcctcgcggcggtgccggcgctgctgatgaggttgggcgggctctttcttccggagactcccaacagcctcattgagcgcgggcgcgtggaggagggtcggcgcgtgctggagcgcatccggggcacggccgacgtggacgccgagttcacggacatggtggaggcgagcgagctggccaacaccgtcgagcacccgttccggaacatcctgcagccgcgcaaccggccgcagctggtgatggccgtgtgcatgccggcgttccagatcctgacgggcatcaactccatcctcttctacgcgccggtcctgttccagagcatgggtttcggcgggaacgcg

SEQ ID NO: 42990 - DNA, 435 bp, Zea mays
  Clone ID: LIB3062-009-Q1-K1-C1
tgaagatgcaagaatggagctccaaaatttggagaaacaagttgatgtgttgcagaatgagaagaaggatttagagactcaattaaatgagcttaaaaatatggaatcaatggcaagtgaacaacatggaagaattgagaaattgactgatgaattaagcagaaaagatcaagaaattgaaggtttggtgcaagcactcgatgaagaagaaaaagagcttgaaatcttggagaataaaagccttcagttggagcaaatgctgcaagagaaagaatttgccttgaagacctcagaagtttctaggaccaaagctttggcaaaacttgcaacgactgttgacaaatttgatgagctgcatagcttgtctgagaaccttcttgctgaagtggaaaaccttcagttgcaattgcaagaaagagattctgagatctcatt

SEQ ID NO: 42991 - DNA, 362 bp, Zea mays
  Clone ID: LIB3062-009-Q1-K1-D12
ggtgaggtcgaaagcggcgagcgaagtagaagatgctggacaagctgtgggacgacgtggtggccgtgcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgacgtcgtcgacgacgcctctcgtcgccagccacgtgcggcacaccgttgttcagcacgcgtgcagagtagctagctatggcatctacgcagaccgtttcaaccggcatcaggatagatggaccagcgactacgactgactctacagc

SEQ ID NO: 42992 - DNA, 395 bp, Zea mays
  Clone ID: LIB3062-009-Q1-K1-E7
tgttgattggagtgcgcaatgggaggctgtgcgggaaaggtacgtactgatgacgaagaaaagcttgattttaaaggtggaaatgttcatattataacaagcaatgagggctgggaccagaagattgcagaagcaaacagagatgggaaaactgttgttgcaaatttcagcgcttcctgatgtgggccatgccgtgtcattgctcctgtctatgctgaaatgtcaaagacttatgctcaactcatgttcttgacaatagacgttgatgacctgatggacttcagctcttcatgggacatccgtgcaaccgcgacattcttcttactcaagaacgggcagcagatcgacaagctcgtgggcgcgaacaaacctgagctcgagaagaaagtgctagc

SEQ ID NO: 42993 - DNA, 372 bp, Zea mays
  Clone ID: LIB3062-009-Q1-K1-F1
tcgagagcagcgacaccatcgacaatgtcaaggccaagatccaggacaaggaagggatgccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaagatcaagaactgaggtgttgctgctagtcagtttcatggacaat

SEQ ID NO: 42994 - DNA, 344 bp, Zea mays
  Clone ID: LIB3062-010-Q1-K1-A2
taccagaagatcttcaaggccgactaccatgtgccgccctgggtctccggctacgcgcgcgtactcatcgcgcgcctgctcgtcgtcgaccccgccaagcgcgcctccatcgccgagatcatgtgcactccgagactcaggaagggcttcgtgccgcccatgctttctcccacagggacacccaagaaacaacagctcgacgaaagcactggcctcttcgacaacgacgacgactacaacagcaacagttaccactctggcaccacctccactcgatcatgcaacgcgttccagctcatatgcgccatatcctccaggttcgacctgtcggggctgttctagag

SEQ ID NO: 42995 - DNA, 385 bp, Zea mays
  Clone ID: LIB3062-010-Q1-K1-A7
gaaaaactcagcacaaacattcaaatgttcggatgttcaaattcttcgaaaatgttcagactttagacaaaaagtaactctaatagcagcttcacacacgcacaggggacaactccgaaactgactgggcagaagacttaacacggtcgaaaagctaaagcctatgggcgagcagcaaccggtgctggagatggagctgtagcagcagcaccaggaccagggcggaggcctccttgtccaccagcaggcctatcctacctgcgcctgaagcgctccggcggcttgcgagccctgcgcttttcacgggatcggacgcggacgatgtgagcgtggatcgcgcacgagacgcagtggtgcaccttggcgtacagcttcgggaggacgt

SEQ ID NO: 42996 - DNA, 359 bp, Zea mays
  Clone ID: LIB3062-010-Q1-K1-D4
ggcgaaaatagttgtcacagtcgattcgtatgatgaaccggcgatgaaaattatcacaacgactggcaatgaaaaccatttcttacaaaaacagcaccgctacagtaacttaccgagaagctgaggctggcgtgagcggcggttaccaaacacaccacaccctatgagctagcgtgataggagagccttgtggcactggcagctgcggcagtgcttctccggtgcgttcttggcgtggaagtaccatccggagagcatgtcgaagaggatcccggctccgacgccgacggccaggtcgatggtgtagtgtcccctgcacgccagcagcctgaccccctggagcacgttgagcgcgtcgt

SEQ ID NO: 42997 - DNA, 429 bp, Zea mays
  unsure at all n locations
  Clone ID: LIB3062-010-Q1-K1-D9
ttcgcggcggacaccagcctgcggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctgtcatgggtccaagacgaagatatcggaagtgatgacatctccagctatcacactatcgtctgacaaaaccgtgatggatgctgctgntctcatgctcaaa

SEQ ID NO: 42998 - DNA, 428 bp, Zea mays
  Clone ID: LIB3062-010-Q1-K1-E10
cggacgcgtgggctgaaacaagaccactagaaacaagttgaagcatctttgcttaggtgaagggaatcggaggagaaagcaaagcttcttgttgaagagagagatcgcttgcttacagagagagattccgctcttcaagaagctcagatgtggcgctcggagctaggaaaagctagaggaaacgctgtaattctagaagcggctgttgtcagagccgaagagaaagctagggtctcagcagcagatgctgacatccgcataaaagaagccatgaaccgacttgagtctgccaccaaagaaaaggaggatctcctagcccttgtggatgctctacaatcccaaatacaaaggcaagagactagcacgatacaggtctgcgaagagagctcggaactctgctcgactgcctcgaagcacatggaggatga

SEQ ID NO: 42999 - DNA, 422 bp, Zea mays
  Clone ID: LIB3062-010-Q1-K1-E12
tccgtctcgcgtgacttcattcccagcgtccggcggcgacctccacgtggtgccattggccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcagtaccccacactgctctgtgtgataactcgtgtaattcagttccggggttgctttattcatcactggcagagtggcagtgggtgctaatttctgcaggagttaaggctatgcatgctagtttgtgtcaggactttgcagtcatgacttttgttcccaacaaatcgatgaacattagaagtgaatgaatagttgccatgttgtaac

SEQ ID NO: 43000 - DNA, 425 bp, Zea mays
  Clone ID: LIB3062-010-Q1-K1-E9
tgcttctgacatgaacattctagagcgccatgctagctatttgatgtctggcaaggagctttctaaactcgtcgcttttgtcaaggggactcaatacgatcttgtggaatatctacaacgagaaaggcatgggtctgctcgtctggagaattttgcttgtgcactcgaactgattggacaaaagctccaaatggatacactgcaaagccgacttgatgcagagtttcttctagctcatatgtgttcagtcaagtttaaggaatggatcgtgctgctagctactctggcgcggcgtacaaaggttttgcgcggatctctttcatcatgatctgcgattgtggaaagcatatagcattactctacagtcacatgatgtattcagggaatatcttgaccttcttaatatcttcgaagaacagctttcg

SEQ ID NO: 43001 - DNA, 297 bp, Zea mays
  Clone ID: LIB3062-010-Q1-K1-G10
ttcctcgccgccggcggcttccgtccccgtgaggcgctcttcctctgggccgccgcagcgtcggcgtccagggtgctgcttgggcggcactacgtcctcgacgtcgtcgctggggcttgcctcggcgtgttcgaggcctggctcagcatcttgctcttgggattcatgtgcgctcaaagcaccttccttgtatgctaatccttgttatcgtagtaccacgaatccgccacattgtggtatacactgtgatacagcattgctgattgtgaagttacaatttcggttagcatttcagtc

SEQ ID NO: 43002 - DNA, 392 bp, Zea mays
  Clone ID: LIB3062-011-Q1-K1-B11
agaatgaagaatggacatgtagcataccaatccaccgtcagtgttgttccaaataatacatccaagtaatacagcgtctagtttccaaaaaaaaagtaacccagcatcctaatggtattagttcacggctccaggcctacaatatctggtttcccatccgacggcagaaaactttccaagcatccactggtaggtacacactttgatgattcgttaatctttccactccagccagacaaaacccaatctcccatgtacatcaagtggcacttagtcattcaaacttgcactctctttctccatctcaacaatacaagctaatctatcatggacctctgaaagtttttgtgctgcttcttgtttgaacttctcgtcataccattctcggggta

SEQ ID NO: 43003 - DNA, 428 bp, Zea mays
  Clone ID: LIB3062-011-Q1-K1-F9
tgtctccggccgagggcggcggcgcgaccggtaaccagcgtcagcgtgagtgtgacaggcgacatgactcgcggcaaccagcgtgaccgcgatcgtgagcgcgcggcggcgcggaagcccaacggcaaggggccccaggacgggctcaccccggagcagcgccgtgagagggacaagaaagcgctggaggagaaggcggcgaagaaggcgcagcaggcagcggccggcggcaccgggacctccacggacaacaagaataaggcaggtggcaagaagtaggccgcagcggcgagcggcgccacctctgtacgattatcgatccatgcctttagcttgtaacctgttcgcatcctcgtagatgcgatgcttgttgggtcataaactcgttttctgttactctgatatcaaaatttggtgatgagaataaa

SEQ ID NO: 43004 - DNA, 388 bp, Zea mays
  Clone ID: LIB3062-011-Q1-K1-G11
cagaagcagaaataagaaaggctgaaaaggcagaacgggaagccagagatctgaaagggacgatgaggaaacggatggagttcctggacttcgattaacaccgtcaccgcggccgttgccgctccccattgtggcggaatctttagtggcggcctgtgtgccatacatgcctggtgaccgcgccggcgcaccttggattgctggagggtttagcgaacagtttctttttaactagcagtgctgctgtatactctcgtggccacagaccctttgagcgcctcctgatacagctttgtcaccactctgatcattgcctcgatgaatttatatacctgacgttatggattaaaaagaatgaaagatgtgatcttgagtgtgtgcacacaac

SEQ ID NO: 43005 - DNA, 385 bp, Zea mays
  Clone ID: LIB3062-011-Q1-K1-G4
cacggcgccgccgcttctgccgccgggagccgagcccaagcctaagcgaaagccatggcgagtggttctctgatcgcctctactttcgccagatctagccatgccctccccgctgccgccgcttcggccatctctcaggctcccagatcccagcacaccgcatctcctctactctccggccttggagcagcggctcgtgctttcagctcaagggctctatggaagggagcattcgttgacgctttcctgtctagaattaagaagaacagagaaaatatgaatggcaagaagatttggtctcgtagatcctctattttgccggaatttgttggttcctctgtgctcatttacaatgggaaaactcatgtccggtgcaagatcactg

SEQ ID NO: 43006 - DNA, 415 bp, Zea mays
  Clone ID: LIB3062-011-Q1-K1-H1
tgacgatgttgggatcctcaagacaggatgcggcaactcgtacgctccatttcctaaaggttgcttctacaccacctccggtgggctgcagagcttcgagcacccgttgcacgaggtcaaggcggtgccacgcgtggacagccaaggccagatgtgcggctccatcttcaaggtcgacagcgagagcaagaagaagcaggacgctagcatcccccgcgtcggcagtgctgccgactggtccaaccagttctgaccatcttcttgctatccattgtcccgtctactatacgaggtgcagagctgtgtatctgatgaatccatgagacgatttctgctacgtttcttgcacgcttgtcgaacactgtgagactcacatcgcgctcatctacgctacgtgtaactgatactaatgata

SEQ ID NO: 43007 - DNA, 424 bp, Zea mays
  unsure at all n locations
  Clone ID: LIB3062-012-Q1-K1-A11
caaggctgtcgattttaaaggacatatactccaattctctggatttgtttggcatgagagtgatgaaaagcagagagccaaggcaaaagagaagcttgataagtgtgtaaaagacactctgctggacctctgttggacccttggtattccaactccgaaagcaaacattagaaaggaagatattgtgtcaaagctgttggacttcattgctgaacctcactctgcagctgaatcttggggctctgatgatcagggatcaaattctaaaaaacgcaagagaggaggtgaaagtgcaagtaagacgcctgatggcacacctagtaggtcgaggaagaaatttgtcgatgacggtacttctagtaaaaggcagaataaagcgctccagtatgatactgangaagatgaatccatgaagtctgacagt

SEQ ID NO: 43008 - DNA, 159 bp, Zea mays
  Clone ID: LIB3062-012-Q1-K1-B12
gtctcattaactcttccccccttaacgaaaacaagtaaaaatgcatgccttaaccatcgacagcccgaatccatacagatctttaaccccccacctacccagaatctggaaacccccccaggaaagcccccaacgagcccacttttaaggccaatgaca

SEQ ID NO: 43009 - DNA, 394 bp, Zea mays
  Clone ID: LIB3062-012-Q1-K1-C7
ggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgctcc

SEQ ID NO: 43010 - DNA, 423 bp, Zea mays
  unsure at all n locations
  Clone ID: LIB3062-012-Q1-K1-D3
tgagcttccgtggatactgtgcggacggacccgagcgcgttctggtgtacgacttcatggcgaactcaagcctgtatgcgcatctccatggaccgcattccgcggagtgtctcctcgactggcggaggcgagcatcaatcgccatcggcaccgctcgggctctcttgtaccttcatcgccacgcaacgcctaagataatccacggaagcgtcaaggccaccaacgtgctgctggattcagacttccgggcgcacgctggcgatttcggtctggcaaggcttattcccgacgacggaacggaccacgcaaagatagccagcagcgagagccagcgaggctaccttgctcccgagtacgccgncatgttcggcaaaccaactgcaggctgcgatgtatacagcttcgggatcatactgctggagc

SEQ ID NO: 43011 - DNA, 431 bp, Zea mays
  Clone ID: LIB3062-012-Q1-K1-D8
gcagcggatccatccaaagcttcgttagattgctcacggtcccagttgctgctgccgaccaggccggacagcggatgactgctgcggctgcactggtgccggtccagggagcgagaggggcaacaccaggaagaccaccaagatgccggcggctggactgaggagggccggcggccggtttcctcttgcgcgggacgtcgggagcagcggcgccaatgagcgctcctcctcggtccgccgcggcttcggcggcggcgttgcaatgccgcgcgcgttgctggaggactcggcgccggcgatggacgcccccgcgacgaccggcagggagccgccgcccccggcctcagccgcggcgtcgagggtcacgccggcggtgctgttcgtcacggtggtcctggccgtggtgctgctcgtctccggcctgctccacg

SEQ ID NO: 43012 - DNA, 385 bp, Zea mays
  Clone ID: LIB3062-012-Q1-K1-E7
aaggggaacattcaacggttctacacagtgacacaacacatcaacacaacccaccgagcacaaacgggccagggccaggcccaggcgagtgaccagtcgtttcacgctcacacgaaacggacaatgcgctttatcaatcagtgaagtgccctccactccactccacctcaaggatgcagcgccgagtaggtccggtacctgtactccgacgccgcgtcgtcggccggctcgctggagctttggtatttgctgcggcacggaacgtagttgttgaccgggcatgacttgggctggcggaggaacttggcgcagtcctcgtgcgagcgctggttgggcgcccactggatgcagttgcggtcgacgttgagcctcccttccttgatca

SEQ ID NO: 43013 - DNA, 83 bp, Zea mays
  Clone ID: LIB3062-012-Q1-K1-G12
tggattgacattacgtattgtctttgtagagatacacctcataaacaggaaaaggggatcttaaaaaaatgacattatacacc

SEQ ID NO: 43014 - DNA, 440 bp, Zea mays
  Clone ID: LIB3062-013-Q1-K1-B11
tgcgcctctacatttcttctctctctgctcctccgcctccgcctgatccatccaagagagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactctt

SEQ ID NO: 43015 - DNA, 464 bp, Zea mays
  Clone ID: LIB3062-013-Q1-K1-D7
tgaccaccaaccacaagaaaagcatcaagaaagaagcatgctggacaatctcaaacatcacgaggtggtaacagggaacagattcaggccgtgattaatgcaaacataattgcacctctggtgcaacttctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaattgtaacagtttgcttggagggtcttgagaacatcctgaaagttggcgaggcagagaaaaatcttggtgcaggcgatgtcaatgtttacgcacagatgattgatgatgctgagggcctggacaagattgagaacctacagagccatgacaacactgagatatatgagaaggctgtcaagatgct

SEQ ID NO: 43016 - DNA, 375 bp, Zea mays
  unsure at all n locations
  Clone ID: LIB3062-013-Q1-K1-D8
ctgaatcagcatcagaagttgagcgatggataagaaaatgctttgcttaatggtggaataaggcgtgctaggtgctacgagtggcccaaactacgagttgggaaatgagatggcggtggatggttggttgcccaatgcgtggctgggagatgtggcagggcaaggcttgggcgccagtgatggtgcataggctaggtaggagagcacagcagggaattagtatgggactacattcatgaatatatgtaaggccaagttacaaatcctatccttcctcaatacaagctcaactgaattctaatccaatgtatcaatatctctagctaacaaaccgatgaactcatctnctaaacaaaaaagcacctatgactctgt

SEQ ID NO: 43017 - DNA, 410 bp, Zea mays
  Clone ID: LIB3062-013-Q1-K1-F10
tcctcgccgccgtcttcctcgccgcggcggttctgctcctcctttctccggcagagggggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaacgtgacggcgcagctggtcccggccatggccaacgtgcacgcc

SEQ ID NO: 43018 - DNA, 410 bp, Zea mays
  Clone ID: LIB3062-013-Q1-K1-F2
tcctcgagcacactgatgtggctatcctgctggacaacgaggccatctatgacatctgccgccgttgccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaagatgtgaatgct

SEQ ID NO: 43019 - DNA, 457 bp, Zea mays
  unsure at all n locations
  Clone ID: LIB3062-013-Q1-K1-G8
taaacccaagcctcctcgtcctctgtcagactaccactctctccctcgcggactcgcggttgatgtcctcgcggcggattcgcatcttccgcgtcagggacagggagagtactccgtcggacggttggaggagaacagggggagaggagctctgagatggagacggccgcctcggcagcgcgcctggtgaactacccgctcgtcgcggcgctcctcgcgttcgccctcgcacagtcctccaagttcttcaccacctggtacaaagatggccggtgggatgccagacagtttatagcttctggagggatgccatcatcccactcagctacagtgacagcactcgcagtggctgtggcgatacaagaaggctttcatagtgcaacctttgcaactgcactagtctttgcatgcgtggttatgcatgatgctnttggagttcggttacatgccggaaagc

SEQ ID NO: 43020 - DNA, 363 bp, Zea mays
  Clone ID: LIB3062-014-Q1-K1-A1
aacagcaaagaggcgcgatccatgcgacaggtagaagaaatacaataatcccagggttgaacttgaatcccaccagaaacacggagcatccacagaatacacaccagccctagtctaatccaatcgacatcgacagagtaccagtagtctcataacagagagagagagagagagaaaaaaaaagaaaagagggcgataacgcaggacaaagctagaatagcacggcccagttccagctcttccgtaagctggttgcttcacttgcagccgtgttggacccggcacggatggttccgtcagaagcaggcgtccaggaggcagcagcagcagagggcagccaagctgttcaagcaagaatacagt

SEQ ID NO: 43021 - DNA, 301 bp, Zea mays
  Clone ID: LIB3062-014-Q1-K1-A6
gttcgatatacttgacagttagtaattgagatctttgcgatctcaaggctgtttatccgtctgttttcttccatgtttgcccacacttcacctcgtttgtaaatgtggacgtgcaggtggcgtcagtgatagtgggaaaggactaatgttctttttaccaatatattataacagtgtgtgcatataaatcttctgagctcgcaagctgtgagcctcccaggttaaaagtgtttatatgttggcatcattgtttgtttcagatattttattgcagaacagaaaattgccacctatcattgcg

SEQ ID NO: 43022 - DNA, 378 bp, Zea mays
  Clone ID: LIB3062-014-Q1-K1-B1
aacatcaaaaaggcgcgttcatacaacaggtagaacaaatacaataatcccaaggttgaacttgaatcccaccaaaaacacctaacatccacagaatacacaccagccctaatctaatccaatccacatcgacagaataccattagtctcataacagaaagagagagagagagaaaaaaaaagaaaagaaggctataacgcatgacaaagctagaatagcacggcccagttccagctcttccgtaagctggttgcttcacttgcagccgtgttggacccgtcacggatggttccgtcagaagcaggcgtccaggaggcagcagcagcatatggcagccaagctgttcaagcaagaatacagtcagccattttacataa

SEQ ID NO: 43023 - DNA, 420 bp, Zea mays
  Clone ID: LIB3062-014-Q1-K1-E10
tttccccttacttgggatataactcacttaaggattatttccctgctatggaaatgaggccaaatccacaatgcttgaatccagcatgtgttcacagacagaaagaatatatggaatccaaacctgctagagatgcagcagcgaagactaagatggaagctgaagcatccacagaaaatgaatgtcctgtccacctagacaatgagtggaatattagtgttcttgatgatgaagaaactgagacatcaagcattcgaaacactccagatatcctaccggaaggtcttgtccgtgagcttccagacgctgattcatacgcaagaccagctgctccagtgagttccagcgctattgatgatgatgatgatctcgaggagctccagcgtcaacttgatgccctaaacgcatcttagccttaat

SEQ ID NO: 43024 - DNA, 422 bp, Zea mays
  Clone ID: LIB3062-014-Q1-K1-E12
tgccgccgctcccttgacattgagcgcccaacctacaccaacctcaacaggctggtgtcccaggtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtg

SEQ ID NO: 43025 - DNA, 439 bp, Zea mays
  Clone ID: LIB3062-014-Q1-K1-E8
ttccacatttgaaggtcacaagagcaaagttcagtaaaatcaaagaaaaggccaccttggaggcgtggaaaggtctgcccacaacttcctgtaccagggcacattccaagaccatcttatgttggtgcgaaaggattgcctgaactatgcaagggccaattacatgatgctcaaggaattactggaatgagagctgcttgcaaacttgctgcccgtgttcttgacttcgctgggactttagttaagccatccattactacaaatgaaattgacgcagcagtccataatatgatcattgaggctggtgcttatccttctccacttggctatcatggatttcctaagagtatatgtacatcagtaaatgagtgtgtctgacatggggtacctgattcaactcagctgcaaaatggggatattataaatattgatgaaaatg

SEQ ID NO: 43026 - DNA, 432 bp, Zea mays
  Clone ID: LIB3062-014-Q1-K1-F1
gaccgcacgcgtccggacggctggtcctgcacctactactactatcttgtcaacgcaggtgttacgagatacgcggggtaatgactcggacgcaatctgccgtatcggtcgccgagtacccctgcttgctgctgctgccagcctgggccacgacctaccactccgtcatcacctcttcaaagctagctccgacatctgcactgcctgtcctactcccatcggacgacgtacaggccctgcgccttctgctgtatcaccttcaggaacctcaagatcatccgcaacaccattcgacgacaggaacgccaaactgcaactgcctcaagaacatcaccaggaacgtcagccatctcaacgccggcaacgccggcagcatccacttcaagtgcggcgtcagcatgcgatacaccatcatcaccttcacccactgct

SEQ ID NO: 43027 - DNA, 440 bp, Zea mays
  Clone ID: LIB3062-014-Q1-K1-H1
tctgtccttccgcgggactagtgctttttctggaagaattccgccgaatggcggcgaagaatccaatgcgtgaaggcccgccgaaccttggccggcggggcaaacctacacaccaaggccaagtggtttgcgcacataggaaccttgcgagggcccagctgttcccagtggagcataaactggtgtatatgaagctctggagtagaggaatgggggctgtgactatttggaaaagggtgtctccaaggctgagaacagtgtgaattctgatattggacctgctctgattgacaaggaccctacagcacagactgagattgataacttcatggttcaacaacttgatggcaccaaatatgagtggatatggtgcacgcaaaaccttggtgctaatgcgattctgtctgtgacattagctgttcgcaaagctggggctagca

SEQ ID NO: 43028 - DNA, 430 bp, Zea mays
  Clone ID: LIB3062-014-Q1-K1-H3
tcgtccttccgcggactaggtttttctgaagattctgcgatggcggatacgatgcagggcgtgaaggcgcgccagatctttgacagcacgagcaaccctacagtcgaggtcgacgtgttttgctcagatggaacctttgcaagggcagctgttcccagtggagcatcaactggtgtatatgaagctctggagttgacggatggtggctctgactatttggagaagggtgtctccaaggctgtgaacactgtgaattctgacattggacctgttatgattgacaaggaccgtacataacagactgagattgataacttcatggatcaacaacttgatggcaccaaacatgagtggtgatggtgcatgcaaaagcttggtgctaatgcgattctggctgtgtcattagctgtttgcaaagctggtgctagca

SEQ ID NO: 43029 - DNA, 396 bp, Zea mays
  unsure at all n locations
  Clone ID: LIB3062-015-Q1-K1-G9
tgcagatgcacttcgtgaggtttctgcatcccgagaagaggtgccaggtaggcgtgggggtcctggatatatgtatactgatttggcaacaatatatgagcgtgctgggcgtattgaaggaagaacaggctccattacccagattcctattctaacaatgcctaacgatgatatcacacacccaactcctgaccttactggatacattactgagggacagatatacattgataggcagctccataacagacagatttatccacctattaatgtcctgccatctctttcacgattgatgaagagtgctattggtgagggcatgacacgtcgagaccattcggatgtatctaatcagctntatgccaactatgctattggaaaggatgttcaagccat

SEQ ID NO: 43030 - DNA, 77 bp, Zea mays
  Clone ID: LIB3062-016-Q1-K1-C10
ctccaatcaaaggattgatagtctaggtaataatccatgttaatgaataaagtgggtggccatcttcacaagagatt

SEQ ID NO: 43031 - DNA, 162 bp, Zea mays
  Clone ID: LIB3062-016-Q1-K1-C9
accatattacgacattattatggtttgcatattgtcttgcgttttgagttgtgacaatgtgcaaaccatattacgacattattatggtttgcatattgtcgtaatatggaactcgtttatcatgttcattccatcctcccgttatgtgaaaaataagacaac

SEQ ID NO: 43032 - DNA, 274 bp, Zea mays
  Clone ID: LIB3062-016-Q1-K1-E4
taggctgcgatggctcggtgctcctggacgccgttccgggggtggccaactccactgagaagctggcgccggccaacaacaactcggcgcgggggttcccggtggtggacaaagtgaaggcggcgctggaggacgcctgccccggcgtcgtctcctgcgccgacatcctcgccctcgccgcagagatctcggtcgagctgtccggaggaccaaagtgggcagtgcttcatgggaggctagacagcaagaaagccgacttcaagagcgcggagaa

SEQ ID NO: 43033 - DNA, 418 bp, Zea mays
  Clone ID: LIB3062-016-Q1-K1-F8
ttcactgtctgggatgtcgggggtcaggacaagatcagacctctttggaggcagtacgtccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgagggcctggactggctggccagcaacattgcgagcaaggcttgaggcctaccttgaaatttaactgcgaactgactaagagctccggatgtatcatggaaac

SEQ ID NO: 43034 - DNA, 416 bp, Zea mays
  unsure at all n locations
  Clone ID: LIB3062-016-Q1-K1-F9
tctcgttattgtggatggatgagagagaactatgttcctactttttgggatgcaattggtttacagctcatgacacatttgggctgctattttaccccgtgaagtgtgaactccaaccaggcctcttaagttagaattagctaatatcccgaattacagaaaagcaggtggttacaccaacagataatgaactgatagttgttggagatggtcattcaggtaccatatctgttcgtgcagctggtaacgaccttataagaccatttgatgttgctgttagtgtacccacttgagctagacccttttccatcgtacgcaacanattgattatatgacatactgatatttcatgtcagaggatcaatctcttttagttaggaatcgacagatccaagatgtagaaaactctacttttt

SEQ ID NO: 43035 - DNA, 335 bp, Zea mays
  Clone ID: LIB3062-016-Q1-K1-H5
tgtgcttttcctccgccagattcggtgctcaaggcgctgaacttgggctccccgaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctggctctctagcagcatctgctactggctgcagctgccgtcggcgtcgtggtctgtctggtcaagtcgaaataaaaaaacggtaagtattggactactgtagaaagttctttt

SEQ ID NO: 43036 - DNA, 167 bp, Zea mays
  Clone ID: LIB3062-017-Q1-K1-C11
gaagttaaattcaagcatctagtattcgttgagttgtgcagctaatcaaagattctttacacaacggaaccaaaggatccattgctgccatgcaaaatacagtaactagcttttgacaataatatacccagcatgtatatgcatattaaaaaccacacccaattgtt

SEQ ID NO: 43037 - DNA, 434 bp, Zea mays
  unsure at all n locations
  Clone ID: LIB3062-017-Q1-K1-E11
aagcgccacacacacgccgacgcgaaccaaccaaccagctggtagtaggttcgccgcgctgacgatgatgcctcgccgcgcccttctcttcgccgcggtgctcctcgcggcctccgccgccgcggtctccgggttccacctgggaggggacgagagcggtctcgtgaggggtgtgctcgccgcgctccgcgagcgagccgaggccgaagacgccgctcgcttcgccgtcgcccactacaacaagaaccaaggcgccgctttggagtttactaaggtgctcaaatccaagcgggaagtggtgaccgggaccctgcatgacctgatactggaagcagctgatgctggaaaaaagaatgtgtacagagcaaaagtttgggtgaagccgtgggaagatttcaagtctgtcngtgagtttcggcttgttggagactctg

SEQ ID NO: 43038 - DNA, 151 bp, Zea mays
  Clone ID: LIB3062-017-Q1-K1-H11
aatctacccagttaactttggaaatgagatgttctagttgatgcacagggttcaaagtagtagatctgagaagggcacttctcaaaatctacacaccaaaaagatttaaacaaatcttccacggaatggtgagagaacgaagaacacaaaa

SEQ ID NO: 43039 - DNA, 427 bp, Zea mays
  Clone ID: LIB3062-018-Q1-K1-A10
tgcgcattacggtatctaataacgattgcggtgttcgtgaatacgatatggagagatggcagctcttgaaccactaccgatataactggccagttaatcacacatctgtgagcccggataagaaacttttggctgtggttggagatgatcgggatgctcttcttgtggattcacggaatggaaaggtaacctctaccctagttggccatctggactactcatttgctacggcatggcacccggatagccggacctttgcgaccgggaaccaggacaaaacctgccgtatctgggacacccgcaacttgtcgacctcgcttgcggtattgcggggcaacatcggcgcgatccggtgcatacgctactcctctgatggacggttcctggtgttttcggagcctgcggactttgttcatgtgtacagcgt

SEQ ID NO: 43040 - DNA, 373 bp, Zea mays
  Clone ID: LIB3062-018-Q1-K1-E12
ggcagagaattttagttgcattatttcttcacctcgctttccgcgagatcaccggctagttagaggaaaacgcaggtaaaaacgattacaacacgcgcacactccactattgaaaaacataacaataagaaaaaaaagagagaaaagaaactccctagaaagacgggtacccaaccataccatcatatggcagtatctggtggtatagcgctttacagctaggaaaatttttatctgtaatcagatggctcccgtcgggcagcaaaggtgttgtcgtcgacatcgcagcagaggggctctcacaccgtgtagttctgctggatggtgtcgatgtccaggcccttgagcttgaccaccgacttcacgtggccct

SEQ ID NO: 43041 - DNA, 396 bp, Zea mays
  Clone ID: LIB3062-018-Q1-K1-G11
ttcaaaacagggaggcttccccaatactcagtctacgcaacatgttcccagtacaagcgtttcgtcgggtcttcctctcccacaacaattgcctgtatactctcagccaactctgccccttgggccttttaccagcctggttggctatccatatttgcctcagaactattacctaccttcagcgccattccagcaagcgtactcaagtaatgggcctttccatcaatctgctgctcctgccgtgcctggagctggtatgaagtatccgatgccacaatacaagagcagccctcctgcttcgaccctaccacaaccatcatcactctctggttaccgaaggttcggaagtgcaaataatatccctggaaatttcagcccaaatcagggggctccccc

SEQ ID NO: 43042 - DNA, 306 bp, Zea mays
  Clone ID: LIB3062-018-Q1-K1-G2
tgctactcgtaatacctttggtgatcttgatcaaagtgttcgccctgttgcacctctagaattgttgcagacactgcgtaaaaaatacccgcaatttgcgcagcagcataataatgtctacatgcaacaggatgcagaagaatgctggacacagttggtgtatacgctttctcaaactcttacctcagattcaagtgaatctgcagctcttccgatgaagcaactatttgggatagatctcgtgagcagggtccactgtgcataaagtggtgaggagagcatggacacagaatcagtatatcccct

SEQ ID NO: 43043 - DNA, 433 bp, Zea mays
  Clone ID: LIB3062-019-Q1-K1-A10
tgctatagcacacaagctgatgtatggagcataggtgtaattgcatatatacttctttggggcaatgggccattttgggcacgcaccgaatctggcgtattccgttcgggtctcaaagccgatcccagttacaatgaggcaccatggccttctctgactccagaagcaatagattttgtcaagcgattgctgtgcaaggatccgcgtacaaggactactgcagctcatgctttaaatcatccatggatcagaaattattatgacattaatctgccgtttgacattcttatattgcgacttatcaaagcttatattcgatactcatatttactgaaagctgctctgagagctctgtcaaagaaccttaaccgtagacgaactattatacctgaaatcacaagggatctctattggaaccaaacatgaatggatg

SEQ ID NO: 43044 - DNA, 364 bp, Zea mays
  Clone ID: LIB3062-019-Q1-K1-A12
tttttatcatttttttttttttttttgtttttttgaatagtaggtggatatatagtgacggttttgagctgcaatacagtttacattgtacacacacagtcacacacacaccttattcactcattgattgtgtcaccagtggtgcgcgtagacatccgcgaaaccaggcaggctgctggttctgcccacgattaagttacaagtactcaatcgcatagacccatgggagattactcggagatggagcacaccatagtaaccacgctagcaacacacgacgactactgagtgtatctctgacgcatgacacactatgcaagctcatggagtgtatcaacctccgttttggcctgcttcctcctgg

SEQ ID NO: 43045 - DNA, 186 bp, Zea mays
  Clone ID: LIB3062-019-Q1-K1-B12
tgtttcgaagagatctagtgttgcagtggtatgatcttatttaccacccacctatttaacggccaggggtgcagtacagcagcagcatcataaagtttctgactgcaagaacgttgctgtagggaaggaaagtaactgtgctagtagtgtacttgcttacttcaaggttaatatctgccaaaataa

SEQ ID NO: 43046 - DNA, 352 bp, Zea mays
  Clone ID: LIB3062-019-Q1-K1-B4
caggtctactatactagatgcattgaaagcaactgtgcatcgaatctgaaaccctgaggtaaagggtgtgtcttggatttcattggctatggtctctcgtgtatcagaaaggactgcatagaagtctacatggcaggagtgctggaatttttgcccgaagcaaaagctgtcctctactcccatggactaatgtatctctggcaggcagtgctggtccagcatcaaaaaatttctttcatttcgacatttgcccaatagttgtgttcatgttcttgttaaaccctgttgtgaatgagaagggacgacatttacctgcttaatatagtaaaaacatgttcgtcagaaaaaacca

SEQ ID NO: 43047 - DNA, 449 bp, Zea mays
  unsure at all n locations
  Clone ID: LIB3062-019-Q1-K1-D8
aacggtcgacatggctcgcacgcaatctgccgtagcggtcgccgtggtggccgcggggctgcggctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgtcagcatcccctccaagtgcggcgtcagcatcccctacaccatcagcacctccaccgactgctccagggtgaactaaaacctagaccacgcgcgacgacggccgcctgatcgatcgaccaaccattccgncgtcgccgccggccggatca

SEQ ID NO: 43048 - DNA, 394 bp, Zea mays
  Clone ID: LIB3062-019-Q1-K1-E7
tgttcacaacgtggtacatgtggctatcgctctatgaagcgcaacttaagatctctcaatctaggactgacttatctagcggtaccgacagcgtgtacatctaattcacagttgtcgtcaagcaacatagtcggatatgtatgtagctctctaccactactgggcatgatacgattcagtactaaggtgcatattgcacaagcaagatatgaagattcatgtgtcaccaatatctcaattactagggacgtgcattacatataatcaagaccagcttgatgctacacgcacgttactcagatatggatgatgatatgtgtagagaatgaataggtctgattctgattgctgtttacaggttagaggtgcagtgcatttacaaagagatataaga

SEQ ID NO: 43049 - DNA, 449 bp, Zea mays
  unsure at all n locations
  Clone ID: LIB3062-019-Q1-K1-H2
tatttctttgctctgtttgtgactatggaattgctggtgctgcctgggcaactatggtttcacagctttcatgatgatgcaaaatctaagcaataagggttttcgagctttctcatttacgattccatcagttagagagctattgcagatatttgaaattgcagctcctgtttttgtgacaatgacgtccaaggtggcattttatgcattgctcacatattctgcgacttctatgggagcaataacgcttgcagcccatcaggttatgatcaatgtcttatgcatgtgtactgtttggggcgaacctctgtctcaaactgcacagtcattcatgcctgagctggtatatggtgctaatcggaatctgaccaaggcaaggatgctattgaagtcacttgtgatcattggagcgataactgggatgaccttgnnggtagtagggacacttg

SEQ ID NO: 43050 - DNA, 427 bp, Zea mays
  Clone ID: LIB3062-020-Q1-K1-B3
tcggcttctcgcacgcgcggcgaccggcttcaaccccaactctgctgcttgatcctcggacacttcgaacgggacgagaaggaatcggacgccagatgagactaaccgacctaggatccatcgacgcgtgaagatgtgttcgcccgccgagtgctaccaatcacgtccacctataagcacggcatatgggacactgtgtttctataccaccgtgctagttcagctccagattatgcacccatgatctctctactcagattacccctaggtgttcaagaagctcgagatatggaggctattgacacggttcattattctggcaccattttccatgaaatatggtatccgcctgctgatgatagctaggtatggtgtcatgatggaaaagggtgcatatgataagcggactgcagatttcttatggatg

SEQ ID NO: 43051 - DNA, 417 bp, Zea mays
  Clone ID: LIB3062-020-Q1-K1-E6
tctgcgccgggctctgccccgtcgccctcggcgccgacggaggcgggtccgtgcgcatgccggcggcgctctgcggcgtcggcgggttcaagcccaccgtcggccggctctccaactccgggcttattactatgaactggaccgtcagcatgccggggatcctagcagcgacggtcgaggacacgctgatcgcgtcggtgccgggcagctagcttcttgtgtctcccataaaccaaatctttcgattcacatgtctgctttgttatcacccatgacgtaatgaaaacaccacgcaaatgttgtctggtttgttttccgagctttctttcaggtatgcggcgattgctgatcagtcaaaacaaaggcctttacagcctgaactgaacctgcccatgctgacacgcacgaggaccatgc

SEQ ID NO: 43052 - DNA, 435 bp, Zea mays
  unsure at all n locations
  Clone ID: LIB3062-020-Q1-K1-F2
agcggctgcaggagcgacccgccgtcgacggcgtgctctcggacctcacctgcgacagcgacggcaaggtgagcgagttcatcggcgggaggcacagcctgccgctgcacgagctgcccacccacgccacccgcggctactacctgggcatgttcctcgggggcgcctaccaggaggccctcggcgggctgcacaacctcttcggcgggccgagcgtggtgcgcgtgtcccagtgcgacgggccccactgcttcgccgtgacgcgcgccgccgcgggcccgtcctgcgccgacgtgctccgcgcgatgcagcacgagcccgaggtgatgtacgaggtgctgaagcagaggaccgacggcgccacggtcgncgncctcgcccgggccttcggcgcaatgccgtacctggtgttcgaccccgaggccgncgtgatgt

SEQ ID NO: 43053 - DNA, 433 bp, Zea mays
  Clone ID: LIB3062-020-Q1-K1-F8
tgatgacatctggtgaggctgtcaagtacaagagctccttggacgcgttccagcagattcttaagaaggaagggcccaagtccctgttcaagggtgctggtgctaacattcttcgtgccattgctggtgctggtgtgctttctggctatgaccagctccagatcctgttcttcggaaagaagtacggctccggcggggcttaaatggagaaatatgatgacgaacaagagcagtgtgtgttcccggtccttttcaatcaggatctggtgaagcttttgcctatcatatcgtagaaattaataattcatgtagagggaggattcttccaacaatttgctttggatggagacttagatctccaaacactgcgaactatcctactaagtggtgacatcggtacccaaaaacatttatggtcatagagtctgtcctt

SEQ ID NO: 43054 - DNA, 344 bp, Zea mays
  unsure at all n locations
  Clone ID: LIB3062-021-Q1-K1-G4
gggaaaatgggacgagttattggcagaaaggggtcaacgataatggctgtgaaagaatgttgcaaggttgaaatacatattggtggtgctaaggggcctccagacagggtgttcatcattggaccagagaaggaggtcaggaaagctgaggccatctttcgaggccgaatgctggagttctagagatgttaccctttgcgatacaggtttcaactgctttatattttgaacgtaaaaaggggaatatccaaaaggtgtatgcgggaccgtggatcccttgaccgtctgtgaatcatgaaaacaaaataaaggatttcaacttggcaaaaaaaaaaaaanaaaaa

SEQ ID NO: 43055 - DNA, 391 bp, Zea mays
  unsure at all n locations
  Clone ID: LIB3062-021-Q1-K1-H12
ttctctgcacgcagctcagtctcgtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgcctacgtcacaccggaggccaggccggccggcgaaccaagccgtggcgctgagtgccgcggctcggcggccgaggaccccataaggagagtcatgttcttggctccctggggtcacacataagaacacaaaccggccggtcgagatctgggcatgcaagctngcatggncatgtcctggtcagtcagatctgcaacaaccaaactgtaaaaagaact

SEQ ID NO: 43056 - DNA, 409 bp, Zea mays
  Clone ID: LIB3062-022-Q1-K1-F12
tccacaccccccgagctcagcttacctccactccagctccaatcacagtcgtgaccagagcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgggggctcctgtactgggt

SEQ ID NO: 43057 - DNA, 320 bp, Zea mays
  Clone ID: LIB3062-022-Q1-K1-F6
tctcattcgattacacacacacacggagagatcaaattgatacactgcgatcttgagcaaacgaatcacagaaaaaatcttgcgagacattactgaccgatggaattcggcaagcgcctcatgaagcagatcgaggagagcctgccggagtggcggagccagttcctcaactacaaggagctgaagcggcgcgtgaatgccgtgtcctccctcgggtcggcggcagatccgtcgtcgttcagcgccgtgtatgccgacttcatgacgctcctggacgccgagatcgacaaggtcaacgtccttcttcctggaacgggaag

SEQ ID NO: 43058 - DNA, 427 bp, Zea mays
  Clone ID: LIB3062-022-Q1-K1-G12
taatgcttttcctgttcaacattatttacactagagtctgtagcaacagtagctacatggataggtgtaccacagccttgctccagactctagtgtaaataatgcttttcctgttcaacatttcagtccgaggcatacacaagccatgccagactttgctcgtgtatacaacttcctgggaagcatatttgatccagagacaaatgggcatttgcagaagttgaaggaaatggatcccattgatgctgaaacggtactgttgctgatgaaaaatctgtcaatcaacctaactagtccaaactttgaggagcataggaggttgctctcttcggatgcctcaagcatggatcaaaagtcgggctcttcccgggttcatctcccgttcatgataacgagcaagtgagagaagcagctggctggcctgaag

SEQ ID NO: 43059 - DNA, 429 bp, Zea mays
  Clone ID: LIB3062-022-Q1-K1-H9
tgcaaccacagcttgagtcacagcttcaggagcctcctccatgcaagggagacgaagcgcggcctctgccaattgaggatcactctgtggttagtaccgggccacctgtgaaaaagaggcagcgaggccagcagcagagtcggcagcctaagtcaccaaagcctaagaagcctaagaaggttgctgttctgccagagggtggggcacttaatgggcatgcaccccgtaggaggggccctaagaaggctgtggggatggtgattaacggtattgagttggaccttgccaacttaccaacacctgtgtgctcatgcactggaactccccagcaatgctatcggtggggtgcaggtggctggcagtctgcatgctgcacgactgctatttcaacgtatccactgccaatgagcacaaagcgccgtggcgcac

SEQ ID NO: 43060 - DNA, 397 bp, Zea mays
  Clone ID: LIB3062-023-Q1-K1-B2
aagcgttgatgacacagctgtgaaggtggttgatattgttgacacattccgtctacaggagcagcctccttttgacaagaaatcatttgtgtcttacatcaaaaaatacatcaagaatctcactgctggggtggagccagagaaagcggatgagttcaaaaagggtgtcgagggtgcaaccaagtttctccttaacaagctgaaggaccttcaattttttgtgggtaagtccatgaaggatgatccgtcttggggatttcgccaataacaaggatgggcccactaatccaccattctctaattcttttaagggcctaaagggatccaatgcttagccttccgcgaaattaggtacccaagttggggactaaccatggaccattattatattccaaac

SEQ ID NO: 43061 - DNA, 415 bp, Zea mays
  Clone ID: LIB3062-023-Q1-K1-B5
cacggctactcccgcccgtgctctctcctttaccggcgttctcgctgccgccgccgggtcttcctcgcatccacatccgcacgtcggcggtgagaggcggtgcggcggagaacgcgatggcgtccgggacgacagcgagggagcggcgcctggtcaaggtgcgggaggagcgccgccgccgcgagtacgaccgggagcacacctaccccggatgggccaaggtactggagaacgcctgcagggatgatgaagagctccgcgccattcttggtgatagcatcggcaacccggagctcatgaagcaacggatccaggaaagggtgcgcaagaaaggcagggcccaattcaataaatccaagacaggctccattggtgcttttaaagtcagctttcgagactttaacccattgaattc

SEQ ID NO: 43062 - DNA, 279 bp, Zea mays
  Clone ID: LIB3062-023-Q1-K1-D1
tgtccttggacctctcaccacaatgcgagaaccctcgcctcggccttcttggggtctttcgctggtgctcgtccgatgttggggctctgaaagttggggctgctgggttggtgggtcggcggacgacatgaggtcttcggaggaaactttgcttggttggtaccaggcgagcggcgacgacttttcgatgtcgtctctccttcttgaaggcgcggcccagaagacctctagtttgtgtgttcgtcggcgttgtggaggctctttggtcactccgcttgg

SEQ ID NO: 43063 - DNA, 265 bp, Zea mays
  Clone ID: LIB3062-023-Q1-K1-D2
aagcgttggatctcggtgcccaagatgcctcctgacgagtgcttcatgtgctcagacaaggagtctttggctgtgggcaccgagctacttgtgtttggaatggcacacattgtcttcagatacagtatactgacaaactcttggacacgaggtgaggtgatgaattctcctcggtgtctatttgggtcagcaagcgttggggagaaggcatatgttgctggtggcactgattcttttggcaggattctcagctcagcagagctgt

SEQ ID NO: 43064 - DNA, 417 bp, Zea mays
  Clone ID: LIB3062-023-Q1-K1-D3
tatcgatccgcagaaattgcttcagttctttgcgaggtttggtgagatcgaggaaggcccgcttggtcttgacaaggtcactgggaaacccaagggatttgctctttttgtctacaagaccattgaaagtgccaagaaggctcttgaggagccacataagcattttgagggagtgatgctgcactgccagaaaggcgattgatggacccaaacccgaccaaataagaaggacctgaaggttttttcgggcctgaaccttaaattggggccaaggggttggctggtattgaacttcctatcattcttttgcccgaacctgtggtattggccaacccatggtaacttttgcacctggaatggcttcattggctggtgggatttctggttgcccaagtgtggattctggttttgggcaag

SEQ ID NO: 43065 - DNA, 344 bp, Zea mays
  Clone ID: LIB3062-023-Q1-K1-D4
tgtaaatgcctcaacagcacatgtggcacttcaccaatggcaggctaatactccagcatggtcagggaacacctatccttgtacatcatggtagaaattccacaaattcaaccagaggcgcactcatgcgcattttcaaaggatctgctggttctgcagaagattatgggttcccaagggctatagcatttgctgctactgcaatccgcatgtcagcagttgttagctgaagacatgtgacaaagacataattactggtcgacacgttgatggctcattgaagatgatatccatacatggagcgaagacaattgaaactgcttttgagcatattgattcagtga

SEQ ID NO: 43066 - DNA, 236 bp, Zea mays
  Clone ID: LIB3062-023-Q1-K1-D5
tatcgatccgcataaattgcttcagtttttcgctaggtttggtgagatcgaggaagggcgcactgggtcttgacaaggtcactgggaaacccaagggatttgctctttttgtctacaagaccattgaaagtgccaagaaggctcttgaggagccacataagcattttgagggagtgatgctgcactgccagaaggcgattgatggaccaaagccgaacaaattacgaggagctgta

SEQ ID NO: 43067 - DNA, 402 bp, Zea mays
  Clone ID: LIB3062-023-Q1-K1-G11
tgacggacgagctggctggcgtgccaacgtcgctccttcaggagctagcctacgcatcgacgacctatagtgtggcccagtaatggcgatatggcgaccagctaccaacatggaactcttcctctccatcaactaccagttcaagaatgtgggacaagagctcaccaagagcagatgaggacctggtgggcctagcaatggcagcatggcgcggtggcgacgagctgctatgtgcagctcttcctctcagtaactaccagttcacgacagtgtggtaggagttcatcaagatcggatagggatcgcaagttggacatgtttttttgtctatctacatactgtgtttggagatgtagtactttattctctacaatcggttaaccctggtgtcagcgtttcgag

SEQ ID NO: 43068 - DNA, 220 bp, Zea mays
  Clone ID: LIB3062-023-Q1-K1-G5
atgaaaattgtattctgggcttctcgagtgagcaggtcatatccttttaaccgcatcgcggtttcaggccatgtagcgatattgtttgtagtttgtaccgggaataacatatttggttgagcttctacgtattgaagaaacaacttatatgtgaaaaaaaaaaaaaaaaaaaaaaaaaataaaaaataaaaaaaaggaatgatcataaaaaatataaaaa

SEQ ID NO: 43069 - DNA, 376 bp, Zea mays
  Clone ID: LIB3062-024-Q1-K1-A11
tctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggcttcgcggggctgtcctgcgcgta

SEQ ID NO: 43070 - DNA, 450 bp, Zea mays
  Clone ID: LIB3062-024-Q1-K1-D10
tgacaatatcagagccttgcttgttgattctacagggaggtattgcctatcgggatcatcggattcaatgataagactatgggatctaggacagcagcgttgtgttcattcttatgctgtgcatactgattctgtttgggcacttgcaagcactcctgcatttggtcatgtctacagtggtggaagagatcaatctgtatacctaacagatttgtccacaagagagagtcttttactctgcacaaatgaataccctgttctacagttgtctctgcaagatgacacaatatgggtggcaacaactgattcttctgtttatggatggccagctgaagggcgcacaccccaaaaagtcttcgaaaagggtgcctcattcttagctgggaatttgtcattctcaagggcaagagcatctttagaaggatcggcacctgtccctgtatacaaaga

SEQ ID NO: 43071 - DNA, 198 bp, Zea mays
  Clone ID: LIB3062-024-Q1-K1-E2
taagcacgtcgacttctcagaagactactcacctaagctcaacgccgacgacgcctatgccactgcagaaatctttggacctgacgggaattctattgttcctcctatgggaaatccatggatctacatgtaccctaaaggcctaaaggatctccttatgatcatgaagaacaaatacggaaacccggctatctatat

SEQ ID NO: 43072 - DNA, 231 bp, Zea mays
  unsure at all n locations
  Clone ID: LIB3062-024-Q1-K1-G6
cagcgagattcagagcccgagcccgagccccagccccagaccaacgactagaaaggacaatctgcggcggaccggcccgaagtcggaggcagggcaaaaggcccgatcccccctacccgccggttgccgcgctcgtgccacggtgcgctagccccgtcgacgccggcggacagcgtgcactatgggttgctcctnctncgtgccaactagaaatactggagggctgaacac

SEQ ID NO: 43073 - DNA, 289 bp, Zea mays
  Clone ID: LIB3062-024-Q1-K1-H11
ttatttcatcttttatcagggttttggttcattttcacttgctcttgttcacattcactatttaactcaccaaaatcagcatcacacacaaatacaagctgactcacaaatacatacttttcaagatcataagcaaacctactccatataccgacctcaactagatcaacctgttcatgctcatgcacccaactcacaaatactatcacacacacctttagactctaattagttgctactaccacattgttgttgaacatgttaaaagaaaagtctataatcaatccaa

SEQ ID NO: 43074 - DNA, 188 bp, Zea mays
  Clone ID: LIB3062-024-Q1-K1-H6
tgaccgggaagccagtacctggatgggtgaatcgactcgccagattaagttccttctggaattgggtattggctgacagcattcaaggttcagcagtcagatattgtaatgccccttcctgatttttctgatgatggcttggggtccaatgcctcgatccttgagggaagtgatgacgatgatttaga

SEQ ID NO: 43075 - DNA, 332 bp, Zea mays
  Clone ID: LIB3062-025-Q1-K1-A11
tcgcgatcgaaaactagaactgtgtaccgagtcgagttggtttgccagctgtttcgaggttacagagttgagatttggaattacaatggcgccattgccctcctccaacccccctttttcttcctcccataagttgcggtcactgtccttcttggactctctggcctttgttcttgtaaatgcgaaatgaagggatgtgaaataagaacatcttcgtcctgttgttgacagtatggtacagcatatttaattttttgtacttgaccggcgatgataaattggatcggtgccagcataagaattatggaaaaaaaaaaaaaaaaagggcggcc

SEQ ID NO: 43076 - DNA, 206 bp, Zea mays
  Clone ID: LIB3062-025-Q1-K1-D12
gtgagatagacatgttttagatagtttcattggacacccaaacagagcggacagagtgtatggctgctaccttcaggatgactgaaagcagtacttgtaacgattttgtttagtaaaatttgtgagtgttactgctccaaacaacaccttatgcaaccatatttgaatatttcacaaataataaggacttaaaaaaaaaaacctga

SEQ ID NO: 43077 - DNA, 215 bp, Zea mays
  Clone ID: LIB3062-025-Q1-K1-D5
aattcccggggccagccacgcaccacctcccccaattgcctcttctcttgtcccagcagcaggcgcgacgcagtcctactcgtgcggtgcctccagttgggcagcaccgttgccacacatcgccaactaacgccatcgatcacccggcggcctcccagagtcttgccctgccatatccgaacctgctcctacagctagccagcaacacaaacaga

SEQ ID NO: 43078 - DNA, 269 bp, Zea mays
  Clone ID: LIB3062-025-Q1-K1-E2
gccatgttctccatgttcggattcttcgtccaggccatcgtcaccgggaagggccggctcgagaacctggctgaccacattgccgaccccgtcaacaacaacgcttgggcctacgccaccaacttcgtccccggcaagtgagggaggcgccgccggtgacctttaggtgtccggatgcatgtgagcgcacgctggttttcggtttgtaccatgatgtaaactattgttcaatcgacaaggaataattgtgttcattgtcattatttttc

SEQ ID NO: 43079 - DNA, 427 bp, Zea mays
  unsure at all n locations
  Clone ID: LIB3062-026-Q1-K1-B2
aagcagctcgctcgagacggcgtgcaggggaggaacgagttcttggtcgaggtgctcatgcttacagtgctcaaccatcgcaaccttgtcagcttggtcgggttctgcgcgcagggggacgagaggctgctggtctacgagtacatgccgttcggaagcctggagagccatctgtttgacgtgcctctcggcaagaaaccactcgactggaacacgcgcgtgaggatagccgtgggagtcgcggaaggggtttcctacctgcacaacgtagccgacccgcctgtgatctaccgcgacatgaaggccgncaacattctgctgggcgaggacttcagcccgaggctctccgaactccggctcgcgaaggtcgngccggttggagacaggactcacgtgtncacgagagtcatgggcacctatggctact

SEQ ID NO: 43080 - DNA, 391 bp, Zea mays
  Clone ID: LIB3062-026-Q1-K1-B7
gaataaagatataaatagagtcatctcgatgaggtggcagtggtacaggaaattaaagaagagaatagtagaaagagttcgaggcggcggcggtacgtccgcacgtagcaccggcacccaaaacgtgagtggcactgactgcactagtactactacatacacgtaggcccgggcggcccggttaaaaaacggacaagagtacaaccgtcagccgcggcatccatggacgttgagcgcgcgcggcgcaccggctgcatcttccgcgtaggagttctgtcgtcgtcacgcacgtagccgcggcatccatgctgtgccgtgcaggcgccagcgccacccgctcgcgcgcgccgtgcctaggcgagcaggccgacgaggcccagcgccagcgcgc

SEQ ID NO: 43081 - DNA, 187 bp, Zea mays
  Clone ID: LIB3062-026-Q1-K1-G11
atggtgggctcatggtttttagctccggaaatctgaaatttccgttgttccttttgcagtgaggtgatttagaagcggtgaaatgtgtatgggatgttgagtcgtcaaagaacaccggaatttaactgtggtcgtataatattatgtgctacattctatgctatggcagttagattttaaaaaatat

SEQ ID NO: 43082 - DNA, 449 bp, Zea mays
  Clone ID: LIB3062-026-Q1-K1-H8
tcggaatagtcctggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaggttcaatatgtttttgcacgcaatggcaaaccgattggaccacaggcgaattctaagtggctctacatcgccccgacggggatgtacgggtgcgtgaactacctcaaggagaagtatgggaatccaacgatctacataacggagaac

SEQ ID NO: 43083 - DNA, 293 bp, Zea mays
  Clone ID: LIB3062-027-Q1-K1-B2
cgactatgatgctcttgatgtggcctacaaaatcggcatcatctaagtgctgcatgaggcatcctagttcatctgttgtgtcctagttctatgtgaaaccagagttttgtagcttattcgctctcaatcgttccattaccatgtgttatgcacacttctgaatttgatatcatccaagtgaccttttgaactagtttgcgttctgcacttcattacacttggacaccgtcagtctttgtgaccagtaattttgtttgtcgtaatgggttggttttgcaactcgaccaataaaa

SEQ ID NO: 43084 - DNA, 413 bp, Zea mays
  Clone ID: LIB3062-027-Q1-K1-B8
tgcactattggttttacgtcaagcaatacgtagagtaactcccaatataggagtaggaacgagacgtaataaaaaaggatcgacgcggaaagttccgattgaaataggatctaaacaaggccaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcggtaatccatgaacagaatctaggtatgtagacacatggatccatacatctcgatcggaaaagaatcaatagaaggagaatcggacgatatctttttcgaaacaaataacatgat

SEQ ID NO: 43085 - DNA, 393 bp, Zea mays
  Clone ID: LIB3062-027-Q1-K1-C12
aagcaaccagaggcagagcgttcttcttcgccgacggcccgggccgacggctcgactgcactagtcgctggaaccctctgcaacaaagccgcctccacctgaccacctattgagctcttccccttcctcgtgggttgtgcgagccctctaccggcgcgcagtacaggggctgattgggtgatcaaacccgcaagatttggttttgcgatttgggagcaggaggcggtggcaatatggaatataaggcgagatctactggaacttcaggaacttcgtctaaaagtttccgtgatctgtacaatatgaagtactcgagctacttaaacgacgaaccaatgccggatgctacatcggaaaaggagcaggttgtaatactcaggctatttagtccct

SEQ ID NO: 43086 - DNA, 411 bp, Zea mays
  Clone ID: LIB3062-027-Q1-K1-C2
tagacgacttgttgcatcgattcttgaagagatcgagcttcttttgcaccacgaggttgacgatgtcttgcaactgcggatcaagctgcggttgcagctcaagctgcaagtgcggccaagaagtaccctgacctggaggagacgagcaccgtcgcgcaagccaacgtcgtcctcggcgtggcccctgagaagaacgacgcgcccgagttcgtcgaggtcgcggcggagttcgaccaggccgcccacggctgcaactgcagcggcaactgcaagtgcaacccctgcaactggtgatcacatcgatcgactaccatggatatgattattatctatctagcttgtgcgaggcgttgaacaataataagcgaggccgagctggctgccatacataagtattgtgaggtgtgtgtg

SEQ ID NO: 43087 - DNA, 323 bp, Zea mays
  Clone ID: LIB3062-027-Q1-K1-C9
tccggattcccgggtcagaacaactgcattgcacagcaagatcatgctggcgcttcttcccaaagctaatgccaagtgaagggtagggctatcatcatccccaataatggcttacgtacctaaataaacgaccttgcatgcatgcaccaactgtgagagttaattgtgcaataattaacggccggcatgtctgtacgactacgcgtcttggttgcaataataaacctctagttttgtacgtgtaatattaaaccactttccacgcaccttacacgtaaattcatgtcagactggatttctcctattactgagtactgccacta

SEQ ID NO: 43088 - DNA, 297 bp, Zea mays
  Clone ID: LIB3062-027-Q1-K1-G4
ggagaagccaagatacacaccgttgtatatcatagatagccttttagtgtgctgtttccaaggacaagggtacacaagctgtacattacattacagtcaggagttcttgaccaaacgatagacgagtaattttcgacagatttaaagcaccgtggatcccagaagatactcatggctatatcatgccctcttgaacataacaactaggatgaccgctatggccagagccatgaaggatccgccgacagccatattttgcgtaaaaaggccctttttaactggtgaaagggccggccc

SEQ ID NO: 43089 - DNA, 416 bp, Zea mays
  Clone ID: LIB3062-028-Q1-K1-F11
aagttaggggtacaatccagaattgagatgcccatggaaggatggggtgagatccgggtcatcaatgagcatgtccgtcagtctgttctggcaagtctgtacaaagctgcaaatgcatttgtgctgccaacccgtggtgagggctggggcagaccggtggttgaagcaatggccatggaactgcctgtgattgtgactaattggtcaggtccaacagagtacctgactgaggagaatgggtatccattggatgtagacaggctgactgaggtgacggaagggccattcaagggccacctatgtgctgagccatcagttgctcggctgagggatttaatgagacatgtcgttgatgatagagatgaggcaaggaataaggggaagaaggcaagggaggacatgataaagaggttctc

SEQ ID NO: 43090 - DNA, 440 bp, Zea mays
  Clone ID: LIB3062-028-Q1-K1-G6
tgaatctgatgacagtactgatttggatcttctattggctgagggtgagggagcagggaatttgaagaagaaaagggggccaagaaggggggatgatttcacattccttgaagccctagtaaaggcggacttctggctactgtttgttgtttacttttgtggagttggcacaggggtcactgttctcaataacctggcgcagattggaatgtctgttggtgctaatgacacaactattttgttgtgcctctttggcttctgcaactttgctggtcgtatccttggtggatctgtctctgaatatttcgtaaggtcaaggatgctccctcgtcctttctggatgatgtgcacacaaataatcatggtggtaacgttcctgctcttcgcgactggtcttcatagcttgatttatgtttcaactactctcctggggatatgct

SEQ ID NO: 43091 - DNA, 347 bp, Zea mays
  Clone ID: LIB3062-028-Q1-K1-H6
tgaaaatatcgcacttggcaatattataaatgatgaggtacctataccatctaatctgatgatgacactgatggaagctatcggctatgttattccttggccaactacacatgtgaagcaagctagaagctcatcttgtacccgacacgagttggtacctgctgcacgtggacaaagctagatggtaagcctaacataattgctacgcggatcaattagattctagtagacactaacacaataacgtgatatttgtatgacattgccactttgactatgcttcgttgtgaacacaactggcagatactgaacatgtatgctatctagtctgacagcaccgtgaaatt

SEQ ID NO: 43092 - DNA, 254 bp, Zea mays
  Clone ID: LIB3062-029-Q1-K1-C3
ttgtcaaagtattttctggtaaaatgtatcaacaaagctaaaaggcaaaggactatgttctgtcttcgatagacctgcagtataaacttgaatgtttttgtgtgttctacagcttacagctaagtcggcaataggaataaaggtcgaaatcttgtttaacctgccctattagcaaatatacattccattgtggaccatgggctgtacaatggaatgtatatttgctaatagggcaggtttaacattccattgtg

SEQ ID NO: 43093 - DNA, 75 bp, Zea mays
  Clone ID: LIB3062-030-Q1-K1-C10
ttacacaccacctcactcccactctatatctctaccatagggtctcctaaattcagttggctttccttcttttgg

SEQ ID NO: 43094 - DNA, 240 bp, Zea mays
  Clone ID: LIB3062-030-Q1-K1-D3
acgctcctcatccttgtagagggtttcggcatgggttctttcagattacttttgatccaggtcgggttcccttgggccgaaggccatccattttctacgcgctttgtactctaggccgtgtgtgtttggtaaatgtacataacctgtacatttctacatgttatgaattgactttcttgcacaataaaattttgtagaatggtttaaacaccaatactgagttctatggctcatgcttac

SEQ ID NO: 43095 - DNA, 300 bp, Zea mays
  Clone ID: LIB3062-030-Q1-K1-F4
tttgtttttttttttttttgtttgttggtttaagtgggcgggaaagtgattttaggcagttattgttgttatggaaataagtgccacgcaatgatcaagcctctggaggtgtcattcttcttaataagtgacacgcaatgctcaagccgctggaggcagatttgtatttgcatttgtagtgtgtgtgtgtgtctatatatgctacctgtggtgtatataccgcctgtgctgcaatgttcggttgagactttagacaactatactttatgaatgatttacatggttctgctcaattatgtg

SEQ ID NO: 43096 - DNA, 396 bp, Zea mays
  Clone ID: LIB3062-031-Q1-K1-A9
tgtgcttttcctccgccagattcggtgctcaaggcgctgaacttgggctccccgaagagcggcgacgcggcgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctgcctctctagcagcatctgctactggctgcagctgccgtcggcgtcgtggtctgtctgtcaaagtcgaagtaaaaaaacgtgagtagttgtactactgtagaaggttcttttgtatagcatgcacgtaagacatgaccaagaaatataacaagaatgcagctgatagtttact

SEQ ID NO: 43097 - DNA, 276 bp, Zea mays
  Clone ID: LIB3062-031-Q1-K1-D6
gccacttcaatcacttacatcgaagtggccttgctacagaggatacggtcgtacagatgtttgggtagtgccgactgcggacaagcaaacagctattatgcaattgcaaactgtgtgtaagctctgcagtggtaaatagcatcccactttgctcgttgtactgttaagctagcagttgtgtgctagctagtatatcgggtaagtatgtgaagaagctattgcattggagcctaccatatgttaaacttcgcatgatcctatattcacataaaagct

SEQ ID NO: 43098 - DNA, 458 bp, Zea mays
  Clone ID: LIB3062-031-Q1-K1-G6
tacaactcaaccatggaaggcctcagccacttcagtatgctgtcaacgcagctttccgtgcttgtctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatc

SEQ ID NO: 43099 - DNA, 209 bp, Zea mays
  Clone ID: LIB3062-032-Q1-K1-C9
ggcagatccatcatcagggtaattgtctctaccgcatggcctttagactaatacgaaagtgatcttactgatctttcgtttcaaatctaaaacgattaaataaaatgtgatttgcaccttgccatgtactctaaaaaaaaaaaaaaaaccaaaaacaacaatacaaatataatacaaaaacatcaacaacaactacataccataacaaa

SEQ ID NO: 43100 - DNA, 303 bp, Zea mays
  Clone ID: LIB3062-032-Q1-K1-G1
aattcccgttctgcgggggttgaggagtggtccaaatggaaggagaggcgttggttacgctgccgctgctgctgggacgacgcattggcaggggttgattgggtggtccttgggtgtaatcacacggtggcacgacaggtgccctcttgtcccccccccgtccccgtgaacggacctaagttttattggagcctagcatgaaccgcattgaatcggaccatgcatcctgcctgcattggaccacggtcgttgtaaatgagatgcttcaccggattattatttttggctgccattttacaagta

SEQ ID NO: 43101 - DNA, 445 bp, Zea mays
  Clone ID: LIB3062-033-Q1-K1-C5
cacagctgctgacggcgcctactgcggcggcggagacaacggtgaaagttagcacgacccgtatcttccccgagatcccacaaggccaggcgagaaaggacttccaagtgctggtgcgcgtcgaggcgccggcgcgtccagaggcgcgcatccccatcgacgtcgtcgccgtcctcgatgtcagcggcagcatgaacgacccggcggcagcgccgacggagagaacgagaacgacgtcgaggctggacctgctgaagacggccgccaagttcatggtcgcgaaactcgaggacggagaccgcctctccatcgtcgcgttcagcgatcggccagtcagagaactgagctccggcttgctgtacatgactgctgacggccggaggaacgccattaggagcttggaccagctggaggcccgcggcggcactgcgctcgtgccggcctt

SEQ ID NO: 43102 - DNA, 377 bp, Zea mays
  Clone ID: LIB3062-033-Q1-K1-F3
acgcggagccagacggcggcttccccttcttgtgagatccttcggcgactccggagaccggatgcagggcaacgcaaactgtgtatagttcacattttcttcatggaaccaacaacaacgaataaaaagttcttgctaatatcttgttctagtggtgtagtgcagaagtagcagcaggcatgattgaagttccattgtagtactgatgttcatcggcacttgatctgtgacaagtgacggcattctttcgtatcttggctgcaaattcttcgttgtccagaatataatttcagatgggtaatgccaattcgggccgtgttaaaaagaaaaaacacatacattctagataaacaaacacgaacaatgagcagacacaa

SEQ ID NO: 43103 - DNA, 454 bp, Zea mays
  Clone ID: LIB3062-033-Q1-K1-F8
aaggagtcgtcaaggatgctggtggaagcaaggttgcaacattgacggggaagtgggatggaagtgtgcattgtgtcatcaacaatgatgcctctaaggtgaactctcatggtccacatcagagttctggttccactttgctatgggagaaaaatgagcctccagtcaatcctacccgctacaacttgtccgcatttgcaataacactaaatgagttaacaccagagctcgaggtacacatggaacatacatatatcccataatctgagttctgttagctcttaacctaaaaggctacgacacatcttttacgctcttgttaaggagaagctgccaccgacggattcaaggctgagaccagatcaacggcacctggagaatggggagtacgagaaggccaatgctgaaaaactgcgcctcgagacacagcaacggatggttgtacacattttac

SEQ ID NO: 43104 - DNA, 452 bp, Zea mays
  Clone ID: LIB3062-034-Q1-K1-E7
tattcatggacaatttcatgatcttgctgaactctttcgaattggtggaaagtgtccagaggcgagcgtacctgtttatgggagattatgttgaccgtggttactactctgtcgaaactgtcacacttttggtgtctttaaaagttcgatatcctcagaggatcaccattctcagaggaaaccatgaaagccgacagattactcaagtttatgggttctatgacgaatgcttaaggaagtatggaaacgcaaatgtctggaaaacatttacagatctatttgattacttccccttgactgcattggtcgagtcagaaatattttgtttgcatggtggattatcgccatccattgagaccctcgacaacatccgcaacttcgaccgtgtccaaaaagttcctcatgaaggtccaatgtgtgatcttctgtggtctgatccagatgatcgatgt

SEQ ID NO: 43105 - DNA, 278 bp, Zea mays
  Clone ID: LIB3062-034-Q1-K1-F5
gctgacgttgtgggaaggggctgggacgctctgttgttgccttatgttatgtggcggcggcggcgtggaaccgcactaataatgtggaccggaacctctgttaccgtcgtttgtgctgtcgcgtgctaggtttatgctgaagtggattcctttactccgcacaccgaactgtgtctgttgtacatcacgccgtgacgccggtggtctcgtctgtctgacttcgttacatggatcgtctagtagtaacggaatgcagtaccacgtgaaaaaaaaaatta

SEQ ID NO: 43106 - DNA, 422 bp, Zea mays
  Clone ID: LIB3062-034-Q1-K1-G6
ttcaaagcagcgtctgacgatctgatgatgctgaagaatgcaagccttgaagagatccagggaattgagcggttgaaagaagaaagagacaacatgcttcagcaaaatcagcaaatgcaacgtgaattggatgtgcttcggaggcgcaggagccgcaaaggcgatgcaagtttctccctgacgttcgccgcgtttgctgggctaataggtctcatggtggggctcctgatgagcctcatcttctcgtccgcgccggctgatgcgtagtaagatgcacgaaaaggttgcagccaacggaagcgttgttgagttgagaccgacgtgggggaaaaggctcgctcgggggaagaagaagatgaaatttctgctctagtctccatttttctttcttttggctgttgcattctaagtattattatacg

SEQ ID NO: 43107 - DNA, 433 bp, Zea mays
  unsure at all n locations
  Clone ID: LIB3062-035-Q1-K1-C7
tgaagttgaactcattggatttgatgatgttaaagagggtaaatcccgaagtgacatgacggttgaagagaggattgcagctgcagacaggagaaagattgagggcaatgcatatttcaaagaaaagaagcttgaggaggccatgcagcaatatgaaatggcgattgcatacatgggagatgatttcatgtttcaattatttggaaagtacagagacatggccttggctgtgaaaaatccatgccatctcaatatggctgcatgcctgatcaaactaaagagattcgatgaagctattgcgcagtgtagcattgttttgacagaagatgaaagtaatgtcaaagcgctgttcangcgaggaaaagctaaatctgaacttggccagacagaatcagcgaggggaagatttcctcaaagcgaagaagtacttccc

SEQ ID NO: 43108 - DNA, 407 bp, Zea mays
  Clone ID: LIB3062-035-Q1-K1-E7
gcgcaccagaaggcgctcgagcgcctccagcatcaggagctcgccgctgccgacaccgggggcgagtgatccgcgcgtgtgaggtcctctcgaactctcggctgcctctgatttggttccaataagatggccacaatgtgcggtcctgaatgttctggacttctggtattgatggaacacgagctgaacactatgctgctggtttttctgttctgacttcaaatttgcccggtgatgatggcgaatgtcctgaatattctgaatattttgaaatgtttgactgttgtattatcatcttatccttgcgttgcactaccgcatgagcacaatttaggattatactttgctatcaaaaaaaaagatgtcaagcagatctgcaatataatactttctctacacatagcctg

SEQ ID NO: 43109 - DNA, 451 bp, Zea mays
  unsure at all n locations
  Clone ID: LIB3062-035-Q1-K1-F1
tctcaaggccacgtatggactgttcagtgatgatggagttctgaaactcccttactgcattgggagtgtcaggattcgtctgtgctcttttcgccattggaatcccttatttatctgccctcaggatttggttggggttctccacgcttttcagcctcatgtatattgtgatagcagttgtgctgtcgtcgagagatgggataaccgcacctgcaagggattacagcatccccaaatcatcgcagtcaactcgagtcttcactacgataggttccatagcagaccttgtgtttgcttacaacaccggcatgctgccagaaattcaggcaaccatcaggcctnctgtggtgaagaacatggagaaagctctatggttccagttcaccattggctccttgcctctctatgctgtagttnttgtgggttactgggcttatgggtcctcaacatc

SEQ ID NO: 43110 - DNA, 439 bp, Zea mays
  Clone ID: LIB3062-035-Q1-K1-F5
tacagaaaataaacctgtgtaggttttggctgcattggagaggattgaacagcaagcggaggtgacctatgatcaattgctaatgctggaggctaatctattttttggcgcctttgcctactatgatcggcatagagacatgcggatggatattgatgatatgtcctatgaggaattattggccctggacgagagaataggctctgtgagcacagctctttcagaggagcagttcacataatgcctcacaagaagcatatatcgtcaggtcgctctagaagtgaacacatcaaccgttgatgacatgaaatgcagcatctgtcaggaagagtacgcggagggcgaacaggcttggaggctgccatgcgagcaccggtaccatgtgtgctgcataggccaatggcttgggcagaagaactggtgtacagtatgcaaagcg

SEQ ID NO: 43111 - DNA, 455 bp, Zea mays
  Clone ID: LIB3062-035-Q1-K1-G5
tctgttacaagcttggtggctaacatcaaaggggagaacaggtttgcagaggtcaaggcagggaaggccgatgttcaggcagaaattcacagaggaaagaagcatttctatggtgatgacttggatgcagaggaagggaggcgcagtaaacattcagcacccgctatcgacactgatcaccttgtgcgggagatgatggacaaggtcttgttgtgcaatggcgagacatgttcaaaaggcgtcaaggaactccgtgaagccctgcagcatgacgtggcaaagaattcacacggggttcatggaaaagggtccggacatggcaagggccgtggcaagaaacagccgaagaaggaggtggttgacttggagactctcctcgtccactgtgctcagtctgtggccaccgatgatcgacgtggtgcaactgagctcctgaagcagatcagacagcatgc

SEQ ID NO: 43112 - DNA, 334 bp, Zea mays
  Clone ID: LIB3062-036-Q1-K1-A1
acggtcgtgcctgatgatactacatatgacatactccctcggaccaataatagttgattttccacgtgccaggattgcttgctccttggtcaagcctccagtctgacacagtgtattaccaaccagagggaatacgagttagcttgaaacttttggaagcaagtcctgcagatgctgaaaatcatgtttcaattctgccagtaaagtatgaagaaccttaacatgcgattcagcacattgaaatttaggaaacttgcactgtaaatgaagtgaactccttgtcagttataatttttcctttccaatatatctctacccctttaaagcacaaaaa

SEQ ID NO: 43113 - DNA, 440 bp, Zea mays
  Clone ID: LIB3062-036-Q1-K1-A12
tgtctgtcttggtggctgattgcaacggtcatggcaaccacgtctcaccggatacccgtgcggctgctatgcctgggcagtgctggtgacctactccttcgaagcaggcagcttggaccacgagctggacatcacgtgctgcgactgacggtacaaggtccttgacaacagacagctgctgacgctgacgctagaccgcacatacggctccaggttccaatccctgcacgagtacctgttcagcaagatcgacatgcagctgcagctggtagccgatcaactacgacggcaccgtcaccgactactaccatgatgtgcaaagccagacgcacgacgagatcgacttcgagttcatgggcaacttgtccggcgaaccctacacgctgcacaccaacatattcacgcggggacatgggcatcatgagcagcagttccgactc

SEQ ID NO: 43114 - DNA, 338 bp, Zea mays
  Clone ID: LIB3062-036-Q1-K1-E10
ttattttcttggaaaatgaattgctttatggagaatctttcccagtttctgctgaagtgctggattctagtttttgcctaccgattggcaaagctaagatagaacgtgggggtaaagatgttaccattactgcattctccaagatggttggctatgctctccaggctgcagagatactgtccaaggaaggaatcagtgctgaggtgatcaaccttcgatcgatcagaccacttgatagagctgctattaatgcatctgtcaggaaaaccaaccgattggtgactgttgaaaaagggttccttcaccttggaatggttcccaaaatatccatgtctgtt

SEQ ID NO: 43115 - DNA, 409 bp, Zea mays
  Clone ID: LIB3062-036-Q1-K1-G6
gtatgtatctgtggtagctcattcggggtgctagtagccggcatatacagacgctgtgaacatgaacgtatctcgttacaatttacatgttctttctaatcacttgattcagaacagtaaaaagatggaaatgaagaaaaggttccgtcactgcacggagaatagaagaggtttgacctctatactaggtggaaatagaatggaaggaagaggggtggtaaacagtaacaggctactctacctatacaaccacagagacgtctctctctgatgttgcgtgagcgcgcggcgccgtctctcaacgaaactactcgctgcccactgctgccgtcggcattcgtgccgtgccgtccagctcgcgcctatcacatgactctgcatgagttggggttctcgacgtcgaatatgc

SEQ ID NO: 43116 - DNA, 409 bp, Zea mays
  Clone ID: LIB3062-037-Q1-K1-C8
tttcaacctctctccctcggcctcgccggctgcacagcgcagcgcagcgcttccactgttgggtgtggtggatttcctgcggccccgaacgatcgatcttttgcatggcagcagcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcgcggggagccccgacaagtactggagcccccaccccaagaccggcgtgttcggcccggcggcggtggacaccaaccagctgggcgtcgccgctgacgctgccgccgcgaatgcggctgcagcaggaggcacggt

SEQ ID NO: 43117 - DNA, 451 bp, Zea mays
  unsure at all n locations
  Clone ID: LIB3062-037-Q1-K1-D6
taaacaaatacaacgagattagatcagtgatggcaatgaaatttgttgcttgcttcttgggagttgtcctggtttgggaagttccaggtgtctttgacatagtatggagcccattcacattccttctaggctataccgatccttctaaaccagatcttccccggttgcatgaatggcaattccgatctggactggatcgctacatttggattgtggggatgatatatgcatattaccatccaactgttgagaagtggttggagaagctggaagaaactgaaatgagaaccaaactctatattaagacctcaatagttacagtgtcaatgatggctggttatttgtggtatgaatacatttataagctggataagattacttacaacaagttgcatccatatacatnctggatccccataacttgctacatatgcctacgcaacttcactca

SEQ ID NO: 43118 - DNA, 460 bp, Zea mays
  unsure at all n locations
  Clone ID: LIB3062-037-Q1-K1-E3
tccaggtgcatcggctcgtggtcaaccgggaccccaagttcaccaacttcgtcgagggccgtgcgcacaaagttatctataggagatatgcaggactttttttctctatatgtgtggacatcaccgacaacgaattggcatacttggaatgtatccatctgtttgtcgagatattggaccatttcttcagcaatgtgtgtgaacttgatttagtatttaatttccacaaggtaactttatgcttcactacgctaatctagcaatctgcaataattcaatactttntatcttttcacatcttgtatttaaactttaaagagcagtttccaactaaatattctctttatcaacatgttctttggtaaccaaatttgcatatattgagctagtgttagttggtactgtattctggctaagacttanaaaagactgctggcatngattgtgttaatcatgtact

SEQ ID NO: 43119 - DNA, 407 bp, Zea mays
  Clone ID: LIB3062-037-Q1-K1-H10
tgtattgccacttgaacctaaaggtggccaactgcctttgttcagcagtggtgattggatggcagacattgattctggatatgaggcagcagaaattgcagcttctactcaaacctcttcgggtgtcacaccatatctgtgttctgctggaagtgtttttggcagttcatggatgctggttaatcatgaccaatcagatggaccatcaacttctgctggtacatcatcgcagcagaaagttgtacctcaaagcgagcatcagcggaatttaaaccgccttccagatctgcaggaaattccagagtcaaaaaacctttttgctgaccttgttccttctggggataataagtccaagaaaacttcagtaccattcaaaggaccagatcataggaacaatgagttgcaaa

SEQ ID NO: 43120 - DNA, 448 bp, Zea mays
  unsure at all n locations
  Clone ID: LIB3062-037-Q1-K1-H2
tgaacatgctgggacttgcaaagagagttggagctaggattttgttgacatcaacatctggggtttatggtgatccacttgagcatcctcaaaccgaggcctactggggcaatgttaacccaattggagtcaggagttgttatgatgagggtaagcgtgtagcagagacgctgatgttcgactatcacaggcagcatggcattgaaatccgaattgccaggattttcaacacctatgggccaaggatgaacattgacgatggccgtgttgttagcaacttcattgctcaagctgtgcgtggcgaaccccttactgtccagaaaccaggaacacagactaggagcttctgctatgtcgccgatatggttgatggtcttattaggctgatgaacggaaacaacactggaccgattaacttnggggacccangtgaattcaccatgctgga

SEQ ID NO: 43121 - DNA, 251 bp, Zea mays
  Clone ID: LIB3062-038-Q1-K1-A1
ttttgttttttttaatttattttttttagttttttttttggaccggaaaaccaaatgctctgagctgtgaagcaagtcatcaatttacaacgagcgagctagctagcagcactccaccatatgaatgattaacatcacgcacgcgcatgcatgttgatgagtaataaatcataagcgctatttcactagctagattcactctcttttcctacgtggatagaaaatctaggaaaaacgagaatagctagcga

SEQ ID NO: 43122 - DNA, 363 bp, Zea mays
  Clone ID: LIB3062-038-Q1-K1-C2
tgctgttagaaagggagaacgcttagttccccctgtttcatttgacttgttcatgagagccgcatgggctgtttctaatgctcgagtgaaggctacagaaaggtttgaagcagcctacccaatgatcaaggagttggctcttgccggtcctcctggctcaaaaactgtgaaacaagcatcacaacagcttttacctttgtgtgcaaaagcaatgcaagaaaacaacgcagagctcaccagggaggctgttgatgttttcatttggtgcttaactcaaaatgcagagtcgtacaagcagtgggaaagaatttatcttgaaaatattgaaaccagtgttgctgtcctgagcaaagttgtgattga

SEQ ID NO: 43123 - DNA, 423 bp, Zea mays
  unsure at all n locations
  Clone ID: LIB3062-038-Q1-K1-C5
tcacgacatcaacctgtccccatccatctcgcccgcgacgtttgatggagtctctgctcgggtcgcgatccattaggtgttccttctccgccgtcgccagcatcaggggcgccgcttcccccaggccctcgcgcgtcgccaccctcgccagcgcctgcgccggcgcccgctcccgcgcgctccgtgctggccacacggactcaatccttgaggtgctggcacaggacgatatgctgaacgcataggagctggtccaatgggagaatggcttgtcattcaatgacatagcgggctaggcagggngattcgcatccgcagacactgccgccccactgccctcttgaaggagatagaggaggagcctggagccccccttacatcctagagangatcatttgggacaaggagattgaagtagctgag

SEQ ID NO: 43124 - DNA, 440 bp, Zea mays
  Clone ID: LIB3062-038-Q1-K1-E6
tgcaagaccagcggatctagtatttgcagagggtgtgttgtttgcatctctagatgtgtgcgatgtgggagatgtatcgacagtgagtttgaatttgaagagacattttttctggggagcatttgccgtgactgtgtcaagtattcaccccaccacagaaaaatagatgtttgattctgttatccattggatggatacagttgtaacattggatttctgtgattgatgctcccatccatcatacatcttgactgagtatttctaacaaggaaaaaaaagagagaaaggtctaccagtttgctatcggtgtaagtgcagcagctgatatattgtttttgcttgcaagaaaaacgaaaaaaaacagtataacctaggaaatcagaagatcaaagtatggttttcctatcatggtgtcagcagtgaatggtgacaactgacaa

SEQ ID NO: 43125 - DNA, 447 bp, Zea mays
  Clone ID: LIB3062-038-Q1-K1-F8
tgcgtgcgttggaagctaatccgacaaaccttgaagttcttcttgctcttggtgttagtcagacaaatgaattggagcagggagaagcattaaggtatctttataggtggcttcagaatcatccaaaatatggtggccttgtccctccgcagtcaactgattcaccttatggtcctgatgttgttagattgtttaatgacgctgctcagatgtcacctgaagatgcagatgttcatgtagttctgggagtcttatacaacctatcaagagagtatgatcaagctataacttcatttaagacagcagtacagctcaaaccacaagactactcactctggaacaagcttggtgcaacccaagcaaacagcatccagagtgctgatgcaatattggcgtatcagcaggcactagacttgaaacccaactacgtgcgtgcatgggcgaaca

SEQ ID NO: 43126 - DNA, 398 bp, Zea mays
  Clone ID: LIB3062-039-Q1-K1-B4
tgcagttgcagctgagagtaccatcacattgtgggatcctgataataatgcgcttgttggtggcattgcagaaacgctagcgccagtgacaaatctttctttcgttgtgacatcagtgtttttgatgtctctatgtccgagttcaataccacagattgctctatggaatgcttcaaatattttcatgcaatgctcttacaacatttatacataatcttcatgcttgtcttcacatgcgtgtcaatttgcactttttactccaattatactatcatacttaatatcatcaacacaacttgctagtcatatgacattttttaaccccttcagcacatccatgattgtcttctacttgcattataaaatatctttctggactatgctggttatctaaagag

SEQ ID NO: 43127 - DNA, 283 bp, Zea mays
  Clone ID: LIB3062-040-Q1-K1-C4
ttctttctaatctcaaatacactgctaggagtgatgcataggcgaagaattctgctaatggatattaatgctgcacataatagaccttatgtagctacaacagatgtcattaactgtcttttacatagaatcaaatagtacttggagagcaaaggcgtcaacattaagtcgataaatactatagatgtagagcaaggtattatctgtatggttaaacaaggccaacacatatgcctgcaggtattattaagaatactgatcatcttgtacgatatcatactta

SEQ ID NO: 43128 - DNA, 337 bp, Zea mays
  Clone ID: LIB3062-040-Q1-K1-F6
tttctttttccgcccttccgtgtggcagaggacaagtttgcttggctgcgggacgacgagggcgcgaggcaggcgctggctggcatcaaccccgtcaacatcgaacgtcttcaggcgttcccgccgatgagcaagctggacccggccgtgtacggcccgccggagtcggccatcacggaggagcacatcatcgggcagctcgacggcatgtcggtgcagcaggcgctgcaggacgacaggctgtacatgctggactaccacgacatcttcatgccgttcctggaccggatcaacgcgcaggacggggcggaaggcctacggcacgcgcacgctcttc

SEQ ID NO: 43129 - DNA, 199 bp, Zea mays
  Clone ID: LIB3062-040-Q1-K1-G6
tatgcatactaactaacgaacacttgcgcttatcacgaactagctgtggttatcgagtgctgtttctctgaacagcgagaagtctcctcaggctatggtctccatgcatctttcgccggcaaatcagggctatctgatcctgaactatctaacaagctgctcattggctactacccttatcaaggaggggaacaagaca

SEQ ID NO: 43130 - DNA, 439 bp, Zea mays
  Clone ID: LIB3062-040-Q1-K1-G7
agaatcttctgtgttgagtttttgagagagatccggagtcaacacgatgaaattgaggccaagtttttttgaagaacgagctgcccttgaggcaaagtaccagaagctttatgaacctttatacacaaagaggtatggaattgtaaatggagaagtggaggtagatggtgtttgtgatgaaccggccagtgagaatactgttgagggaaaagaaccagacgctaaaggagttccagacttttggcttactgccatgaaaacaaacgaggttttgtctgaggagatacaagagcgcgatgaagccgctttgaaatatctaaaagatatcaagtggtctagaatcgaggatcctaagggtttcaagctggattttttctttgatacaaacccattcttcaagaattctgtcctgacaaaaacgtaccacatggttgatgaa

SEQ ID NO: 43131 - DNA, 465 bp, Zea mays
  Clone ID: LIB3062-040-Q1-K1-H7
tccacactaacgaacgaactcttgctccgatcacgagctagctgaggtcgacgatggcggctgtgctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctgcgtcggattccccatcagcatgtccaccgactgcaacaagatcagctaagttacgacgaccaagctaataagcctaccgaacgtacacg

SEQ ID NO: 43132 - DNA, 411 bp, Zea mays
  Clone ID: LIB3062-041-Q1-K1-A5
taaaaaaaaaaaaaaaaaaaaaaaaaaaaaaaaaaaaaaaaaaaaaaaaaaaaaaaagaaaagaaaaaaaaaaaaaaaaagaaaaaaaaaaaaaaacccaaaaaaaaaaaaaaaaaaaaagggccgccctttttaaagatcccaactttacttccccttccttccaactttaaaccttttctatagtgcccccaaattcaatttaattgcccttcttttaaaaccttctaacctggaaaacccttggcttacccaacttaattccctttgaaaaaattccccttttcccaagttgccttattaccaaaaagcccccacccaaccgcctttccaaaaatttgccaaccctaattgccaattggacccccccttttaccggcccttaaaccccgtcggttttggggttacccc

SEQ ID NO: 43133 - DNA, 440 bp, Zea mays
  Clone ID: LIB3062-041-Q1-K1-B12
ggcggctctagaagacgatgggcaaggacgacgtgatcgagagcggcgctggcggcggcgaggtcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgcc

SEQ ID NO: 43134 - DNA, 139 bp, Zea mays
  Clone ID: LIB3062-041-Q1-K1-B5
tcacagttttgaccaatgtattagtattattttaccattgtgtattaaaatagatcgggaggatttttgtacatcacagctgcagtcatcttgtgtccatattattaatatattgctatgtcttagtttggcaaaaata

SEQ ID NO: 43135 - DNA, 431 bp, Zea mays
  Clone ID: LIB3062-041-Q1-K1-B8
gtacggaagggcaagaaaacaggaattcctgcacagacaaatgatccaaggaggaacccggaacatcctcgcaagtcgcctttgcatgcaacggcctacaaaaccgatcctcaagaccaaggtccaaggaacccaccacatcgaccgagacctgaaactgatcaacaaagacactccgaccggcctactcaccgtgagcctgcaccacgaagacatgcaaatcctcagagagaacaagggagtaatgctgtggcaccaagaagcccctacaggacagctgctgggtctgcttcgccaatgcagtcaaacaaccaatcaaagccgaatcatagatcgactgcgatgcaggctccagagagaaggcattcttcagaggggcatagccagcatacacctggaaggagtaggatgaagcccggtagttatgagcc

SEQ ID NO: 43136 - DNA, 471 bp, Zea mays
  unsure at all n locations
  Clone ID: LIB3062-042-Q1-K1-D1
tccaaatgctgctctaacacggagacacgtgaattcaataaagcaaacttgcaagtcatctggtttggtaaagaggagggggtaccatttggacacatcaccttacaggcctatgctgatcatgattgtcctcctgctggtggctatccttttcggggcactgtataccaagtgatgcacttgtagctggcctttttcccctatggagacgagacaaactctgccaatctgatccttttcgtactctgtagtccccaatggctgcaggaagttcgaaattactggctgtagaagtgtagatcatacggcagcatgctactgcttccatgactccgttactgctctcgattcgtttcttcattatgttttctcgcgcgttgtatcgtttgaagctgttttaagcaacggaaaanaataccatgtgacacgtgtatcctacgaacatgggtttctgtttagttagcagtgggc

SEQ ID NO: 43137 - DNA, 377 bp, Zea mays
  unsure at all n locations
  Clone ID: LIB3062-042-Q1-K1-G2
aagccgaggtcgagctgttcacggcagcgagcatgcaccacgatcccaaccccttcgacgagggcgccgacgagaaccccttctcgaatggaggcggaggagcgcgtggcggaggcgtcaagccgcagtacgggttccggccgacggagcccgcggggttcggcggcggcaggggcgatgcgaccaccgacatccctctggacaccatgaacgattcgaagggcaaggcgaaggagctgtctcagtgggagtcagatctcaggaggagggagtcggatatcaggaggagggaggaagctctcaagagcgctggggtgcccatggaggacaagaactggccgnctttcttcccaatcatccaccatgatattgccaat

SEQ ID NO: 43138 - DNA, 438 bp, Zea mays
  Clone ID: LIB3062-043-Q1-K1-C7
ttttgtaatggacaaaaaagtattcattattataatttagaaacctgtgccagattaaaagcgacacaagacgaaaacagagagccagcaaagcaaacccaaggacattgaggtgctgctctgctagcgtacgtgctacagcatgtcacgtaaggtacacgacgacgacgacgacattgaacggagggacactagacgaagtgatcactagtgggtgcatgatctacttctttattatgtgccagtctgatgcatgacacacacgtagctaggacatctctgctacgacgacgactgcatgctgctgatggccacgtacgctgccatccaacgagcgagctacctccactatggttccatcgatcagttgatcttggtgcagtcgacggtggggctgatgggcacgccgacggagacgccgcacttgccggggatgtt

SEQ ID NO: 43139 - DNA, 395 bp, Zea mays
  Clone ID: LIB3062-043-Q1-K1-D1
ttgaggttagaagaggagctagagcgagagagtcccatcgcaacacacaaaaggaagaggaagaggaagaggaaggcgagaacgatgggcttgctcctgctgctcctcgtcgcggcggcggcgacagctcctgcggccgacgcatggggcaaggaggggcactacatggtgtgcaagatcgctgagagctttctgacgaaagaggcctcgacggcggtgaaggagctgctgccggggtgggccggcggcgagctcgcggagacgtgctcttgggcggacacgcagaggttccggtaccgctggtccagcccgctgcacttcgccgacacgccaggggactgcgagttcgactacgcccgggactgccacaacaccaaaagggagaagaacatgtg

SEQ ID NO: 43140 - DNA, 441 bp, Zea mays
  Clone ID: LIB3062-043-Q1-K1-F6
ttttgatctagcttccacaggatgaagccctacttacagattggaagcagcagttggaagcggctcgcacggcaggtggatctcagcgctaggcaggtggaagcgtggttccagaacacacatgttcagataacacacatgttcatgctcatgctgaccccacacagaatgaatacttcttcaggtacagggatgaccggaatgcagcagaattttttagagctaatggtgatataaatggacttaaatcacactgtaatagtcagttaatatgcatgccactactttgttaaagcgaagatgcatgccacttcttctagagcaagtgaatgggggtatgagttggatgttttaggtctctgtttgatgtgggatggagaccatcagaagagatttgatcaccatcgaggtatggaggggaagcagtaggagttcccgggg

SEQ ID NO: 43141 - DNA, 260 bp, Zea mays
  Clone ID: LIB3062-043-Q1-K1-G12
tggatccccccgtctgcatgaattcggcacgagaaaaccatctgctggtacgtacaagacgtcattcaaggatgcttgattgcttgactagctggacactgaagcaaacgtgatgcaccattgatattaactcgtgaaaatttgagaccgccatctactactgcactggaattgactctcctactcaacgtgactctaccatgaacatgcttaccactaccttgcattataactctactgtcataataactggttccatc

SEQ ID NO: 43142 - DNA, 370 bp, Zea mays
  Clone ID: LIB3062-044-Q1-K1-A3
gcgtacgcaggatcgtctgcgacaacacgctggacgccaggctcagcgtctccttcaggcaaaagctgcctgagatcaggaagaaactcttcagctaccaagtatcctaatatcttttaattttttgctattattatattctctgatcgattgctttctgaaataaatcggaagcggttcgtcataacttggaactcggttgtctctgccaaaataatgcttaacaactggtcgtcgagtgatctgcttgctcctctctttttttccttggaggcatagtaaatctcctttgtcaagtgtactagcatgtagcacaaaaatgttctcttgtagacgaattttgaagctcatcgaaggctcgcgagcaggc

SEQ ID NO: 43143 - DNA, 375 bp, Zea mays
  Clone ID: LIB3062-044-Q1-K1-A7
tgtggcaaatgtcggtgacctgcagaacacgaagcgccgtgaagcctgccgccccgacgaggaaggccggacatggcaagtcagacttcctggggaagtctgacgatatccctccggcaaagaggctgacgagaaaattggtcagctaaacaagggtacgtatagtgaaaatccgatcatgtgcaggagggtggagggatatggagtatagtgtgcaggaaccagtgtgccgaagagaggctagctcatactgagcgttggcctgtcgatggtcgcgcggatttgccatcgacacaggtttgctgcatcgagtcatcttaggaatggctatgcaaactcctttgtggagtgctagagcctgcttccagccttaac

SEQ ID NO: 43144 - DNA, 449 bp, Zea mays
  Clone ID: LIB3062-044-Q1-K1-B4
tgtgaaagctgcagtcggacgtttgaatgggagcagattcagagagaccgcaccgaaagcaactggagggacttctaggagccagttcaaatagaaccagtgccgttggctctctaaatgctgtggtgaaaggaaaacaacccctgatcagagcatttccgtttctgagcatcgttgaagatagttggcattgggcccccggaggacctcgaggggctgcagaggttcctttgcttcagagcccctctgtacctattcatcaacgtggaccctggaggaccgttactgcctgctagtagcagctcgttattttgagctcatcttttgtgctgctcgtcagctcgtgttcaaaccaagcctactgctcatttgctttccctgcagcagcagcagcccctactgttgcatcgaagaaagcaatctcattagcgactgcgttgaactgtagt

SEQ ID NO: 43145 - DNA, 447 bp, Zea mays
  unsure at all n locations
  Clone ID: LIB3062-044-Q1-K1-C4
tccaattcgcaagatccattggcgttgagatcgcatcgaccatctagtacaggatcaaacgtgaagagcaacatagaagctgtttggatgggacactctcctcctttgctaaggctcgcaattgtggatttggcattaccaaaaactcctaatgataactctctgtcattgtttgctgatccccttgttccagagagattttattgtgcgcatggtggggggcttgacatggtcacactgcacttcctaccattttcataccctgaaatgtcttcgacaccaccctctgtgcatcctgtcctcactacagggaacagcgaaacaagctcaccttttctttctggatttgttaccatagctgatgcatatggtcatgtacagttagctggcatcacatgctngggtgagtgctttgtggtggagatgaaggggtggaaggaaccgcac

SEQ ID NO: 43146 - DNA, 393 bp, Zea mays
  unsure at all n locations
  Clone ID: LIB3062-044-Q1-K1-H6
tgaagaatgattttgtcaagtatgcccatgatgaggaagcagccgatgaccagggggagtctggatggaagtatatccatggtgatgtcttcaggttcccaaagaataagtcgctattttccgctgctcttggcacaggaactcaactatttgctctcacaacctttatattccttcttgcacttgtcggagtattctatccttacaaccgtggtgcactatttactgcattggttgtcatttatgcactcacttcacgaattgctggatacattgctacctctntctattgtcagttggaggggacaaactgcgtgaggaacttgctattgacaggatgcctattctgtggacttntcttcctgacattttgcttcttggacaccgttgcta

SEQ ID NO: 43147 - DNA, 166 bp, Zea mays
  Clone ID: LIB3062-045-Q1-K1-A3
tcgacgcgacgcgtacgcatggatccgctgcggtgattagcatgagtttattgggtaactagtggggagtactaaatggcctggcgtttggacgtttcaactgttatgtactacgctttctcgtgtctcagatgcttgcattaaattagtggcgcttttgcatttt

SEQ ID NO: 43148 - DNA, 382 bp, Zea mays
  Clone ID: LIB3062-045-Q1-K1-A9
cacggccatcgtggcgagggcaaccaagctgagcgctactcgcagtcgcagttgttgcctggccagcatgcagctctaactcaccccgtgcagcagacgccgagtcgtggcaggtagctaggaaggagggccggagggaagggaagggcaggccatggcgctggaagccgtggtgttcccgaaggagcacctagcgggcactgccaaggcgcgctcggcgtcgtcactggcctgcggcttccgcaccgaggaggtcgaggacaacggcggtgtggttctgcaaggagaggccggcgcggccaccacgtgggagtactgggacgcggcgctctgcccgtgctccactgcacctgctggtgccgtggaggagtgctgggacgtg

SEQ ID NO: 43149 - DNA, 86 bp, Zea mays
  Clone ID: LIB3062-045-Q1-K1-F3
cttatatgtgaaaaacaaaaatcaccatgctttcattctagagctaaataaatttatcacaagtcaagtttccttagctaagccgg

SEQ ID NO: 43150 - DNA, 313 bp, Zea mays
  Clone ID: LIB3062-046-Q1-K1-B12
ttcctggaattctttcggtagtttctcgttttcttatattactcaccagaagcttacaattcgtgggctgcacaaggtttggaccattttgttcagaaattgcgatttagggcagccgtaggcagtcatccatttgtatattcttccattgctgtgataagatggtaagaatgctcaaaatttttttttggttaaatgaaaataagaaaaactcagtttgattcaaaaaaaaaaaaaaaaaaaaaaaaaaaaacaaaattaaaaaaaaaaaaaaaaataaaaagagaaaatggtaaaaaaaatataagagaaa

SEQ ID NO: 43151 - DNA, 383 bp, Zea mays
  Clone ID: LIB3062-046-Q1-K1-B3
ggcggctgcagccggcgccggcgccggcgctgctcctcgtcctggccaccatcgccggcgtcgtggtggtgcgagcggagccccaggtgccgtgctacttcgtgttcggggactccctcgtggacaacggcaacaacaacgacatcgcgtcgctggcgcgggccaactacccgccctacggcatcgacttcgccgccggccccaccggccgtttcagcaatggcctcaccaccgtcgacgctatatctcggcttctgggcttcgacgattacatccccgcgtatgctggcgcgagcggcgatcagctcctcaccggcgtcaacttcgcttccgccgcagccgggatccgtgacgagaccggacagcaactggggcaacggatc

SEQ ID NO: 43152 - DNA, 385 bp, Zea mays
  Clone ID: LIB3062-046-Q1-K1-B7
tgccgatcgagtcaactttagtcgtggatgttgacaattggaaatccatgtggcaagtaaatgattttggaactgggggcaggtcagagtctagagcatgttcattccacgtatgttggtttcgtgacttgttttcggtgatttcagatctgaatggctgacattttgtctccatcgatatttaatagtaaagcaaggtttgtgacctggatttattgggtgctgtagacattggaagtggattttcctcaattggagatattgacaaattggaaaaaaatgtgacttgacctgtgctgcaacaaccttaaactaagaggggcttctaattcttcatctctaccaacaggactctactgttactttttaaaccaataactttttc

SEQ ID NO: 43153 - DNA, 210 bp, Zea mays
  Clone ID: LIB3062-046-Q1-K1-B8
cccacgcgtccgtagttctagatcgccacaccttttgtaggcatgtatttttgtaggacctgattttggtagggaatagaggggtaaggtaaaacaatgaaaaacgtaggagttcggaagtagttcggcaaaatgtccacacctatgtaattgtattgaaactgactaaagctagtgcaaggaactgacacttagttttgttttgtgttt

SEQ ID NO: 43154 - DNA, 420 bp, Zea mays
  Clone ID: LIB3062-046-Q1-K1-C9
ttgcaatcacaacgaacaaaagctctcgatctcaccgacaccgaggaagaagagatgaatggcgtccgagcagggagtcgtgatcgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgctgcgcctgcgcctgcgtctgcgtc

SEQ ID NO: 43155 - DNA, 357 bp, Zea mays
  Clone ID: LIB3062-046-Q1-K1-E2
tgaggccaaggaaagtgccttggtgtggcaccatcaggatgctgacctaggctttggatccgcacaggcaaaagagatgcttgatcacctggaaagtgtactagcaaatgaaccagtctctgtcaagagtggccagttcattgttgaagtcaaaccacagggaataagcaagggaatagttgccgagaggatacttgcatcagtgaaggagagaggaaagcaggctgatttcttattgtgcatcggcgatgataggtctgatgaggacatgtttgaaaatattgctgatatcattgggaggaatttggttgctccaagaacagcactgtttgcgtgcactgtgggacaaaaaccaag

SEQ ID NO: 43156 - DNA, 440 bp, Zea mays
  Clone ID: LIB3062-046-Q1-K1-E7
ctgctcgaaaccgcagccactggccagtcgatgcccatgactgcggtgcccaggaccggccccggttgcctggggtcgccgccggctcaggctctgtcgagctcactagccggggttcaaggcgccccgaagcgactgggcgcatcgaagccgtcgtggatcgttcgcactgagtcaaacgtgaggagggagagagcaaaacgacctgatcctccttgcaccatctgcaagggcacagggagaatagactgccgcaactgctttggccgaggaagaacaaaccatgccgatgtggccatgcttccgaacggcgaatggccacaatggtgtcgaatttgtggtggtagtggactggattactgcctccggtgccatggaactggtgagtatcgtgaacccatgggctttcacttcactgtccaaagaaaatgaggtgggat

SEQ ID NO: 43157 - DNA, 385 bp, Zea mays
  unsure at all n locations
  Clone ID: LIB3062-046-Q1-K1-F5
tgaagatcgaccagggtggctgggtcccactcgtcgtggcgacggccttcttgctcgtcatgtacgtgtggcacttctgcacggtgaagcggtacgagttcgagatgcacagcaaggtgtccatggcgtggatcctggggctgggctcgagcctgggcctggtgagggtcccagggatcggcttcgtgtacacggagctggcgagcggcgtgccgcacatcttctcccacttcatcaccaacctccccgcgatccactcggtggtggtgttcgtctgcgtcaagtacctccccgtgtacaccgtgccgacggaggagcggttcctggtgcggaagatcgggcccaggagcttncacatgttccggtgcgtggcgaggtacgggta

SEQ ID NO: 43158 - DNA, 195 bp, Zea mays
  Clone ID: LIB3062-046-Q1-K1-G6
tgctgtagccatcctctctacctcatgtgtttgtccagacatgtggaaatgtgactgttgttacagacctttggtgcagtatcatctcatatttcgagttgaaatggtaatcactgaatgctcttcgcagggcatttccagcttgtatcttctccatgagatcgcatctatactcggactcgtggacgatgacat

SEQ ID NO: 43159 - DNA, 281 bp, Zea mays
  Clone ID: LIB3062-046-Q1-K1-H4
tgttctaagggacctgtaaatgcttgtgccctatattgtgtgcctccacatattggggagcttgaagcatcgacaagttgctagtcattgcttacgtatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctaaaaaaaaaaagaaagaaaaataagtacataaa

SEQ ID NO: 43160 - DNA, 349 bp, Zea mays
  Clone ID: LIB3062-047-Q1-K1-B2
aagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcga

SEQ ID NO: 43161 - DNA, 219 bp, Zea mays
  Clone ID: LIB3062-047-Q1-K1-D10
gagatcgagagaggttttgtttaagaaaaaaaaagtataggaacaggtgatgtgaggtgagtgacggggaagagtgaagctagtgggccgccgccgtgccgtagcaaaactcgttccggagggcagaactaccgccgcgcacgacgaagtgggctagcgaccgcgtgctggtctcgactacacggttctccttgcacaggaactccctggagcacgccc

SEQ ID NO: 43162 - DNA, 396 bp, Zea mays
  unsure at all n locations
  Clone ID: LIB3062-047-Q1-K1-G1
tgataattgtgacaacaacttctgttcgaccacaccaagcttattacttgaaccgcctggctcatgtgttaaaaaatgtaccacctcctcttctgtggattgtggcggaatggccatatcagtcccgtgaagcagcggagatcctgaggtcttctggggttatgtacagacatcttatctgcaatcggaacagtacaaatataaggaagattattgtctgccaaaagaacaatgcaatttttcatatcaagaagcaccgtttagatggtatagtacattttgctgatgaggagcgagtgtactcagttgatttatttgaagacatgcgnaaaatcaggcgcttttgtacgtggccagtagcgacacatgtttggacccggtaccaagggggttttg

SEQ ID NO: 43163 - DNA, 258 bp, Zea mays
  Clone ID: LIB3062-048-Q1-K1-E6
tggacgcgtgggcgacagttggaagctgaaggagatctttgctacgggcatcgtgcttggagagctaccttgctctgatgactgtcattttcttctgggctatgcacaagaccgatttcttctcggacaaattcggtgtgaggtcgatcagggacagcgagcatgagatgatgtccgccctgtaccttcaagtgagtatcgtgagccaggctctgatcttcggcacccgttcccgtatctgggccttcttggagcgcc

SEQ ID NO: 43164 - DNA, 309 bp, Zea mays
  Clone ID: LIB3062-048-Q1-K1-G6
tgtttgtcctttcttccatgttcacagcatctttaataataatatacctctgcagatatggtgtttctggtttccctacattgaagttcttccctaagggaaacaaagccggtgaagattatgatggtggccgggacttggatgactttgtcaagttcattaatgagaagtgtggcaccagccgggatccaaagggccacctgacttcagaggctaggcttgtgccaagcttgaatcctcttgtgaaggagtttctcaatgctgttgattacatgcggaaggaaatcctctctaaaatagaagaggatg

SEQ ID NO: 43165 - DNA, 268 bp, Zea mays
  Clone ID: LIB3062-049-Q1-K1-B3
ctgagctcgccggcacggcgacagcgacatgatgaatctgtcgagcagaggagctttcgcgtcgttgtattatgtgtaccattagcatccattttgtttgtttctagaagttggtaatgaccgtcggagaagagcctgtaattgttcgatcatgtattgcttacaatttttttttaaaccgatgaaataaaacaatcaggcttaacatctcataaaaaaaaaaaaaagagataaaaaaaaacaaagaataatacaataaatagatcat

SEQ ID NO: 43166 - DNA, 388 bp, Zea mays
  Clone ID: LIB3062-049-Q1-K1-E11
tccgcacccaacccccgtcggagagagagatggcatcggtggcggagatgcagcccctcgcgccggcggagtaccgccgcgcgccggagatgaaggagaaggtggaggcgtcggtagtggacctggaagccgtcaccggggagacgctgtacccggtgatctcgcgcggggagagcgccctacgatggggcttcgaccgcaaggtctactgcatcctcgctgcgcagctgctcctgaccaccgacgtctccgccctcaccgttctccatgctacccttaacgccacgctctgcgacttcgtggacctcgcgctcgagctcgacgtccttgccttcattctgatgatcccattgtatcattatcagcacatgcacccacacaatttcgt

SEQ ID NO: 43167 - DNA, 271 bp, Zea mays
  unsure at all n locations
  Clone ID: LIB3062-049-Q1-K1-E12
tcaatccaatcccatttgcatttgcattacatcaacgccaacataagctttacatgcaaagggtngcttcacagggggctttagtctaatcaacctcctcactctgtctgtgtctattgtatataccacttgtcgtggatgtatgcctgtacattgttggcaaggatcaatatgatctgcttgctatctcttaagtgatcttagcaattacttcatctgtcaatgatgatttgtcgaaaccttctaccttgcgcctatttcttgacaaata

SEQ ID NO: 43168 - DNA, 375 bp, Zea mays
  Clone ID: LIB3062-049-Q1-K1-H11
tgattctgtgctgattgatcatgatctggatagctatgcactctatgacactaatggacgtgaagttgcacaggagttggttgaaaagattgggaaggtgtttgagaccatactggaagagactggcaaattgagggaaggaaccaatgaagatatgtctatcgcaaaggccattgcaattgttatggatagaaatccacagttgaagcaagaacggattgctcatgaagttcttcagtggtatttgtgccgtatggagggttggtttgccactgacgcaaattcaatttcactacagggctgggatcatgaggtgctgcttccaggtggccatggcctcatggttcgtggatatcgtccagttataaatactct

SEQ ID NO: 43169 - DNA, 442 bp, Zea mays
  unsure at all n locations
  Clone ID: LIB3062-050-Q1-K1-A12
aagcactccagtcccgcagcagcatggccggcagcgcgtcccgcctcgccatcctcttggtgctcctggcggcgtcaccgctgcttggcgcgacgcagaaggccgcgccagggccggcgtcgtcgtcgggctcgggcgcgggcgcggcggacgcggcgccgccgacggacgtgaacaaggcgctgaaggacgagcagttcagcgagttccggcagctgctgcacgacacgcgcgtggacacgcagatcaacgcgcagctgacggacagctacaacgggctgaccatcatggcgcccaccaacgccgncttcgacaagatgaaggcgggcgtgctgaacgggctgtcgccgcaggagcagatccagatggtgctctactgcgtgctgccccggttctacagcctgtccatgctcggcaccctcagcggcaaggtcaacacgca

SEQ ID NO: 43170 - DNA, 453 bp, Zea mays
  unsure at all n locations
  Clone ID: LIB3062-050-Q1-K1-A9
tctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgncaacatccccggcaagtgcggcgtctccgtcggcgtgcccatcagccccaccgtcgactgcaccaagatcaactgatcgatggaacc

SEQ ID NO: 43171 - DNA, 325 bp, Zea mays
  Clone ID: LIB3062-050-Q1-K1-B7
tgagatcgagtatcttccgacatctcatccctgatgaaagtgttgctagtgaggtgcgctgccacttgtcatgtcaaggtggccctgcacgcggctctattgcgatacaccgtatcatccgcgcccaataagtgcagtcttgccctcgcagagaaagacactggattccttaccgtattccaaaagaatgtgcctgccggaccactgtcactaagaacgcgggtagcgacgaccgcacctgttgccacgccaatttccaatacggccgccaccgatgggaagaagaccgtgcgacagggcttggtggatatcacgggctcatact

SEQ ID NO: 43172 - DNA, 76 bp, Zea mays
  Clone ID: LIB3062-050-Q1-K1-B8
tgagatcgagtatcttccgacatctcatccctgatgaaagtgccgctagtgaggtccctgggagttgtcatgaaag

SEQ ID NO: 43173 - DNA, 468 bp, Zea mays
  Clone ID: LIB3062-050-Q1-K1-D5
tgcgtcttgaaaggggagagagagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgacgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagattctcatgcaagcaaggctcgataagaagctgacacaggcacaacttgctcagatgataaatgagaagccacaggtgattc

SEQ ID NO: 43174 - DNA, 306 bp, Zea mays
  Clone ID: LIB3062-050-Q1-K1-E10
tacaagtaagacccacaccatggattctactaagcgggccttgcgatgataaggccgtaacgcgacgactgacacctgccacccgacaacgccgcacgcatacaagcctaacttcagaactacttcgacagcgtcccacagagacgcccatgcatgccaacacgcagcgacccctatcaagacaccttcccgcaaccatcagtcctacaagacgaagaccactacttgcctgaactacacaagcttctctaactatagactaagccccaaaatctgagcgctacaacgagagcgcagacacctact

SEQ ID NO: 43175 - DNA, 213 bp, Zea mays
  Clone ID: LIB3062-050-Q1-K1-E5
tcaagttatggtacgctgacgctggcgcaagctgctacatacgtcgattagatgcgagcatgggaccattgtctggaccgtcgtgagtggaatctatccagtaggcttttatgcacgaactagtctaaggcgaaagacctagacgcattgtgctattatcgaatgttgagctgtcaatacctttggcgcttatgacgagaaataatatctgac

SEQ ID NO: 43176 - DNA, 463 bp, Zea mays
  Clone ID: LIB3062-050-Q1-K1-E8
tgatggacaagtaatcaccattggtgcagagagattcaggtgccctgaggtcctcttccagccgtcgatgattggtatggaggctgctggaatccatgagacaacatacaattcaatcatgaagtgtgacgtggatatcaggaaggacctctatggtaacattgtgctcagtggtggttcgactatgttcccgggtatcgctgatcgtatgagcaaggagatcacttcccttgcaccaagcagcatgaagatcaaggtcgttgcaccgcctgagaggaagtacagtgtctggataggagggtcgatcctagcctcgctcagcactttccaacagatgtggatatcgaaggaggagtacgacgagtctggcccggcaattgttcaccggaagtgcttctagggtttcacaagttcctcgtcgttacctagtctcaaattatgtcccctccatttctcgagatat

SEQ ID NO: 43177 - DNA, 339 bp, Zea mays
  Clone ID: LIB3062-051-Q1-K1-B11
tgggctcccgcagcggcgccacctccaaggaggtgaaggtcgctgactgtggccaggtctagatctctggtctgtccggctgccctccctccgtcatcgtcgactccgcctgcgtccgtcccttttcatttccttcgatctgaataagatgatggcgatctgagtggtggtcttagttgagtcttcaagtcgtttgtgtctgtgtccctcgcggttttaatttagcggtttaggtgtggatctgtgaatcccgtggcgcctctgcttaatccttgtttcagctgttatgttatgggatccatgataatgctataaaactgaaattccggttcgggcttc

SEQ ID NO: 43178 - DNA, 433 bp, Zea mays
  Clone ID: LIB3062-051-Q1-K1-C5
taacatcactactggtgttatatgcaatggagtgaagagtgtaatcaaggaaggccacaagagctttcccagtggacacacttcatggtcttttgctggtctaggcttccttgcatggtacttagctgggaaactcacggcttttgatcgcaaaggacatattgcgaagctatgcattgtgtttctgcctcttcttactgctgcgcttgtggctgtttctcgagtggatgactactggcatcattggcaagatgtatttgcagggggtcttataggtcttacagttgcttcattttgctatctacagttttttccatatccttttgatggcgatgcgttgtggcctcacgcatacactgtccagttagccgaagaagggaacagcagaaatacaaacttctacagcgtgagaccaagccagatcgaaacagtc

SEQ ID NO: 43179 - DNA, 136 bp, Zea mays
  Clone ID: LIB3062-051-Q1-K1-C9
cccattatatttattttatttttttttataattttaaattcttaatcctggtaatgttggtcataatattgctcttcttcatttaataaattgttgttctattctattttataagtcttcattatatattcttttt

SEQ ID NO: 43180 - DNA, 160 bp, Zea mays
  Clone ID: LIB3062-051-Q1-K1-D12
gaattcaaatcacaatcttttaaacaaaacttttgcaaaaaaatacctagggtttaaacataagggcccaaaacttcaaaagcttttcatgattcatttttggacaaggggatatgggttttaaaaacttcgcttttccctttttttcttggaaaaggcc

SEQ ID NO: 43181 - DNA, 368 bp, Zea mays
  Clone ID: LIB3062-052-Q1-K1-A8
tgatgatactggaggtgaatcagagcagaaagggcaaacaccatcagcaacaccccttttctcgtttaagaatctgtcaagtggtcaaaatgctttcacaggtctgaccggaactggattttcaagcacatcattctcgtttggctcagcctctaaagatggctcaagtgctggtcccctatttgggctgaaagctgatggttcttcgttcccttcttttaatcttggtgctgccaccaatgggggttctgccacagctcttgctacttcagcagaggcacccaagatgtttgctatgacagagggccctgtcgaaaccggtgaagaaaatgagaaagctgtattcagcgctgattctgctttgtacg

SEQ ID NO: 43182 - DNA, 419 bp, Zea mays
  Clone ID: LIB3062-052-Q1-K1-F1
tgctggaatttctgaatatattgatatggagaaggagcttcaagaggtcataacgttaaccgaagagattttggcaactgcaaagcaaactgagagtgcccagaatgttgcaggtctatcaccgccaagctattcagctggagtgcagtctgagggactggatgacctttcacattcccataagtttgccgttggtactagagttcaagctgtgtggagtgaagatggagaatggtataatgcaaccgttgaagctttgacaccaaatggatactatgtagcctacgatggctggggaaacagtgaagaggtggacccagataatgtgaggctgcttgaggaagaagcagctgatgccttgggacaagctgaaaagggaagctgaagctacaaaaatggcaataaagaggaaaattgaa

SEQ ID NO: 43183 - DNA, 356 bp, Zea mays
  unsure at all n locations
  Clone ID: LIB3062-052-Q1-K1-G11
acggccgcgaccgaaacgggacccaccagacgcaattccccaacacgtccgcctcgacgaatttcgatcgtttccaacttgggatttccgccttccaatcgctccgtttccttcgtattctagaacctagcatttggtttgattccgccgcttggtccggccccgaggaggaggcaagggagggagcggtggccgcgcggccatggcgggctcgtctacggcggcgatggacgcagccgcggcctggtgggacgacgtgaacaactccacgctgtggcaggaccgcaccttccacgccctcgccgcgctctacggcatcngtgcagtcgtagccctagtccaacttgatagaatcg

SEQ ID NO: 43184 - DNA, 67 bp, Zea mays
  Clone ID: LIB3062-052-Q1-K1-H5
aacagtttatgtcctatgtttgtccggtcaaaaaaaaaaaaagaagaacaaaaaaatgggaagggaa

SEQ ID NO: 43185 - DNA, 237 bp, Zea mays
  Clone ID: LIB3062-053-Q1-K1-A12
gactagtttagatcgcgagcggtccccttttttttttacttctttcctgaaatcaaagtatatagcataggtctagacaccatacacacaggccacaacaacaatgacgctaataccaccagcgttatttatgttacatgcaccactgatggtccgtacccggtagcgtgatcttcaccgacaaccccacccgaaaaaaaaaacaacgaccacaataggataacgaagaaccaagat

SEQ ID NO: 43186 - DNA, 401 bp, Zea mays
  Clone ID: LIB3062-053-Q1-K1-B2
tgaagacagaggccagtcacaaggcgatagcagcaggtggtggcaagatgacggtgctccactctccggttggagttaggagcatcgtgacctccttggtggctttcttcatcctagccagctccatcgtgttcctcctcgacagaggccaggaagagcaagtgcaagtggcagtcgagcatggacgccaagaagtgcaggtgaagctggaatccgggctgcaagaaccggcgataagagggacaacccaagagggggacgccagcaacgaggagtgcaactggtcccagggaaggtgggtctacgacaacgtgtcccgcccattgtacaggcgggctcaagtgctccttcatctttccccgaggtggcctgtgacaaggattggcaggaaggatgccatg

SEQ ID NO: 43187 - DNA, 90 bp, Zea mays
  Clone ID: LIB3062-053-Q1-K1-B3
tgaaaacacagaccacacacaattcgattgcagcatgcaacgtcatgatgacggggcggcactctactattggagctagcaacatactca

SEQ ID NO: 43188 - DNA, 408 bp, Zea mays
  Clone ID: LIB3062-053-Q1-K1-F11
tgtggctgctactattgaggacaaggaggatttcacaaatatggagaatacaccaccagtgatagaacccccaagcaaaccaaaatacaggcatgactactacaacagtgccacagaagtggtactgacaatatttgctaagggtgttcctgctgatagtgtagtcattgattttggtgaacagatgttgagtgtatccattgaagttcctggtgaagaaccataccattttcagccccgtctgttttctaagattatccctgagaaatgcaaatatcaagtcttatccaccaaggttgaaatacgccttgcaaaagctgagcaggtgacatggacaaccctggattatagtggaagaccaaagactgttccccagaagataagcacgccagctgaaacagccccaag

SEQ ID NO: 43189 - DNA, 346 bp, Zea mays
  Clone ID: LIB3062-053-Q1-K1-F8
acgcgtccgaagctccgcaggccactctgcgcgagttgcttggcctgcttattggccctggagagggtcgtggtcttgctagccatcggcgcctattcgaagaaaacttactggcgaagggcctaaggcctgttaggatgccctgtcaacgacatcccaatctatctgcctccggcctaaatgtactctcctaacattcccgacaccacacagatatactcggaggcccccatcttattatgacctgccaaacactaccatgcctagctagatattcaacactcacctattgagctggctgtgcacgactcttgccagccctgatgactctcatatctctcttgaa

SEQ ID NO: 43190 - DNA, 370 bp, Zea mays
  Clone ID: LIB3062-053-Q1-K1-G12
tgaagattctgtgagcttcatggcacatgggggtggtggggatacttatgcagcagtgaagaagtaccttggccgtatcctttctgaggtggtggatgcttccattcaaaaacttgttgattcaggcagtggtctaagtgtgtcccaggcaatgcaagtcgctgctaacatgtctgtgatggagcgggcatgtgagttcttcacacgccatgctgcacaactgtgtggtgtgccactgcgtgctgtggaccgtggtcggcgggacttcccacttcgcaggtcacgtgatgctgctgatgcgctcctgctgcggctcctatgtgctaaggttgatgagttcatgcggcaatctgatggtgttaactggatg

SEQ ID NO: 43191 - DNA, 335 bp, Zea mays
  Clone ID: LIB3062-053-Q1-K1-H11
gccaagcgcgcgttcgtgcactggtacgtcggctagggcttggaggagggggagttctccgaggcacgcgaggacctggccgtcctggagaaggactacgaggaggtcgccgcagagggcggcagtgatgactgcgacgaggaggaggaatactgatctgcttgcatgaatctgtttggctgtcgagccaggttgtggtgttgaaaaacctttgtttgtgtcctgggtaatgtttgggtgtttccttccatcatcacttgctgaactgctctagtatttgcatttgtaattgaagtctgtcgctttaaaaaaaaaaaaaaaaaaaaacataaaaa

SEQ ID NO: 43192 - DNA, 442 bp, Zea mays
  Clone ID: LIB3062-053-Q1-K1-H4
tgaaacacaccaagggccagctgtccttggaattgctcttattgctatggctgaagaattaggagctgaaatggctgtacgttcacttgagcgtcttctgcagtatggcgagcagaatataagacgagcagttcctcttgctcttggtatactctgcatatctaatcccaaggtgaatgttatggacacactgagtagattgagtcatgatgccgatgccgatgtgtcaatggctgcaattatctcattgggtttgattggtgctggcacaaacaatgccagaatagctgccatgcttcgcaatctttcaagttattactacaaagaagcggctcatctgttttgtgttagaattgctcagggccttgttcacctcggaaagggcttgttgaccctttctccgtaccattctgatagatttcttctttccccgatggcactt

SEQ ID NO: 43193 - DNA, 204 bp, Zea mays
  Clone ID: LIB3062-053-Q1-K1-H6
tgataacacagcgccatgcgatgtatcttgtgacttgttgaattagtgatgcaggatgcctttgttaacaaagctaacgcttcaacttcgacttgagcattactttgattttttgttgaatcgtgcatatctgtatcaatttatttattttgggtttatggtattgtggttcgatcaaattataaacacactaaaaaaaaagag

SEQ ID NO: 43194 - DNA, 235 bp, Zea mays
  Clone ID: LIB3062-056-Q1-K1-B11
cgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaataaaaaaacaaaaaaaaaaaaaaataaaaaacacaaaaaaaaaataaaaaaacaaaat

SEQ ID NO: 43195 - DNA, 415 bp, Zea mays
  Clone ID: LIB3062-056-Q1-K1-H11
tgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttacca

SEQ ID NO: 43196 - DNA, 183 bp, Zea mays
  Clone ID: LIB3062-057-Q1-K1-C12
tccaaaatcatgattacagggaagtggaacaagtccctgagttgccaaccatgtgaccaagaaggcgatcctttttcaggcacggagctgaaagagatctggagaggtgcttctggcccacaaggcgacaagtatcagtacacacactttggacacaaaattaacagctttgacacgggacct

SEQ ID NO: 43197 - DNA, 372 bp, Zea mays
  unsure at all n locations
  Clone ID: LIB3062-058-Q1-K1-A1
gacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgtcatcgcgcgcctnnctcccggccgcaccgacaacgccgtcaagaaccactggaactggctcctcaagcgcaagctcgccgtcgcgtccgtcccggcgggttcctccgacgtcgacgcgcgcccgaccaagcgcgtcaggctcttcgccgacagcccgtcggggtcgggg

SEQ ID NO: 43198 - DNA, 281 bp, Zea mays
  Clone ID: LIB3062-058-Q1-K1-A4
tgctcgagacgagagccagctctcccatcacacgagcacatggcgttcaccaccctgggagctgtcttcctggtcgtggctgcgtccggaacgcccgctccggcttggttaacctgggaaccggaaggcccttttaaccttgaaccaggccctggggaacccggaaccgctgccaactttggacccaagcgttgcccgactgctgttcgtgggaccacctccggtgtaacgaccccggacccgtgaccaacgggttcatggacggtgcggacaacttgcgc

SEQ ID NO: 43199 - DNA, 182 bp, Zea mays
  Clone ID: LIB3062-058-Q1-K1-B10
tcggatcatgtgatttaacatgaccacttgtcatatttggtccctgtatgagatgtgtaatgtgtggggatattttctctctttaatacaaagaagggcagctaatcttgtgtttttgaaaaaaaaaacaaaaattgagaaataaaaataagtatacaaaatctaaataaaaataaatatta

SEQ ID NO: 43200 - DNA, 406 bp, Zea mays
  Clone ID: LIB3062-058-Q1-K1-B12
tttgtgactgacagtgaaaaaatgacagtcgagtatgagaactgcaagcttctccttgtggacaagaaaattaacaatgccagagatcttatcactatcctggaggatgctattagaagtggatatccaattctaatagtggcagaggacattgagcaggaagctcttgcaacccttgtggttaataggcttagaggtgcattgaagattgctgctattaaggcccctggttttggagagcgcaaaagtcaatatcttgatgacattgctactctcactggaggcactgtcatcagagaagaagttggattatccttagacaaggcagacaatgcggtcctaggaactgctgctaaggttgtagttaccaaggattcaacaacaatagtgggagatggcactacac

SEQ ID NO: 43201 - DNA, 146 bp, Zea mays
  Clone ID: LIB3062-058-Q1-K1-H5
tatcacagcagaagtgctcaatttttgctgcggagcccacaagtatgggcaccacaatgaggacttcatcgccatctactttgcttcttgcatggaatttatttgggtgtcattgctgcatatggttgccgtagacatcctaatgc

SEQ ID NO: 43202 - DNA, 412 bp, Zea mays
  Clone ID: LIB3062-059-Q1-K1-D3
acgattaaaaaagataacaatatagcatgcagggctaccgtatgcaggtgtttagtaaggttctagacacagtacatgcaaccagtgaccttcaagcatgccatctagcttaatatcggaaagccacaaggtgcaaagtatggggcagtttgtgaacggcaagaccaactgggcttaacaagacaatcaacaaatgtcaaatccagatcagccaaactgagtgttccaattctcaggcaaaggaacagggtgtcagtgccttctctcctcatcaaagtgtcacatgaacatctagctgaaaaggaactgatagtcacttaaagttccccaagatagatctgcttgtcgctgccgcaagatccaatgatcggctctgtgggatggaaagcagtctcattgacagaaccattgt

SEQ ID NO: 43203 - DNA, 405 bp, Zea mays
  Clone ID: LIB3062-059-Q1-K1-E1
tgcaatcgctcttaagggactaggaagtctgcttgttattttgagcagctccctcggggcgcatctcctgctgctgtggctggctctgatcactcctatcttgcacgactgctacaactacgacacggataaggcagaattcgcgcggctgtctgcgaagttcacccatgacgtgacgctggttggagctctcctcgtcttacggggcatgaagacctccattccgaatcgacagggcatgaagatggctcacaaggcgaagactaactactaagaggttgctcgctcggcctcaggcgggtgtcaggagactaatagcggcccagtgcgaagcagtcgatgcgcatcgagctgtcggctgcgcttttacatgtatcgcatattcagattccatcttgcggggcg

SEQ ID NO: 43204 - DNA, 401 bp, Zea mays
  Clone ID: LIB3062-059-Q1-K1-F12
aagcaagcagcagcagccggctccgcctcccgcagcagccacaccccgtccgtcaccagaggaagaggaagaggaggatgtcggggtcgaaggtgtacacccttgatgaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgtccgtgcaatgatggacgagtacctcgtcggtgagattgatgcggccacgatacccagtaaggtgaagtacacgccccccaagcagccgcactacaaccaggataagaccccggagttcgtcatc

SEQ ID NO: 43205 - DNA, 62 bp, Zea mays
  Clone ID: LIB3062-059-Q1-K1-H10
ccgcttacgagcgcatcccttctccctcggagcggtcatctactggctcgtatctcccatta

SEQ ID NO: 43206 - DNA, 428 bp, Zea mays
  Clone ID: LIB3062-059-Q1-K1-H3
ttctgcactattgccactgttgcaaaatggggtcgatcagcttacatcaacattcagggaggggtgcagcttcagctcactgtcaatgtggttgctctagtggcaaacttctactcagcttgcctgacagggagtgctcctatcactgctgtgcaattgctctgggtcaacatgatcatggatacactgggtgcgctggcattggcgacagaacccccaaacaatgaactgatgaagagaacacctgttggaaggaaaggaaacttcatcagtaacattatgtggagaaacatcctgtgacaggccttgtaccagttccttgtaattaggtacctacagacagagggaaagtggctgcttggaatcaagggcaataactgcgatctagtcttgaacacactgatcttcaatcgcttcgtgttcttgca

SEQ ID NO: 43207 - DNA, 598 bp, Zea mays
  Clone ID: LIB3062-054-P1-K6-A1
cttgtacctgtcctgaatacggaggttgccttaaggctgaaaagggaccgtggaaggacccaaacatacttaagatagtccaaagtggtggggttcattgtgctcgtcaaattgtaactatttccaatggtgaggaaaaatttattacttacgccaaaccgaagcgccacgcaatgagagggagtgacacatcaactgctgagtctggttcagaagctgatgatgctgtgtcccccaaagctctcagaagttacatatcacatcctaagttgaccccagttcgtgaagaggtcaaaatggtcagggctactagcttttctactcgtgtccctgaatatgatgtacctgttgttgacaaggccgtggatgctacatggaagagagagcaaccacgaaaggcaccatccgtgccccaagatgcagactcatctgtgaaaactgcatccaagccatctggccgcccctgggataagatcggtgcaaatctgatggcttgtcttatgggttttgtaatgttgggtcgatcaatcaaagatcttgccacaatgagattggcatctaaaggcgggtcagaagaaactactgtacattggacccg

SEQ ID NO: 43208 - DNA, 505 bp, Zea mays
  Clone ID: LIB3062-054-P1-K6-A11
ctccccttgtgtcgcgctcgcgcatctgaagcaagggggggaagggccaagggggatcggtcttgttctcggagagggttgagctgcttgacggttttgactcggatcatggtgtgcagctctatcagatagagagctgacgtgaggtgtgagacgcggatcgtggagtactactcagtaggagaggtggggagggggaagaaggcgatagccggggaggatggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatcaggttgttccatggggc

SEQ ID NO: 43209 - DNA, 680 bp, Zea mays
  Clone ID: LIB3062-054-P1-K6-A3
cgcagatcgagtcatcaagctagctagcccggagcacgcctagacacgccagcagcaatggcggctcagctggccgtcgcgtttctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgccctacggcgagaccttctttggccgcgccacctgccgctgctccgacggccgcctcgtcgtcgacttcctggccgagaagttcgggctaccgctgctgaagccgtcgaagcagggcggctcagacttcaagcagggcgccaacatggcgatcattggcgcgaccaccatggactcgggcttcttccagtctctgggcatcgccgacaagatctggaacaacgggcccctcaacacccagatccagtggttccagcagctgatgccgtccatctgcggctcgacgcaggcctgcaagtcgtacctgtccaagtccctgttcgtgctgggcgagttcggcggcaacgactacaacgcgcagatcttcggcggctacaccccggagcaggcgagcgggcagagcgccaccatcgtggacgccatcggcaagggcgtggagcagctcatcagcctggg

SEQ ID NO: 43210 - DNA, 594 bp, Zea mays
  Clone ID: LIB3062-054-P1-K6-A4
tctctctcttcatctcgatcttcgccacgggtatcctggagatgaggtggagcggcgtgggcatcgacgagtggtggaggaacgagcagttctgggtcatcggaggcatctccgcccacctcttcgccgtcttccagggcctcctcaaggtgcttgccggcatcgacaccaacttcaccgtcacctccaaggcctcggatgaagacggcgacttcgcggagctgtacatgttcaagtggacgacacttctgatcccgcccaccaccatcctgatcatcaacctggtcggcgttgttgccggcatctcctacgccatcaacagcgggtaccagtcgtggggtccgctcttcggcaagctcttcttcgccttctgggtgatcgttcacctgtacccgttcctcaagggtctcatgggtcggcagaaccgcaccccgaccatcgtggttgtctgggcgatcctgctggcgtcgatcttctccttgctgtgggttcgcatcgatccggtcaccacccgcgtcactggcccggatactcgaacgtgtggcatcaactgctagggaggtggaagggttgtagaaacagagagataccacg

SEQ ID NO: 43211 - DNA, 345 bp, Zea mays
  Clone ID: LIB3062-054-P1-K6-A5
cggagcggcgcgggccggcccgtttagcacaaaaaaacaggtcgaaaagcgggctaaacgggccggtaagcacgttttagtgtaaaaaaacgggcttagaggtaaacgggccgtgccgggctagcccgccgtgcctagtttcctgtccaagcccgcccgcttattctaccgtgccgggctcggaccgggcccaaaaagcgggcttcgtgccgggctcacggacctcgtgctttttggccatctataagtacaagaaacaacatccaagtgtacaatcccctgtactttgcagtcttgtttaggcaaactgttcatccgattgatcaaacgagatcgttacaattt

SEQ ID NO: 43212 - DNA, 597 bp, Zea mays
  unsure at all n locations
  Clone ID: LIB3062-054-P1-K6-A6
ctgcggtccgggccggactcccgggtcgcccagcgtcggccaataagatcaagctcagctcaaccgaggtgtagctcgagccatggctaagatcaccacaatggcggcggnacggcgatcgcgcttgttcttctacccgcggccgcggcgaggagancccaccgcagcgcacccgcacgggctctcctccgagagcccgctcgctctgtcgccggctgcttacgacttcttccaccccagagcgcgcgcccgacgagctcacggcgtcgcgccggtgccggcgctcgcgtctcacggacaggagcagctgagggagtccgcggtcagagggacatcggcgagcatagcgaaggccgacctagacaaagaggccgtggcgcccgtggagacgcactggcgccacaaccacaaggtgacaggcgtgttcgtcagcgccgcagcagccgcgctagtggctatcggcgtggcgtacgccgtggtgcggcgccgggtcgtagcggcgcgcggtggcgcgggcgcgcccaagccgaacgcgtagttgcttcagggcccgcagactggtaagcttaggtgggcccagagagttgggccgggatg

SEQ ID NO: 43213 - DNA, 349 bp, Zea mays
  Clone ID: LIB3062-054-P1-K6-A9
cagatggagccgagaagatggacacagatggtgagaaccaagagggcggtgaggctgatgggcagaaacaaggcgaaggaagcacaagcaccccaattcaggaggattgaaggcatggtgacatgggctgggtcatccattgtctgagttttaggtttgccagttttcgtgggggtgcaggaaagagctagagccttgttgccgcagaactccccctctatggatcgcatgtggatgctaacaacattcttgcttatttttgcagtagatggtactgagaacagaatcagatgttgtaaactatacatacagtcgtgcatgttgccgaatgaaccattgtttcggtcgt

SEQ ID NO: 43214 - DNA, 424 bp, Zea mays
  Clone ID: LIB3062-054-P1-K6-B1
cagagagggaaatagccgaataccgcgcccagatggaggctgagttccagaggaaggtcgcagagagcagtggtgactctggtgcgaacgtcaagcgtctcgaggaagagacaacggcgaaaatcgaacagctcaaccagcaggctgcaagcatctccccagatgtcattcagatgcttctgaggcatgtcaccaccgtgaagaactgagaagtgctgctcccaaactatgctcatcggtctatttatttttgtcagagcaggtgaggaataataatatggcccttgtaccagtaattctttttttaactacggaataagccgcagcagctttagcggcaaccgtgactgttactaccagaacttgccattatttggtataatcggcaaattaaataatattgttttatattggatttttgaac

SEQ ID NO: 43215 - DNA, 655 bp, Zea mays
  unsure at all n locations
  Clone ID: LIB3062-054-P1-K6-B10
accgagttccagccgcaggtggccaggccgacgttcgcgtcagcgatccagatcggcgacccggtgtccgtcgaccgggccgtggtcgcgctcaaggcgacggacggcattgtcgaggaggcgacggaggaagagctcatgaacgcgatgtcgctcgccgaccgcacggggatgttcgcctgcccgcacaccggggtcgcgctcgccgccctgttcaagctcagggagcagcgcgtcatcgggacgaacgaccgcaccgtggtcgtcagcacggctcacggcctcaagttctcgcagtcgaagatcgactaccatgacagcaagatcgaggacatggcttgcaagtactccaacccgcctgtgagcgtgaaggccgactttggcgccgtcatggatgtgctgaagaagaggctcaagggcaagctctgagcgcctgtgcctggctaatgcaatcaactgattggaatgcagtggtttcgtcggtattggggggatcttttaggcttcagaaattctgtctgggttaggctactatctgtttgtggagtttaagcaggagaatggatgtctctcctgcaagactggcgctctctcttgtgctacgatgtgttaccatggattgattacangtgacctagtcgctggtggattgaat

SEQ ID NO: 43216 - DNA, 649 bp, Zea mays
  unsure at all n locations
  Clone ID: LIB3062-054-P1-K6-B11
cgcccagcgtccgccaccgtcgggaacggttcgggtgacagnaagacagatcggcggggtgcccgggaagcaacacttgctcgccagaagaacaccaagcgcaagaagagctctccaagatgctatttttgactgcttcaacgggggcgatgtcggtgaggccgaggcgggagaggccaagtcctgccgggccacacccggacccgagctccacggcccgagttcccgggaagcggggcacgtcggcaaaggggagggccgggtcgcggatgcagcgctcgacgaacttgacgaggaccagggacgagggccacacagaggtgcccacctcgaaggagtcgttgtcctgctcgaacatcagcaccgcgccgccgaccggaagctccaccaccggagacgctgtgaaccgcatctccgccagcggcccgtgaagacactgaagcgaagcgaccagaaaagacaaccaactgcgaaccccaggatctacagcttgatatatctgggagatgcatgcctgattacatattgccaactaccttagctaaggttcctaactgtatgccattgttgagaaaaatatctctgaagggaaattatcggctttctgataatgggttggtcacaatcatctcggctgcaccttctttat

SEQ ID NO: 43217 - DNA, 555 bp, Zea mays
  Clone ID: LIB3062-054-P1-K6-B12
ccgggccaagcgtccgcccagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgtcgccgccctcgtgttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgctcacctttcgtccgggcttgcctgtggccttgctgggcttgcagctggcatggccatcggcattgttggtgatgctggagtcagggggaatgcacaacagtcgaagctttttgtgggcatgatcctcatccttattttcgcagaagcg

SEQ ID NO: 43218 - DNA, 635 bp, Zea mays
  Clone ID: LIB3062-054-P1-K6-B2
attatctcaaacctgtgcgtctgcccctttccagctttcctctcaaacggagagatgtactcggatcagatctccaccgggcgcaagcgctccatccatgaccgccttgacggcgacctccctgccggcacgggcgccggcggccgtgtccgtcacacggtgtccaagaggcaacgacagatagatgaaaaatggaagcatgatctgtatcgggaagatgatgaaccagcttcaaaatcaacagatccgaaggatttgcgattgaagcttcagaggcgaagttttcaacaagattttaccagcacaagaagttctggtgtgcgtgatctacgtgagaagctatctggtataatgaacccacagccatcaaatgctgacccaccaaagccaaagccaaagccagtatcggaggttgttaacatctcaaggcgtcaaattgctgatgaaatgcatgcacgccaaaataagaaaccaccaaagcagacttcatcgaagaagacatctcagccaaaggctgaaagtccactcgacagtttcctgagttcccttgggcttgagaagtactcaattaccttccaggcagaagaggttgacatggcagccctaaggcatatgacggacagtgatctaaaagc

SEQ ID NO: 43219 - DNA, 666 bp, Zea mays
  Clone ID: LIB3062-054-P1-K6-B3
ctactcctccacccagctcgctgcttccggaatccggagagctcgcgtcgcgcgtgcgcgggcgtgggtgcgtgcggcggcgaagcaccagcaccaccctctcgcgtcgcgcgcgcgtctcgatggccgacggcgagccttccctcacgcgctggaccttcgaggatttcgtggtccactacgaagcgcgcttcggcctccggcgcgaggccgacggcgacggcgacggcgatggcgacgatgcacccccgccgcgcggatccgatcatggggccagtcgccccgccactgcccgcgccaacggcggcgcagacctcgccgtcttcgagcagttcgagcggatggagaggaaggtggagataagcaatggagctatagaggacggtccactgcagaaatctctacttccttcatttgaatctgcagaaatgcgcaacttagctgagacattgttaagggatataattcgtggaagtccagatgttaaatgggaaagcataaaaggtctggagaatgcaaagcgtcttctcaaagaagcagttgtaatgccaattaaatatcccaaatacttcacaggtctattatcaccttggaaagggctattactggttggtccacctgggacaggaaagacaatgctagctaaagctgtggctactgagtgca

SEQ ID NO: 43220 - DNA, 689 bp, Zea mays
  Clone ID: LIB3062-054-P1-K6-B5
gctactgcaaagcttggagctttctgatactgaagttggaaacaatggactccagcatctatctggtcttcgtaatctgcaaagtattaatctctcatttactttggtcacggacattggtgtgaagaagatctctgtgttgaattcgctgaagtcagttaaccttgacaatcgccaaattactgatgttggcctggcagcacttataagtctcactaggctgactcatcttgacctttttggagcttgcataactgacaatggcacaaattgcttcagatattttaagaatcttgtttctcttgaagtctgtggtgggttcgttactgatgctggagtgaagaacatcaaggatctgaaggccctgacgttgctgaatctttctcaaaatgctaatctgacagacaaaaccttggagctgatctctggcctgactgctttgatcaacttgaacgtgtcaaactcacgggtgtccaatgctggcctcaaacacctgaatgacctgcacaacctgcgttcactgtctctagattccacccgggtgacggcaaacgagatgaggaagcttcgagcaacagtgctgcctaatctgatcagcatgcggccagagtagtacccatttggcacctgctgtaaataatcattaggttcgagcaggctgttctgtttgtaagtaccgccttcgttct

SEQ ID NO: 43221 - DNA, 706 bp, Zea mays
  unsure at all n locations
  Clone ID: LIB3062-054-P1-K6-B7
cctgcagctccgggccgacttcccggctaagaagcatgacctcaaatctaagcaaaaattggaaaagaagattagtttttacacaaaagtaaaagatgcagttacttccttaaatgctaagaagactgtcagtaagaaaaataaacagagtcggcgccagaagaagcttaaagcatacgatctgtcggcactttctgagttcctcccagaaccagctgcaccagagcagaagactgaagcaaagctgaactgcaagtcaagacagacattagtggtgcaggagtctgctcatcttaaggctgtactggacaacccgcagttccagcttgacccattcgctgcgatccatcagcacctgctggcaacgcagccgcctgcagctgcaaagaaggacgacgcagcggggaagcaggggaaggtttccaaggacaagaaaagcaggaggaagaagggcacatcgtcaatctctcaggcaatggatatctgattgtgttccttcagtactagtaacttggtccgatgtcgactgcccgtgttccactagagggagctcatcgaagttcgatatcgatggttggcatagtttgagtaccagtagaggtagtactgtaccagccctcgcttttggcagcctgttgattgatgtttgcagaatcggtgccattaacatttggtgctactttggaaactggnngattgaggagag

SEQ ID NO: 43222 - DNA, 654 bp, Zea mays
  unsure at all n locations
  Clone ID: LIB3062-054-P1-K6-B9
ggctatgcagagctttgcttgcgttccatccatctccactgtattctgttttcccatgcccatgtgtggttttttttaacactgaacgcttcttctattctgatcctccagttcggacaagtcggagtcggcaacaacgacgaccacagctcccccggacaagtcagttttccagaggatcagaaaatctcccaggttgcatgcggatggaggcacactctggccctctccgagaagaaaaatgtcttctcctgggggaggggcactagcggacagctcggcaacggtgaaatagtcgacaggaacacacctgtgctgatcgatgccctgagctcagatggttctgcctgcaagaagctagagtcatccacggcagccccgttcgcagccaaagtttgggtgtcgccgtcagaacgatacgccattgtccctgacgagaacgtccgtaaagcaggcggaggcacggcacgaggcaacggcgccgacgcgaacgtgccggagaacgacgtgaagaggatgcgcgtgcagtcatcgtagtaggtcttctactaccgtncactccaccccacccccgttaaccctactactagtagtaagtactacgaagaaccggtgccccatctagcggcgcccgatttttgtgcgttacgttct

SEQ ID NO: 43223 - DNA, 515 bp, Zea mays
  Clone ID: LIB3062-054-P1-K6-C10
tagacctctacggcaggactatgtgaaaaagaaaccgaagttgataaatccaagtgatgaagcaagtatgattgcctctaagtcttttcaaccagaagaagtgaaacccatagcctgggcagttgctacaaaacacgagggcgatgccagtgaagaagcttctctcaccgatgaggcacctacatcagaagtcatgctagcccggaagagaaaagcaggaagctctttgtcggtagagccaaaccatctctctgatgaacttgaaccaaagctggaggatgcttagaacggggagacgtctacctgataagtaaaagttagcagcatcgtgatgccaactgccccctatcatggttttattggccctctgcttgtttctcatttccctttggagccagtttctctgttttgcgaggtcacacaagccttatttgtagtattacaacacagaagctggcttgaccaaaatccgacactgtggggtcagcaacttaacaaaatgtttgtacgagggt

SEQ ID NO: 43224 - DNA, 681 bp, Zea mays
  unsure at all n locations
  Clone ID: LIB3062-054-P1-K6-C2
agcgcattcgcgtacgtcaacggacgtcgaacccatcgcccatgggaggagggcacgaggagcaggagggtggcggcgcaaaggccgggggctactcctccggtctcccgccgtcggagccgccgcacctgcagggccagccgccgcaggagtacgggtacggcacgttccagggccctcggcatcctcccgtcgggttcccgcagcctgccccgcctcccgggttcggcggcggcggcggctaccacaaccagcaacagccgtacgcgcacgcggagacgtactacgcccaggggtaccaggccgtgccaggctatggtcctgttgctgaaggaagacctgtgagaatgaggcgtctcccatgttgtggcctcggcttaggctggtgcctgttcattgctgggtttttccttgctgccattccatggtacattggggctttcgttctgatatgcgtgcgggtacatgaccaccgagagaaaccaggatatgttgcttgcacaattgctgccgttgntgctgccgttgccatattcctgggggtaactaagggaacacacgtgtggngaattgcttccagagaaggcaatggatttatacttgtatagtatctgtgtgtattaaaagtgtggagcgacatcgagatgctcttatgacttatgttcatacatattctacttt

SEQ ID NO: 43225 - DNA, 80 bp, Zea mays
  Clone ID: LIB3062-054-P1-K6-C3
aaaaatttaaaaaaaaaaaaaaaacagaaaaaaaaaaaaaaaaaaaaaaaaaaaaaggaagagaaaaagggggggaccca

SEQ ID NO: 43226 - DNA, 499 bp, Zea mays
  unsure at all n locations
  Clone ID: LIB3062-054-P1-K6-C4
ggcgactaaccctgcgcaggacgacggtccgggtccggccggcggctgggagacgcgcgagttcacgagcagggacgccgagacgaggctgaggacgccggtgttcttcgcgtccatcgaccagcgggacggcagcgccgggggggagggcgcgtgcgcggcgctcgccgccgtcctcgcggcggcgctccacgcggtccacccggcgatgcccacccggccggagctggacgcgctcatccgggacggctcgtcggagtggaggcggctctgcgacgacgaggcgcgcgcggcgcggttccccaaccggcacctcgacctggacaccgtgctggcgtcccgggcgtggcccatcgcggtgcggcacgacagggccttcgtcggcttcttccagccggagagcttcgcgtcgctgtccggcgccatgtcggtcgacgacatctggcgcgagatcgccgccggcggcggacgcgcggacgtgtacttngtcagctggaac

SEQ ID NO: 43227 - DNA, 678 bp, Zea mays
  unsure at all n locations
  Clone ID: LIB3062-054-P1-K6-C7
cacggctaagctgtcggatttcgggctggcgaaggaggggccgcagggggacgcgacgcacgtgacgacgcgggtgatgggcacgcacgggtacgcggcgcccgagtacatcctgacgggccacctgacggcgaagagcgacgtgtacagcttcggcgtggtgctgctggagctgctcacgggccgccgctccgtcgacaagagccggcgcgggcgcgagcagaacctcgtggactgggcgcgcccctacctccgccgcgccgaccgcctgcaccgcttcatggacccggggctggagatgcagtactcggcgcgcgccgcggagaaggccgccggggtggcgcaccagtgcctgcagagcgtgcccaaggcgcgccccaccatgcgcgacgtcgtcgacgcgctcgagccgctgctggcgctcgacgacgacgtgcccatgggcccgttcgtgttcacggtcggtggaggcgccgccgagggtgtcgccggcgacgacaatgcggacgcggaggcggccggcaggcagggcaagaggcacgtcatgtcggccgtgcacgcggagagcccactgcggagccggtacgccagcgccgtgaagagaccagagagcccgccgaccctgagcagggcatgagtgccattgcanatttgcaagtgtacatagctagctgacag

SEQ ID NO: 43228 - DNA, 507 bp, Zea mays
  unsure at all n locations
  Clone ID: LIB3062-054-P1-K6-C8
ggaacatagagcaacatgcttccgacaatgtgaataaaattttggtaggcaacaaagctgacatggatgaaagcaaacgggctgtgccaacttcaagagggcaggctcttgctgatgagtatggcatcaaattttttgaaacgagtgcgaagacgaacctgaatgtggagcaggttttcttctccatagcaagagatatcaagcaaaggcttgctgaatctgattcaaagccagaggatcgcacgatcagtatcaacagacctgagggtggtgaggcttcagcgtcacaaaaatcagcttgctgcggatcgtgacggggttacattgtcacaaggaagataaatagtgcgataccatactttgtaatttacccttctacgtaccttttatctggctgtcatcgttctcgtctagctnttaaatgcaattgcttggattcaggtttctgtgttgtaatgtgaacaattttagttgtacccctggtagaaatgcatgtgctcataagtc

SEQ ID NO: 43229 - DNA, 378 bp, Zea mays
  unsure at all n locations
  Clone ID: LIB3062-054-P1-K6-C9
gatacgtcgtcagggagtgtcaattcatcatcgccaccatcaataccagaattgccacggctgcatgctgatgtctgcagttccatgttcttctgttgacgtgattttagtttgaccgttgtggggtagggccaattctttgtgaaaggaaccttaccttatatgttggcacacagcaggctaaccgtttttgtgaagaaaccattgtaggtcgttagttgtcgtatatcgcacgcgtgcatctttttggagcggttttcggctccccccacccacaggtggcggttccgttaggtacagtttccagattttaacgatgctaatacagtaaaagcagtttgtacattctacgcagattttgcagggatacgtggttng

SEQ ID NO: 43230 - DNA, 617 bp, Zea mays
  unsure at all n locations
  Clone ID: LIB3062-054-P1-K6-D1
agtccgggccgacttcccgggtcgcccagcgtncgccggaatcacagaccgtctatctcagcttgctgcgctgcactaccctgccctgccatcatatcgacgtgagcccggccgagcgagagnagggagaggcatggctgctccgaagctcgcgagctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaaatgaggcgtcctgtgcgcgtncgggcgaggaatgcatgcatggcggagagtaataaagtaatgctactggtattttaagctagatcgaggtgtgcctgtctctagtcatttat

SEQ ID NO: 43231 - DNA, 471 bp, Zea mays
  Clone ID: LIB3062-054-P1-K6-D12
gggacatgtatatgggttggccaatgcgcaggccaaccaagcaaatggcagccagagcacagaagagaatcattaggcccccaagcatgtttccattattattgcagcaatccagcatggtggcacaaaagagtgatatgattcttcgtttggggagttcctgaaatcttctcccccgatatttccgtagattctttcgcaaaaagccgatatttcggtagatcgatttgttcttcaattgtaactgtaggtttcaaggtggctaatgagtaatgagcctaataatgaacggtaggtttcaagatggccagtaatatatacacggagttagtcgtcatattctactgtgttgagttttatcgccttggtgtggttgtcctgatggagttgtgatcgaatggtgtggcttttcgctgccctttccttcacccactaaaaagcatagaatgtggagaattttaccttgagcaa

SEQ ID NO: 43232 - DNA, 346 bp, Zea mays
  Clone ID: LIB3062-054-P1-K6-D2
ccacagtatgaaccaccacaaccataattacatctatctaggagtggctgtggccgccgccgatcgattatttccatgggttacccaaggatttatggctgtctagtgcagaagcagataatttctgcccaagtttcctgtcattaatgtacttgcgtgttcgtgcgagttggctagtgcattttgcatgtcgtcccgggactaacgggatgtgtatataatatattttgtaacagagacatctgggttctatgatctccacaatgtcaaaaattgaactatcgcctgaattgtcagtcatcaacaacaaaaccttttagtccggaatatattagagttgaattct

SEQ ID NO: 43233 - DNA, 548 bp, Zea mays
  unsure at all n locations
  Clone ID: LIB3062-054-P1-K6-D3
gtggtggtacatgggaacgtgatacagttgttcgtgctctacgtgctgcatacaataaccctgagagagctatagactacctgtattctggaattcctgagaatgtggaggctcagcctgttgcccgagcacctgctgctggccaacaaacaaatcagcaggccgcatcacccgctcagccagcagttgcattgccagtgcagccatcacctgcctctgcagggcctaatgcaaatcctttgaacctttttcctcagggtgttccaagtggtgggtccaacccaggcgttattccaggtgctggatctggtgcccttgatgccttgcgacagcttccacagtttcaagcactccttcagttagtccaggctaatcctcaaatcttgcagccaatgcttcaagagctaggtaaacaaaacccacanattctgcggttgattcaggaaaatcaagctgagtttctccgcttggtgaatgaatctcctgagggtggtcctggagggaacatactangtcaactggcagctgctgtgccacaaacgctgaca

SEQ ID NO: 43234 - DNA, 368 bp, Zea mays
  unsure at all n locations
  Clone ID: LIB3062-054-P1-K6-D5
cgaaggcannttttccgcggcccgaaacccgaaaaacggggggaccaccggcganccggcgcgggagggcaccanganncagncagcaccgcggangccgcnggcngacccngangagnccgngnccgnacaacnggcgnaancanggcccnncggggccannggancccggaggaggagggggggacgaaagangaacnganngcccgccaccgcccgcggggggaacaacngaaccgngangncagccngacggggacgaaagaagaacnggcgcnccgngnggcagagcagaaagaggagccggangacacgagggcnaagcngggcacgggccggcgnnngacaacgncgngacngggaaaacc

SEQ ID NO: 43235 - DNA, 644 bp, Zea mays
  Clone ID: LIB3062-054-P1-K6-E1
gttttccatgatttccgtaatggagcatgcaggaaccttgtttgcactgatctttttacaaggggaatagatattcaagctgtgaatgttgttatcaattttgatttccccaagaactctgaaacatatctccacagggttggtagatctgggagatttggtcaccttggtctggccgttaatttgatcacctatgaggatcggtttaacttgtataggattgaacaagagcttgggactgaaataaaatcaattcctcctcagatagaccaggctatatactgccaataatctgaccgttttcatatgctttcatttctccgcgaataatgagaacttttgtaaataccagctcatcaggttttatggtgttgatctcgtttgttgcatcagagacaattctatgttggtggataacattagatgaggcacccaacttattttattacaccttgtcatgctgacactgttatggctatatgagggcaaatgtcctgccacattaggcacaaagtagtgtatattctaggtgcctattcctaggccctgtcctgcttttagtttctttttctcttattttcatcctattgtgtcattagctgtttacacaggacattttaaccctgttgcctggtctgggcgtg

SEQ ID NO: 43236 - DNA, 481 bp, Zea mays
  Clone ID: LIB3062-054-P1-K6-E10
atctacaggaaggccacgccactgaaggagctcgagcagagggcctctgccatggaggagatgcagacgcgcatcggcggggctagagcaacatccctggtccaggccgccggctccaccggcgacgactacctgtcgtcggacgacacaagcttcctgcagttcccgtcctcgtgctcccccgcgctgtcgggcgacagctacggcgcgcccagggaggccaagacggaggccgcggacgccacgacggtcacggtagcgtcgacgtcgtcctccctactgcatgccgcgagcgttgccggcccggcggtgaggcacggtgacctgcccaccctgcaggtgccaacgcacctcggagtcgccgactggacgcagatgcatgacccgtttcagctgcgcagcccgtggcatgaccacctcttcttctctcccttagccacctgctatactgaaatctgaactttgaattgaggaaggtgca

SEQ ID NO: 43237 - DNA, 564 bp, Zea mays
  Clone ID: LIB3062-054-P1-K6-E11
gaagggacctgaggttcaatgttgtgattatttggcatcccaatgaaggcaaagttgataagcagcagattctctcagatcgctgtttctgcattaagtaatttatctgtatgcttgtgagatttggcaccgttcttctgtgcctccagttttttgtatactgtgtcaatctcagactgcatgcaaaaagactctggattagaaatactcaaaagcaacaagaaaggccaagaaatcagtgactgaagcggatcaagagtcttaaatgccttcctcacctggtaatagttcagcatattctttcttcttttcttcgtttttgcagtcaccaaatccctttcaatgtcaaaaggtacagggtccaacactatgcctttgatgtattcaaaacctcatagctgatttgtggcatgcaacgagggttaccatatatagaattatagatccaaaatacagtgaaagtttgaaacacaaggagtctacaaaactaagcttattccctctttgtgtttcttatacaaaacaaaaaacacattcaataatacattatgatactttaagttg

SEQ ID NO: 43238 - DNA, 408 bp, Zea mays
  Clone ID: LIB3062-054-P1-K6-E12
cccgggcgcttcttcttctttctatatacatatatagacctaataagaacaaagacgtacgatagataacctgcttattttgcgacccatcccattcccacgcaaaggcaccgagcgtgatctccgtccgtgccgccatggcctcgcaccgggcgctgctgctgctgctcctcgccgccgcgctcgtcgctgcgctggccgctgtcgcatccgccgacgacgccaacgccaagcccaccatcctgacccccgtggcgcataccccgctggggtccttcgacggcgacaagccggcctctgacgacgacgccgtcgacgacgacgaggacgccgcccctgtcggcgcgcccaacggggccaccatgactgagcccagggacgacgtccccgtctcgcccgtcgccaaag

SEQ ID NO: 43239 - DNA, 574 bp, Zea mays
  Clone ID: LIB3062-054-P1-K6-E5
cacagaatattagaagcattagttagaagtgcagcaacgtttattgagaccaaacaacaagaagacggttcatggttaggtaattggggtatatgtttcacctacggggccttcttttcgattaaaggtttagtcgcttctggaagaacgtacaagaacagcccttgcatacggaaagcatgccacttcatattgtcgaagcagcttcagtactggtggatggggagaaagccatatcgctattgaaactcaggtgtatgtaaatctcaaaggtgaccgtgctcacgctgtgaataccgcctgggcaatgctcgctttaatttatgctggacagtttgaacgagatccaacgccattacatcgtgctgcaaaggaattgatcaacatgcaactggagacaggagagtttcctcagcaagagcatgtaggatgcttcaactgcagcctctacttcaattacccaagctaccgcaacttgttccccatctgggctctcggtgagtaccatcgtggccttcgtgcaagaaagacaagtgagtccgtgtgtctatatatatatatagagagagagaga

SEQ ID NO: 43240 - DNA, 265 bp, Zea mays
  Clone ID: LIB3062-054-P1-K6-E6
gaaacgtacagcacgggcgcgagggttctttccatagagaataatatacagattattcgcccaaagagacgtatgttatatatatgagttgtatgcagtcaccgaactggtacaggcttccgctttccatttcctgttgggagtcgtgtagtgtaatcctggggtgtgtatttgttgcatcaatcatgccagccgatttgaatctcgtttcaccagcatgatctgatttgggtatacaagtataaaccgcaacgagcgatcttgt

SEQ ID NO: 43241 - DNA, 663 bp, Zea mays
  unsure at all n locations
  Clone ID: LIB3062-054-P1-K6-E7
ggacttctcgccgcagtggtgggacctcatcaccaccaccgcctggttccgcgaccactggtcccgcgagcacgcccacctggatgagatagccgagcagctcgagttggtcgccctccttgcctacgatgaggatgaggacctcttctacggcgagcaggcccccgccgccgccgccgcccttaagacagattcggtgctcaaggcgctgaacttgggctccccgaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctgcctctctagcagcatctgctactggctgcagctgccgtcggcgtcgtggtctgtctgtcaaagtcgaagtaaaaaaacgtgagtagttgtactactgtagaagtttcttttgtatagcatgcacgtaagaaatgaccaaaaaatataacaagaatgcagctgntagtttactgctgctctcctcgtgtgtctagggtgcacttctgtaagcaaacgtatatgatgtgtaatggcagacagcttaatgttacaactagctcttctact

SEQ ID NO: 43242 - DNA, 517 bp, Zea mays
  Clone ID: LIB3062-054-P1-K6-E8
atcggatctagcagaattctctcaacctcatcggcggcggcgaagagcgtgcggatcggagatggcgacaagcgggtggaggaggagagcggcggcgcgggcctcctggagccacaccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggggatgggaggggtggtgaatctatctatggcatgaagtttgctgatgagaacttcaagatcaagcacactggaccaggccttctgtccatggccaatgct

SEQ ID NO: 43243 - DNA, 561 bp, Zea mays
  Clone ID: LIB3062-054-P1-K6-E9
agttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccctactggttctctgccatgaccatgaagagtgttggaagcgccgccctgaagatggtggaggaggtccgcaggcagttcaacaccattcctgggttgatggagggaacagccaagcccgactacgcaacctgtgtgaagatctccactgatgcttccatcaaggagatgattcctcccggcgctctggtcatgctgactcccctcatcgttggaaccctcttcggcgtcgagactctctccggtgttcttgc

SEQ ID NO: 43244 - DNA, 266 bp, Zea mays
  Clone ID: LIB3062-054-P1-K6-F12
ctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggaggaggtggtggtgggtatggcg

SEQ ID NO: 43245 - DNA, 606 bp, Zea mays
  Clone ID: LIB3062-054-P1-K6-F2
cagagattggcgtcttcgtactcgcctacctccgcggctcaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcact

SEQ ID NO: 43246 - DNA, 652 bp, Zea mays
  unsure at all n locations
  Clone ID: LIB3062-054-P1-K6-F3
cccgggtcctaggccagcaaaccccctctgtaccctccgggcaatcgggcatgaatccacccatccgcgatgctacatggagctcagcaagcctcggcgtcgtcgaccgcaggcccgcgccccaagagcactgctatcctgcagtctgatcagccacctcgcgccgccgccgcgcgggaggggggccgcggcggcacgggtccggagtcgcttgtgcgcggctcggtcgtcgcgccgtgcgtcagctgcggcatctgcggcggactcctccgtgacgccaccgccttcaccgagtgcctacacgccttttgcaggaaatgcatatatgacaaggttgcgaaagacaacataaagtgttgcccgaagtgtggcatttttatgggaaatccgttggagaagctcagacctgatcatagcctggaacacatcaggccactgatatttcctgctaagaggcgcaaggttgtcaccatgaagaagaggaaggaaagggtgtcctctgaatcaacccttccttcagtggtgggtaccactgcagaagaaagcactgcactgatacctgctgcttcagaaagtaaggcacaaaaggatcttactcctgtcggaagagatgctntgtcacgaattaggggtcgagactttgactcagcat

SEQ ID NO: 43247 - DNA, 618 bp, Zea mays
  Clone ID: LIB3062-054-P1-K6-F7
cagcggctccccgttcctcttcctcgtccgcctccaacgaccaccatccatcgccatggctggccccaccaccacgctcctcctcctgctgctgtgctccgccgcgctcgcgtccggcgccacggcggccgacgacagcggattcacgaccttcaaggtgttcttccacgacatcgtggcggggacgagcccgacggccatccgcatcgcgcaggggggcggcgtccaacacctcgtccaccagcttcggcgcgatggtggccatcgacgacccgctgacgacaggccccacgcgcgccgcgggcaccgaggtgggccgcgcccagggcacctacacgtttgcggaccagcagacgttcggcctcctcatggtgatggacttcgtgttcacggccggggagcacaagggcagcacgctctccatcctcggccgcaacgaggtactcagcgacgtccgcgagatgagcatcgtcggcggcagcggaaagttccgcatggcgcgcgggtacgtccaggcgcacaccatcgactccggcttcaaatccggcgagaccgtcgtccagtacaccgtcaacgtcagggcctagctacccgctcgatctaccttgcttgctcctc

SEQ ID NO: 43248 - DNA, 334 bp, Zea mays
  Clone ID: LIB3062-054-P1-K6-G10
acttttcctatcttggttgttgcctgatactgcattttcttaccataagttgtaacctcgtttcttgcggtttggtgtaggacacgacttttctgttaataatgttgtggcttgaactttccaggctgtggagattggtgaaaactcagcgctgatatcatttgttacttttctgtttcttgtcatgcttcttgtgttgactgctgagcatggttagctggtgtgttgccttttgaggtgtcacttgcttttgtatcaggatgcttacaatttaatggaaattactgtgtagtagcaactaaaatcaacaatcaaatcatatcttaaaatattg

SEQ ID NO: 43249 - DNA, 448 bp, Zea mays
  Clone ID: LIB3062-054-P1-K6-G11
gctcatgctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgtcccgcccctcgtcgtttacttccttggtttcggttcattaggtagatcgggtcttagcgtccgtctcttcgcctctacgctgagactgtttgtttggg

SEQ ID NO: 43250 - DNA, 647 bp, Zea mays
  Clone ID: LIB3062-054-P1-K6-G2
tgttcctgctcctcatactgctgacgtcattggtgaagaattgtatgagtcattggttgaatggaatcttgatgagaaaatatcttctgtgactcttgacaactgcacaactaatgatgcgaaggccaacaagcatggggctcaaatctgagctagaccggtacttggatgaagaaatggtgaacatgcaaaccaaaaacttcaatgttttagattggtagaaggtagctggaactcggtttcctattttaagaaggattgcaagagacatatatgttatccctgttacaactgttgcttcagaagctgctttcagcactagtggtagagtacttagtgagcatcgcagtaggcttacttcaaagatgttggaggctctcatgtgctctcaagattggcttaggaacaaatacaaagttgatgagaaaactaaacaacctgccaccttttggtcctgtctccaagacatgcaagagggcctccaggaacttgcactttgacattttcatttcaaggatttaggtggcgttaatcttttggctgttgacatgtagtgaacaagtcaagtacaagtagcaattgacaagatcacaagaaccttttggctctcatgaacacttgatatggatcttttggttctcatgttt

SEQ ID NO: 43251 - DNA, 554 bp, Zea mays
  Clone ID: LIB3062-054-P1-K6-G3
gcccggtaggagggggagcaagcagcagccgtcggtggaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctagcagcagtagctgagaccataaagactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaggccgtggtctggtgattgctccaaaggactactccaccaagtaccgttactaagaaggcaggcattccccttatgcaatctattggggatgtttacacggacagttagtcggacaggtgatccctaactggatcttggc

SEQ ID NO: 43252 - DNA, 650 bp, Zea mays
  unsure at all n locations
  Clone ID: LIB3062-054-P1-K6-G4
gaactgtgagatcgagagaaataataaaaaaaaatccgtcttcttgtggtcttctccaaaccctagcgcccccggccccggtctccgcccccccgccttcgccgtcgcggtcgcgccccatggcggggaagtcgcgaccgcccaagcggatcctcgagtcctataccatcaagggttcggacagagtcatcaagcctggcgattgcgtgctaatgagggcatctgatgcatcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtcaatgctgaggatttcttctgccgcttcgagtataaatcagctactggcagctntgtaccagatcgtatagcagtgttttgcaagtgcgagatgccatacaatccagatgaccttatgatccaatgcgaagaatgttctgactggtttcacccttcttgcattgggatgacaatcaaagaa

SEQ ID NO: 43253 - DNA, 658 bp, Zea mays
  Clone ID: LIB3062-054-P1-K6-G5
gtgggcgactcagtcaacaggaaccaatgggtctctctcgtgtgcatggtggaggcctcaatacctgacgacaggctcaagatacgcaccttcaatggctcactcatctccttcaaggcattggaatacaacgcaacgatagatttctactggtcaccactactggtggagtctaacagcgacaaccccattatccaccgggtggagtaccggatcataagggcagacagaattgagaagcatgccagtgtctggagggatgccgacatcattgtcttcaattcttacctgtggtggaggaagcagaaggatgacatgaggatgaaggtcatgtatggttcgttcgaagatggtgatgcaaagttagacgagatggaaatggtcgatggtttcgagatagctctcaagaaactaaccgaatggctgggggagaatattgacaagaacaagactaggatattttttgcaggatcgtcaccaacacattcctgggctagcaactggggtggagaagacaagaacaagtgccttaacgaaacagagccgatctacaaaaccggatacaaagctgcaactacagactacagcttgatggccaaagctaagcactactttcgaacattggagccgaaaggcatacatgttcagatactgaaca

SEQ ID NO: 43254 - DNA, 644 bp, Zea mays
  Clone ID: LIB3062-054-P1-K6-G9
ggcgactacgggtaggccaccgccgccggcgccgtcccactacgacaagtgctgaggccttttcgctttcttcgccggcgacgagcacccaccaactaaggtcatggaagagatgatagatctaacgggggatggaggtgttcttaagacagtagtgcggaaagcaaaagatgatgctatagcgccatccgagagcctgcccttggttgatgttcattacgaaggtacacttgctgagactggtgaagttttcgataccacccatgaagataactctattttctcatttgaaattggacaaggcgctgtcatcaaagcatgggatatagccttaagactatgaaggttggcgaggttgcaaaaattacatgcaagtcagaatatgcatatggagctgcaggctcgccaccagagatacctcctaatgcaacccttatttttgaggtggagctagtagcttgcaggccgaggaaaggttcaagcttaggcagtgtatctgatgagaaagccagacttgaagaacttaagaagcaacgggagctagctgctgctaccaaagaagaggagaaaaagaagagggaggaagcgaaggccgcggcagcagcccgggtgcaagcaaagcttgatgcccagaggggaagggg

SEQ ID NO: 43255 - DNA, 500 bp, Zea mays
  Clone ID: LIB3062-054-P1-K6-H1
aacgactgcgagtgaacatgggacttaaaaacctgcgtgacagagtgaaacagcaccaagaaaaagtaggggagaagtggagcacggttgcaaaactccaggaagagtgggtggaaaatgcagaccgctgggtggctggtttcttagagaagtttgaggaagggtgccactcaatggggacagccatcaaggagaggatccaggagaggctcatcaaggcacaatccagcgactttggcagcctcctacagtacgacagctacgattctgatgaagccaaagaaaacgacgaggacgaagacgaagatgaactctttgaagacgtcaaggaatagcacctccgtacatatacaatggttttgtagctgcaaattgtgttgtgagtcagttgcctctctctggttggtgatctttatatatggtctcaaaggtaggtcaggttgcaatgtttgtagctgctcttggtgtttgttcaggcaacgcatggttgtaaaagctgt

SEQ ID NO: 43256 - DNA, 628 bp, Zea mays
  Clone ID: LIB3062-054-P1-K6-H10
ggcgacgacgggtaggccaccgccgccggcgccgtcccactacgacaagtgctgaggccttttcgctttcttcgccggcgacgagcacccaccaactaaggtcatggaagagatgatagatctaacgggggatggaggtgttcttaagacagtagtgcggaaagcaaaagatgatgctatagcgccatccgagagcctgcccttggttgatgttcattacgaaggtacacttgctgagactggtgaagttttcgataccacccatgaagataactctattttctcatttgaaattggacaaggcgctgtcatcaaagcatgggatatagccttaagactatgaaggttggcgaggttgcaaaaattacatgcaagtcagaatatgcatatggagctgcaggctcgccaccagagatacctcctaatgcaacccttatttttgaggtggagctagtagcttgcaggccgaggaaaggttcaagcttaggcagtgtatctgatgagaaagccagacttgtagaacttacgaagcaacgggagctagctgctgctaccaaagaagaggagaaaatgaagaggtaggaagcgatagccgcgtaagcagtctgggtgcaagcaaagcttgatg

SEQ ID NO: 43257 - DNA, 589 bp, Zea mays
  Clone ID: LIB3062-054-P1-K6-H11
agagcatgcttggcatcaagatcacctgctcgcaggagacggagcccctcgggaccgcaggcccgctggccctggcccgcgacaagctcgccgacggatccggcgaccctttcttcgtgctcaacagcgacgtgatcagcgagtacccgttcgccgagctcattgagttccacagggcccacggcggcgaggccacgatcatggtgaccaaggtcgacgagccgtccaagtacggcgtggtggtcatggaggagggcaccggcaaggtggagcggttcgtggagaagcccaaggcgttcgtgggcaacaagatcaacgccggcatctacctgctcaacccgtccgtgctcggccgcatcgagctgaagccgacgtccatcgagaaggaggtgttcccgcgcgtcgcggcggacggggccctcttcgccatggttctcccgggtttctggatggacatcgggcagccgagggactacatcacgggcctgcgcctgtacctggacttgctgcgggagaaggcgcccgtcatgctcgcgtaggtcgcgcacgtactgggcaacgtgctggtgcacgagaccgaggacatttg

SEQ ID NO: 43258 - DNA, 175 bp, Zea mays
  Clone ID: LIB3062-054-P1-K6-H12
ctagtaacaaggttggcgaaatattattttctggcctgactgcctatatatgttgtacgtgattggtatcgtaatattcattcgcttttgtgatacataattcattattggatcttcaattgtgatacataattcattattgataaatgcaaaggcgtcagcgttcttgtttgtt

SEQ ID NO: 43259 - DNA, 551 bp, Zea mays
  Clone ID: LIB3062-054-P1-K6-H2
gggaacggctgcgaaaactgcccgtttctagagatggacagagagcacgacacgtcgtcaactgcaccacccccaacttcactggaattatctctctgatggaccccagtaggagctgggcagcccgttggttgagaattggcaggttcattcctgggtgctatacacttgctgtctcggaggagcttccagaagagtatcaagggatttgtcaagacaacaacgtgcagtatgtgccgcccaagcgtgtctaagtatcaagacggcggcaatgatggtgtcttggtcctgaagcagtatagataattaggtagaagtatctgtgcttgccaagggaactgctcctcttatgctttgtatccgagtgctaaggcagtctatttcatgttagtgataaggctgtttatttaggtggtgaaccggcgggtgattgaatcttatccaataaccttgatgcctgttcttgaaatctgtgacaacgcggttcatgtgcttctgtcatgttctttcacatctatgtatatatgaagaaaatgtaatagctaaaggtc

SEQ ID NO: 43260 - DNA, 654 bp, Zea mays
  Clone ID: LIB3062-054-P1-K6-H3
cttcacttctcgttctctttcgccctccctccctccatccaaaaactgtagcagttgcatattatctctctctcttttttgtgtagatctgcctgcacatgttcactctggacttcttgaaccaagtggcaaacagccttgagaaggacagtgtataccatctagctgagaagaagatcccttccatccatgggttcacgacgggcctgaagcttgaacagtttatattcgacgccttcacatactccccgtccacggcacttttcgaggtcatgcgggaggaggaattcgcgccggtaaagaacgccagcggcgcaacgtatgacacccctgatagcgcgaagctcatgctgctccgcctccacagcagatgggtagtcgccgctggcggcttcttgacgcactctgtgcccttgtatatgacaggcgttgaagtttctccgctctcctcctacgccggagagaacctggaagcgatctgccgtgggcgaacgttccatgcgccgagcgagatctcgttttaggaggagcacttgtgtctggagtagcacttgtgtcatctgtaaaacgagtgtaaaggatgggcaggctgttgtgtactgcgtattgtagatgtaacatctcggacggacaccaattcatctcgagttttct

SEQ ID NO: 43261 - DNA, 428 bp, Zea mays
  Clone ID: LIB3062-054-P1-K6-H4
gggttgtcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtaaacgaggcccagtcccgcggcggccgtggaggcggcagaggaggcgggtacggtggtggccgaggaggcggacgctaccgcggcggtgggcgccgagatggc

SEQ ID NO: 43262 - DNA, 660 bp, Zea mays
  unsure at all n locations
  Clone ID: LIB3062-054-P1-K6-H5
cccgggctggacggaagcaatggggacactggagccaattcctatcatatgtaccctgcggatgtcagattgctaaaggaaataggcatggacgcgtacagattctccatctcttggtccagaatactgccgaagggaacgctcgaaggaggtattaatcaggccggcatcaagtactacaaaaagctcatcaacttattgatagagaacggaataaagccatttgtaacaatttttcattgggacgtccctcaagcactggaagacaagtacggtggctttttaggcgacaggattgtgtttgcaatttttttagaaaggattacacagacttcgctaaggtgtgctttgagaacttcggtgacaaggtgaagaattggttgacctttaacgagccacagacatttacaaccttttcgtacggaacgggagtttttgcccctggacggtgctcaccaggagaaaaatgtgctcagcctattgctaactcactcaccgaaccatacattgctggccacaacatccttcgagcccacgctatgactgttgacctctacaacaagaattacaagggtacagacggccgcattgggcttgcgtttgacgtaatgngtcgcgtgccatatggaaatacatttctcgatgaaacagcccaggaaa

SEQ ID NO: 43263 - DNA, 709 bp, Zea mays
  unsure at all n locations
  Clone ID: LIB3062-054-P1-K6-H6
ctgcagttccgggccggcttcccggggtggccaagatgttaaggtttctgttgaactatcattcatggaagctgtccaaggttgcagaaaaaccattacgtacgaagctgatactttttgtggaacttgcaatggaagtggcgtcccccctggaactgtgcctaaaacatgtaaaacatgtcgaggctctggtgtgatatacatgcagaagggtatatttactgtcgaatgtacttgctccctgtgcaatgggagcgggaaaattgtcaagagtttttgcaagacttgcaaaggagaacaggtagtgaaggggaaaacgtcagtcaagctagacatagccgcaggaagtgacgataatgacatcatgaaggtttttggtaagggtggtgcagatgttgaccgaactaagcctggtgacctttatgttactatcaaggtcagagaggaccctacttttcgaagagaaggcatccatgtgcatgttgattctgttttaagcattgctcaggctgtcctaggtggaactgtcacggtaccaaccctcactggaaatgttacagtcaaggttcgtcaaggtacccagcctggagagaaagtggtcctacggggcanaggaataaaagcgaggaactcgccagtgtttgggaatcagtatgtacacttcaatatcagggttccgaccgaggtgacgcaaaggcagagggagctg

SEQ ID NO: 43264 - DNA, 556 bp, Zea mays
  Clone ID: LIB3062-054-P1-K6-H8
cagatgtctaactggttgcaagggtgtggagtttgagtttcaagtggagaattctttgccagaaaggatcattggtgatgagaagagagtcttccatattgtcctgcacatggtaggcactctaacagaccgatgtaatgctggctgtatctcattatatgtaaatgtccataatgaggttgaagataggcataatcatgactggatgctgcgaagagcaaacttctctgggggctatgtatgtgtgaaatttgagattaggattagaaaatcaaagggctatctgttgagttcatcaagcagtcagataagtcagggatccaaacccaacaattctgagatgggacttagcttcaatatgtgcaagaagattgtgcagatgatgaatggcaatatttggtcagtatcagattctaaaagcatcggagaaactatcatgctagtcctccagttccagttggaacctgtgacttcggtctctggagcgtactcagatttgtacagatcatccgcaatttccaactttaatgggctcagagttctacttgcggacagt

SEQ ID NO: 43265 - DNA, 549 bp, Zea mays
  Clone ID: LIB3062-054-P1-K6-H9
ggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcggaggagcttccagaagagtatcaagggatttgtcaagacaacaacgtgcagtatgtgccgcccaagcgtgtctaagtatcaagacggcggcaatgatggtgtcttggtcctgaagcagtatagataattaggtagaagtatctgtgcttgccaagggaactgctcctcttatgctttgtatccgagtgctaaggcagtctatttcatgttagtgataaggctgtttatttaggtggtgaaccggcggttgattgaatcttatccaataaccttgatgcctgttcttgaaatctgtgacaacgcgggtcatgtgcttctgtcatgttctttcacatctatgtatatttgaagaaaatgtaatagctaaa

SEQ ID NO: 43266 - DNA, 185 bp, Zea mays
  Clone ID: LIB3062-055-P1-K6-A1
tgctgtgacaaccacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtg

SEQ ID NO: 43267 - DNA, 574 bp, Zea mays
  unsure at all n locations
  Clone ID: LIB3062-055-P1-K6-A12
gggcgccaggcgccagccgccagccgcagcccgcaggggcgctagcagacgagcagagcaggctagcagcactgcagcagtaccgcagcggcgcagcgcagtccgcagccggccagccgcagcccgcaggcaggggcggtaggcgcgccgcgcgcgtagccgccaggcgccaccggggggggggcagggcacgagcagcgagcagcgggcagcggccagccggccaccggccaggccagcgacgcgcacgcgccgacgcccactccactcgaccaggcccagngaccagccgnccagccgccagcgngctgnactgctgnttcactgttccagttccaggcttccaggtttcaggcaagcgtgaggagagtggagatcatcccgatgatgatgcgaggtggaaggctcacgggtttgacctctcaggttctgaggggcttcatcacggaaatatttggtagcagattatcattctttacgacagaggaagaattcaaagatattttttcaccatttggcaccgtanaagaagctcgacttatgagagaccaccaaactggatgggagaaaggat

SEQ ID NO: 43268 - DNA, 86 bp, Zea mays
  Clone ID: LIB3062-055-P1-K6-A2
ggtcgaccagctccgagaaaacccacccttccccacaaggctccgtcccttcggcggcggcggcgatgtctctcccccctggcccg

SEQ ID NO: 43269 - DNA, 69 bp, Zea mays
  unsure at all n locations
  Clone ID: LIB3062-055-P1-K6-A3
cgccgccgtatcaaacgcactctcctncgccgccgcccgaggcaagatggttctccagaacgacatcga

SEQ ID NO: 43270 - DNA, 318 bp, Zea mays
  Clone ID: LIB3062-055-P1-K6-A4
cccagatgtgcctgccaacacgccgacgggctcagccaagtcccccgcgggacgcgtcaccgccgccggaggcctcgtcgccctcgccgcgctacccgtcgccgtcgcggccgggatcatgttctagagcatctaccggtcgtcttagactttgtgatttcttcgtcatcattcttgttacagcacacacatgtttgtgcattatggtactagttcgttaattcacgtacaaacagctagctgttccaggcacgagattcttccggatttgtttccttgtaataattccccttgatgagcgtgtgtttggtatgtttc

SEQ ID NO: 43271 - DNA, 493 bp, Zea mays
  unsure at all n locations
  Clone ID: LIB3062-055-P1-K6-A5
ccatcttcgggtccaagtcttctagctaagtctctagctcttacgggaccaagcggcaggcccgcccagcatccgcgtcgaccgcgcgcgcacactgcagtacgccggccgcgcgcacttgacgctgacaatgccggcggactccgacgacgtcgccagcccggcgtcgacgctgggcagcgtgcacaagaggggcgggggcgggggcgggggtgggaaaagcggcgggcacggaggcgggcggcggcgtccgggcccggcgtaccgcggcgtgcggatgcgggcgtgggggaagtgggtgtcggagatccgcgagccgcgcaagaagtcgcgcatctggctcggcaccttcccgacggccgagatggcggcgcgcgcccacgacgccgncgcgctggtcgtcaagggccgcggtgcggtgctcaacttccccgagatggcggcgcgcctgccgggcccggccttcgccgcgcctggggacgtgcaggccgcg

SEQ ID NO: 43272 - DNA, 385 bp, Zea mays
  Clone ID: LIB3062-055-P1-K6-A8
cttggatctatggcttctgcagtacagaagcgcgatgtgacaaaacacctcgctgaaacatggctaaaagtaatgctgtgcatgctgacggaggcagactggcaaaggaggcaatttgtaccaacagttgaggaatacatggcaaatgcagtttcctccttggcactggcggtcattatacttccagcgcagtattttcttggcgaaacgctctcagattacatggtcaaagatcatgaatacagcaatttgtctgagctcatgttcacttgcagtcgtctcttaaatgacattcgaagcgttgagagggagttcgaagctggtaaactgaacagcgtttcactgcttgctctacacagtggtggttccatgtccatagaagcgg

SEQ ID NO: 43273 - DNA, 468 bp, Zea mays
  Clone ID: LIB3062-055-P1-K6-B1
agcagaatctctgcaggttgattgagccctactcaagggtggagattgcacatatagcggagatgattgaattgccgattgaccatgttgagaagaagctgtcgcagatgatccttgacaagaaatttgctgggacactagatcaaggtgctggctgcctcattatctttgaggattctaagacggaggatatcttccctgccactctcgaaaccatttcgaatgtcgggaaggttgtggacagcctttatgtgaggtcggccaagatcatggcttgaaagcagctagtcttacctgtttgctctgatttcatttccagtctgtcgatgtcctcagacatttattccttcaatattgacagtttattgtgaccgctacaggttcatgtgaccaaaggctagctatttttacgactgaatgagttatgcatgtattggtcttttaatatcagcgtgcagagtcggacgg

SEQ ID NO: 43274 - DNA, 630 bp, Zea mays
  unsure at all n locations
  Clone ID: LIB3062-055-P1-K6-B12
gttgccgagtttgttgatcctcaggaagtgaagctcaaggtggaccctcctcccccgccagctgctcctgttcctgttagcccagctgctgccacaagggcacctcctgttcaacagactcagacaaatcaaagtgtgccacgccaggctgctacaccaaaggaggaactgccacctccaccacctccccttgctaagccccctatggctgacctgacgcctctaggaagagagaggcttccacccactccaaataagccggagcctcctgttgtgacacttgacgatctctttaagaagacacagtcctctccgaggatctattatcttcctttatcagaagaggaggtggcagccaagctcgccgcacagggcaaaggaaaaaaaggataggaggtgttagcttccattttcggctagcttggagtttgttgcggaacatggcgtgcggtggtcacagcagctgacacgtgctactgctgtggcgaaagagttgtagccttgtagggctgttctgtggaaaaaggacactagtgtaggagcagcagcttgtatttcctaatgagattgttagttntgattgggtctccgagtagagtgtgtgctgaagttatttgatctacatgaagt

SEQ ID NO: 43275 - DNA, 641 bp, Zea mays
  unsure at all n locations
  Clone ID: LIB3062-055-P1-K6-B4
gccctatgcaagcagcaagcgcacacgtaaacgtacacctacctcggcgagcaaaagggaaaacgctgatcggagcaacgaagcccgcagccatgccgacggcgacggccacggccacggcagctcctcgccacgcggcgctcttcctgcccctgctgctgctcctgctcggcctccacgccacgtccgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcggcggcgggtggggcggcggctacggcgggcccggcggcgggtacgcccgcggcggcgtggtggcgcccaccgtgacgtgctccgagaaggggccctgctacaggaagaaggtcacctgccccaagaagtgcttctcctcgtacagcggcgccggcaagggatacggcggcggcggcggcggcggcagctgcaccgtcgactgcaaggtcaagtgcacggcctactgttgattcgactcgtccgctgctggcgcgtagcggtntggcagtgggcggtgctag

SEQ ID NO: 43276 - DNA, 327 bp, Zea mays
  unsure at all n locations
  Clone ID: LIB3062-055-P1-K6-B6
gattcctcttgtcgcctctctagtgtccgagatcatcgccgcctacctcatgccccccatcgagtctggctcggttgatttcgccgaatttgagccccggctcgtttactgattctgtacaaagatttatccttgagttanttcaccctgaaagacaagctgctggtgctttctgccgaaggggccttggatgaatggtgaaaaccgctggatggttagaggatctacatcttcttgtgttcttctgtaaaatactgagacttgggcagcataaaaagcttggcaaatttctgttgtgtggcatctncatgtaagtaacagtggact

SEQ ID NO: 43277 - DNA, 652 bp, Zea mays
  Clone ID: LIB3062-055-P1-K6-B7
atttccatcttcatctgactctggatcctctgggaatgtgataattgacttctactggggtatggagctgtaccctcggattggcaagtactttgatatcaaagtcttcaccaactgtcgtttcggtatgatgtcctgggctgttcttgccgtaacctattgcataaagcagtatgaaatgaatggcagagttgctgattctatgcttgtgaatactgcacttatgttgatctatatcactaagttcttttggtgggaatctggatattggtgtactatggacattgctcatgatagagctggtttctatatctgctggggatgcttggtatgggttccatccatatatacttcccctggaatgtaccttgtaaaccaccctttgaatttgggcccccagctagcactctcaattcttctagctggaatgttgtgcatatacataaactatgattgtgaccgtcagcgccaagaatttcgacggacgaatgggaaatgctcggtctggggcaaggctccatctaagattgttgcctcttatcagactacaaagggagaaactaaaaccagtcttctcttgacttctggatggtggggcttgtcacgtcactttccatatgtcccagagatactatctgcatttttctggact

SEQ ID NO: 43278 - DNA, 636 bp, Zea mays
  Clone ID: LIB3062-055-P1-K6-C12
caagccatatgaaagcaacaataattgattaattaattcgcctaacttctctctatatatattgtcaagccagcacaagaatttgaatggccgaaacaaaaatcggagaacaagtgttaagaaggctactctagatcctatgatcaaaagttataatggaatctcaaaaggtgaagaagaaggtagcagacggaaggaggaaattttcaactttccttttttactcccccgatcgatcgagttcgccagctgatcgatctctcgctcacagatcgagatccaaggacgagtgcgcttctctcttggaggaagacgatgacgacggcgacgaggctgcagatgactcggcgccgcgttgaggcgattcgaagaacctcaacggccccggcctttgccatcccggtgtcctcagcgacaatgcgttggcatcttggcttgactccgcacttgtgcctgattgcgggttgtcgaggttgaccccaaacaggcggacgcgcttcgacgctgccgttgggctgttgacgagcggtaccgagtcgagaagcatgggcacgctggccgtgggcggcgcggggctgggttgcaccaacataatgctgtgcaaaggcgggtgcgggggcggcggcggctgctgct

SEQ ID NO: 43279 - DNA, 506 bp, Zea mays
  Clone ID: LIB3062-055-P1-K6-C2
gaagcttcaaaaccatcaagctggtttagaagttcaagcatggtacgctgcacatcaatatcatggatgtccggatcagactgaatactaacagactcaatcgagtcaaggccatgcataaagatcttggatggcgcgtgtgaatgcgtcacatgacgaatagtagctgatccatgagcgtgcctcatctaatagtacgtggtggaccaatgtcataaccgaaatcaatggatgtaggtgcagtccacgtgataagcaaatctgcgtgcgatctatataatatcatgtgtctgacggagcatacacgatgacaccctgtggctgtgcaatatgatagctatatgctagatctgagtgtacgatgggaagctgaatgaccggtcaagatctatgaaagttgataaggcaggtgcttctacatatgatatgatgggtggcgaagatcatcaactttaatggaactgaccagtggttgaactttgatcgaacagatcagactgtgcata

SEQ ID NO: 43280 - DNA, 610 bp, Zea mays
  Clone ID: LIB3062-055-P1-K6-C4
gaaaaatccgccctcgtatcctcacgcccacaaaacacccgaagaaaagaagagactgaacgccgcgagttcacgtgacgatggagaacgccgcctccgccatcgctaagccgtcgctgtccaagaagccctcgccgtcgttccgcctccggaacggcagcctcaacgcactgcgcctgcgccgcgtgttcgacctcttcgaccgcaacggcgacggcgagatcaccctcgacgagatggcctcggcgctcgacgcgctcggcctcggcgccgaccgctccggcctggaggccgcggttggcgggtacatcccggccggcgccgcggggctccgcttcgacgacttcgaatccctccaccgcgcgctcggggacgcgctgttcggccccatgccggtggctgtgaccgaggacgacgacgacgagggggacatgaaggaggcgttccgggtgttcgatgaggacggcgacggcttcatctcggccgccgagctgcaggccgtgctcaagaagctcggcctgcccgaggctcggaacctggccactggtgcaggagatgatctgcaacgtcgaccgcaactgcgacgggcgcgtcgacttcggcgagttca

SEQ ID NO: 43281 - DNA, 602 bp, Zea mays
  Clone ID: LIB3062-055-P1-K6-C5
caagccatatgaaagcaacaataattgattaattaattcgcctaacttctctctatatatattgtcaagccagcacaagaatttgaatggccgaaacaaaaatcggagaacaagtgttaagaaggctactctagatcctatgatcaaaagttataatggaatctcaaaaggtgaagaagaaggtagcagacggaaggaggaaattttcaactttccttttttactcccccgatcgatcgagttcgccagctgatcgatctctcgctcacagatcgagatccaaggacgagtgcgcttctctcttggaggaagacgatgacgacggcgacgaggctgcagatgactcggcgccgcgttgaggcgattcgaagaacctcaacggccccggcctttgccatcccggtgtcctcagcgacaatgcgttggcatcttggcttgactccgcacttgtgcctgattgcgggttgtcgaggttgaccccaaacaggcggacgcgcttcgacgctgccgttgggctgttgacgagcggtaccgagtcgagaagcatgggcacgctggccgtgggcggcgcggggctgggttgcaccaacataatgctgtgc

SEQ ID NO: 43282 - DNA, 649 bp, Zea mays
  Clone ID: LIB3062-055-P1-K6-C6
caatggggttgcatattccaggcagcagcaagctgatggcttcccagcacctcgccaagttgatgaaagtatggtattttatgatgccccatctgattacaacttggtggatggaaaagatgacttcgtatatctgaacgacattctgaatgagccacttggaaatgaatcgctctttgatggagatgatatgatggcttactttgatgccacagagaatgatttcaagtatgacattttgggctctggtcagggtttggattatccacttgcagacatgccgttgaactttgcccaaaagagtgacaaggaagacaagtttacattcgaagggatctctgaggttccggaagcaaatcctcagtacggtgcatcctcatctggttcacatgaagatctgtatactgatactgaatttctaggtgtgccaacagatgacactgctgataaaacttacggaaatcgcctggccagcatgttaggctctatcccagctccacctgcaatggcctcagaattcccgccgtcaacagggaaatctgctgggatgctttcggctgtcagctcgagctcaattcgttttactgctggtatcatccaacttgatggcctcactttcagcagcggctccggtcagtggcccttgcaa

SEQ ID NO: 43283 - DNA, 254 bp, Zea mays
  unsure at all n locations
  Clone ID: LIB3062-055-P1-K6-C7
acgacaatcactgctacgctaacactcatantgcgttgctattcaaaggcgtcacttaatggtttggggtttgtttgctccaaagtacgtattcgatgcaatcggccttctcctcacagacttgttaatttgtttagcatcaatctactacagctgatgttgctttgctccttgagttgcactgctaaccactaacacaacaccgttattatgcttttgtgtgaatcggttgcagctagagatgcaattttttc

SEQ ID NO: 43284 - DNA, 654 bp, Zea mays
  Clone ID: LIB3062-055-P1-K6-C9
gccaatgacgtctgattcatgtgctcctttgattgcaacccttccattggaggcacgcggaaaaattggtgacttcattaaaggagtgtttgccgtcttcctagacttggatttctcatttcttgagatgaatccgttcaccatggtcaatggggagccatatcctctggacatgagaggagaactagatgacacagcagctttcaagaacttcaagaagtggggaggtatagaatttcctctaccttttggaagagtactcagccctacagaaagtttcatccatgaactagatgagaagacaagtgcctctctgaagttcacggttttgaacccgaaaggtcgcatctggaccatggtcgctggtggtggtgctagtgtcatttatgctgatacagttggagacttgggatatgcatcagagcttggaaactatgcagagtatagtggtgctcctaatgaggaggaggttctgaattattctagagttgttcttgattgtgcaactgctgatcctgatggccgcaagagagcccttctcattggaggtggcatagctaacttcactgatgttgctaccacattcaatggcatcatccgagccttaagggagaaggaatccaagttgaaggcttcaagaatgcacatttatgt

SEQ ID NO: 43285 - DNA, 146 bp, Zea mays
  Clone ID: LIB3062-055-P1-K6-D10
cagctcaacagtctgtgatcatggccgagagattaagctcggattagcagtggccagcaagatgagctggcggccggcgctcttcagtcgccggcgatgcaggcaacgccggccggttgattagaagattttgtgcacgtttcctg

SEQ ID NO: 43286 - DNA, 328 bp, Zea mays
  unsure at all n locations
  Clone ID: LIB3062-055-P1-K6-D11
ccgtaatgcgccggccgattgctgacaaggatgaccaagtcagtcaaggaatttggggtggttggctgttcgagaaaagcttcttcctgaacttccggctttcagccctgggatggaccccaaaaacctttgggccccccggatccaatcgcatggtaaaagctcgggtctgagcaatcgatgagggccgagtctgctgaggcccgaagctgagatgcctccgctggagggtgacgccggcgaaagcaagatggagggaggtcgactaagctntcggatcactggtcgttatccctaattacatatgataagctaaatcttgactact

SEQ ID NO: 43287 - DNA, 642 bp, Zea mays
  Clone ID: LIB3062-055-P1-K6-D12
cgcgcatgtgcttcttctatggatgaggttcctttcggaatcattgttcgctgtccaacctgcatgatagcagttgctgttgtgcagcctcaggatggaactcaggttgtttcctgttcaaagtgtcgatatcaatatgaattattttctggagacattacgagtattgaatccgaagaagttagcatggatatttcagccctggagaaagccttgagatttattaatatgaggaaagatggtattccagctgctgtccactctattgtgatccgctcaccttcaggaacagcacgtacttacagatttgctacccagaatgtaactcttcctgctcaagaaggagaaagggttaccatttccttggcggccccagttaacgtttaccgtgacatgggacccctcaaggttgctgcgcgctcacaaggatttaaacctggagaacctatgtgtctcactaatcacatcaatgggcaagtctcgaagttgctaagagctccatcaaagaacaagggaacatttttccttagcccatatttattggtcggtgctcttgccttccttgcatctacagatgctgcttccgcattcattgacccaagtcttcctagacttgttacagcaactgccattgcatcagct

SEQ ID NO: 43288 - DNA, 641 bp, Zea mays
  Clone ID: LIB3062-055-P1-K6-D2
cccgggttttgatgctgtttacgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctgttggatcaccttttcagagagagaaggcaagtgggtcatttcgaagaagccgaggagagggaacctggaatcaagaaaaccttcagctcttctgtgtag

SEQ ID NO: 43289 - DNA, 596 bp, Zea mays
  Clone ID: LIB3062-055-P1-K6-D3
gccacatgaaatttttggattgatctgtggcccatttgatgctacaatggaagataaaacctcttttgatgagtgcagccatggaaatgctgaggtgctgcaaatcatcactgatttacagaagaggactgaagcactggagaagaaactgattgggtcagacaaagaaatactttcattgagggaaatttttaaagactcaggaagaaaagtccagcaactggaatacattgtagatgagttacagttcaaacttgactcttccctggctcaccttggaaacatgtgcaatacactagccaccccatcaatattcctgattggtggttataatggcgtgacttggttatcatctcttgattccttttctcctgagaaagacgcggtcctaggtctcacaccaatgagttctccccgctcatatgcatctgctgctgtgttggatggacacatatttgcttttggcggtggcgatggcatgtcatggtataacacagtggaatgctatagctcaagaaataatgagtggacggaatgcccctccatgaaccagaaaaaggaagtctgctggggatctgtcttatgagaaatatacc

SEQ ID NO: 43290 - DNA, 547 bp, Zea mays
  Clone ID: LIB3062-055-P1-K6-D4
ggttcacgccctgcagttctgcaatctgctggcataacgtttccaaaagctatcatggttatgtatacctggaaatggaaaaaaattgagtctgtaagcagattgcgtcaagctttcactgcggttccgatatacgctagagctcaagacctctcacatttgttagatcttaagaaagcaggcgcaacagacgttgtcctggaaaatgccgagaccagcttgcagctaggttcaatacttttgaaaggactgggcgtcatgtctgatgatgtatccttcttgagtaagcttgtgagggactcaatggagctacaagctcaggaagcactgaaagacattggggaccaagaagttgatattatgaagcctcttcaggtaagagtgtcagatttagtggagagcaatggtaatagttcaagaatggtagccccagagcagtcgttaagtctaagtagccgcccagacataaaggcaataaaaccgccagtggccaatgggatacctgaattgaaggtggaaaatgataagacaggatacgattttgaca

SEQ ID NO: 43291 - DNA, 651 bp, Zea mays
  unsure at all n locations
  Clone ID: LIB3062-055-P1-K6-D8
cggttctcatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttcagggaggtgttcaagccagagactttcgcgccgggcgcctccatcctcttcacgcactcgcccgccggagtcctcaccgtcgccttctccaaggactcgtcggtgccggtggccggcggcgtggcgatcgagaacaagcgcctctgcgaggccgtgctggagtccatcatcggngagcgcggcgtgtcgccggccgcgaagctgagcctcgccgcgagggtg

SEQ ID NO: 43292 - DNA, 640 bp, Zea mays
  Clone ID: LIB3062-055-P1-K6-D9
agcgcacagccacacgcacagttgtgtgttgccgtgtagcagagcagctcgcgccatgtccctgtccgtcggcggcgcgcggacctctctcctcccttcttcgttcaccgcctcttcatcccgcccgcgcttcctcgcgcttcctctccaccgccgctcgcacggctccctcacctcgctgccggccgcgtgcaggcggcggctccgggtgcgcatggcccggacggagtccaccggcgtcaccatcggcttccgcgcgccggatttcgagctccctgagccactgactggaaagctctggacgttggatgacttcgagggcaactctgcactgcttgttatgttcatatgcaaccactgtccatttgtaaaacatctgaaaaaggacatcagcaagctcacctctttctatgtggagaaaggacttggtgctgttgccatatcgtccaactcagttaggacgcatccccaggatggcccagatcgcatggctgaagaagcagagctgttcaaatatcctttcccatatctttacgatgagtctcaagaggtagccaaggcttttggagcggtctgcacgccagagttctacttgttaaaaaggatggccggaggccttttgaacttttctacctggaca

SEQ ID NO: 43293 - DNA, 147 bp, Zea mays
  Clone ID: LIB3062-055-P1-K6-E1
cagctcaacaagtctgtgatcatggccgagagattaagctcggattagcagtggccagcaagatgagctggcggccggcgctcttcagtcgccggcgatgcaggcaacgccggccggttgattagaagattttgtgcacgtttcctg

SEQ ID NO: 43294 - DNA, 392 bp, Zea mays
  Clone ID: LIB3062-055-P1-K6-E10
tgtttcacacgctatgttgaatatcacaggtgtgtggctgcaaaaggtgaggatgcacctgagtgtgataagttcgccaagtactatcgatccctgtgcccaggtgaatgggttgatcgctggaacgagcaacgcgaaaacggcaccttccctggacctctgtaatcctacaatgcaaaagaagtatgaactcacgatgttgtgccggcttctcttccttggtaactggcgccaagttaccttttttggagctctctacagaataagaaatcccttttggcttgaagaatgccctgttgctcttcctaacggtcatgttgtgcgctgctgagaaactagcgtcacagttaacaattttctttatacagttcagaaaatgattcgtgattccc

SEQ ID NO: 43295 - DNA, 651 bp, Zea mays
  Clone ID: LIB3062-055-P1-K6-E12
agttcatgtgacttctgatgatgcaccgcgtgcaacagatgaacaaatcaagaaagcttcgaatatattcaaacgtattgatctgataaatttctctgcatgccaatttgctaacccagctttgcaaagacactatgggatcttggaggccttagctttaggcgaagatgagatgcctgatataaaggatgagaccctgcctgacgaagaaggcttgtctaagccaggggtagccaatgctattgaggaattcaagacttcagtctatggtgaaaattatgaccaagaggaggcagaagcggcagcagggaaagcttcccgtggtaatgcttcaaaaaagcggaaggaggtcactgatgcagctgcgcagataagtgctgcttatgactgggcagaacttgcagacaatggaaaactgaaggaaatgaccacggtggaattgagatcctacctgaccgcgcatgatctcccggtttctggtaagaaagaggtacttatcagcaggatcttgactcacctgggtaagtgaagccgggtatccgaactgttagtttcctgagacccgactgacatctgtagtgctgtctcgcggatccttgtggaccgtaatcctcccccgtgcaggctacgtgccgattttttgtatagcga

SEQ ID NO: 43296 - DNA, 632 bp, Zea mays
  unsure at all n locations
  Clone ID: LIB3062-055-P1-K6-E2
caaggtttcagacactgttgttgagccatacaatgcaacactgtcagtccatcagttggttgagaatgctgatgaatgcatggttcttgacaatgaggcactttacgacatttgcttccgaactctgaagcttacgacgcctagctttggagacctgaaccacttgatcagtgcaacaatgagtggagtgacttgctgcctccgcttccctggacagctgaactcggacctgcgcaagctcgcagtcaacctgattccgttccctcgcctgcacttctttatggtcggctttgcgccactcacctcgcgtggctcgcagcagtaccgtgctctcactgtccctgagctaacccagcagatgtgggatgccaagaacatgatgtgtgctgctgacccgcgtcatggccgctatctcacagcatctgccatgttccgtggaaagatgagcaccaaggaggtggacgagcaaatgatcaatgtccagaacaagaactcgtcctacttcgtggagtggatccccaacaatgtgaagtccagtgtttgtgatatcccgccacgcggcctctccatggcctncaccttcattggcaattccacctccatccaggagatgttcngncgtgtgagcgagc

SEQ ID NO: 43297 - DNA, 619 bp, Zea mays
  unsure at all n locations
  Clone ID: LIB3062-055-P1-K6-E3
cacagccttctggagctgcgatgacatgaacatatattactcttattccagtacctacagattcgagatacactatatttttctggtacatgctggaactaaaactgaaagttcatttaatatcgactgcactgcactgcactgcaaacttcccatccaaatgtttgccaatgacacatatgtcttcatccccaatggcagggtggcattcctcatcgcggaggcgtgcctgctggcaggatcagtgcgcaacgcgtaccacacccggtacaggggcatattctacggcgactcgctctcatgtgagacggtgcggaagggcgtcttcgcggctggtgcggccttcaccttcttcacggccatcctgggcgaggtgtactacctcagcttctccaagtcccgggacgccgccggtggtgccccctacggcggctccagcattggcatgggcccttacaactaactaatggccgcccccggtcgcttcatgctggaggaatgcagcagcagtgttctttttgacgttaccttagtagggacacggtgtaattggttattggatccgctgttttttgtttaggttcttgtatgaggttactacttggttgngctgtatact

SEQ ID NO: 43298 - DNA, 665 bp, Zea mays
  unsure at all n locations
  Clone ID: LIB3062-055-P1-K6-E5
cccggngtcgacctcacgcgtccggaagtgtagaggggntcggatcacaactttgatgaggaaacccaagggtactggagaatcaaaacatgaatacaacccgaagcgactgaaatctgctgatggcacaagggatcatcaggtgaattgatcataagcgtagcgtagctttcgttgtgttctgccgctgttctacgttttatgaaaacattcttacttcacatcacattgtcaataggttgtgaatgcagaagctcatcaggtgggctgccttgatgtgagtgacaaaaatagcgagaacttcagtgcatcgtcaaaagtgcttgctgcatcacttgatgttgaagctgggtctccctccggcgactgcaaggatcatggaccaaaaggataatgcaatgtccaccgagtgttttctggagttgactaacacacccacctggcgcgccgcaactgaatcagagataggaagtcaatcagtgcaagtttgtaagataagctagcttgcccgttattctggtttggaagtcaaaatagttcgttcaacttagcctaggcagttgacggttttgttgtgtttctgagggactctgatacgaaaatcaaattccctttgttctgtgtttggcgctgcaacctgtaaatggagtgctttttttttgcgt

SEQ ID NO: 43299 - DNA, 589 bp, Zea mays
  Clone ID: LIB3062-055-P1-K6-E6
gcgatataacttactcttttccatatactactatgagcagttataagaattatgagtcgctacagctaggaaggatttttaccagatcatggcaaactcatcactcctcacccaatcaaggtaaaaaaaaaggaagaagggagaacgaggaaagcaatagctcgaattatgtaactgacaatttagtgacggcaataatggcccgggcgggcggtcggccgcccgccgtggtctagcgccacgcggaggcgacggtcaccgcgcgccccatccaacagaaccggagcacgccgttctccgccttgactgtgaacccgggcggtacatggccgacgcgggcgccgaccagctcttcggcaatgctcgagccgagcgacaccgggcggaagcccgccatgccgaacctggcgcgccacttgccgaagacctcgcaccgctccagccggtcggggccatcccggccgaccgcgttcgccgccttcttcgacagggccgcctcggccctggccttctccgcaatctcccgcgccagcgtcgcgtccagcgactccaggatggcgcccgtaatgcgcgcacgcctcagtgaagc

SEQ ID NO: 43300 - DNA, 586 bp, Zea mays
  unsure at all n locations
  Clone ID: LIB3062-055-P1-K6-E7
gctcgccgctcgcgtctcgctcacgcgaacgcagcctccgtgcatatcaccagcctcctcgcgcacccggtcccgcttgcctctccccacctactcgccgtcgcggtgccgtacgccggtgctgtccagtctagggtttcggccctcgcccgccgatccgtcccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgcttgatccgaagatgtttcagcctctcatctgctagctntgatacacgagttatttgctattatgatattcatttg

SEQ ID NO: 43301 - DNA, 641 bp, Zea mays
  unsure at all n locations
  Clone ID: LIB3062-055-P1-K6-E9
ctgtcactcacacacacacagactcgtggtttccaaagccaactgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggngagtgag

SEQ ID NO: 43302 - DNA, 567 bp, Zea mays
  unsure at all n locations
  Clone ID: LIB3062-055-P1-K6-F1
ctctcgttccagggcgaggtctatgtgttcgactccgtctcccctgataaggtccaagccgtgcttttgctgcttggagggagggagctgagcagcctgggcggagcgtcgtcctctgcaccttatagtaagaggttgaattatccacatcgggtggcatctctgatgagatttagggaaaagcggaaggagcggaactttgataagaagatccgatactctgtccggaaggaagttgcacttaggatgcagcgtaatcgaggtcaatttacatcttcaaaaccaaagcctgatgaaatagcagcatcagaaatggcatccgcagatggctccccgaattgggcattagttgaaggccgacctccatctgctgccgaatgtcatcactgtggtactaatgcaacagctacaccaatgatgcgtcgcggacctgatggaccaagaacattatgcaatgcatgtggcctcatgtgggcaaataagggtctcctgagggacgtaacaaaatctcctgtacctctccaagctacgcaatcagctccgcatctagatnnggtggtaatggaa

SEQ ID NO: 43303 - DNA, 487 bp, Zea mays
  unsure at all n locations
  Clone ID: LIB3062-055-P1-K6-F2
ggttggtttgcgtttgttcgggcagctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctnggaggttaaactggcgaa

SEQ ID NO: 43304 - DNA, 542 bp, Zea mays
  unsure at all n locations
  Clone ID: LIB3062-055-P1-K6-F3
cccgggccaagttccgtcccctcatggctacggcggcgaaggcaagggctccgccggccgtgacggcttccaaagcggcggcggcagcggtggagctggaggagcacgtgcactacaagcacactgatgcgtgccaccaactccggtggacagccaaggaaagctatgagtacatgtacgcgcggccgtggagcagggtggtcgacttttatgccgagctcgtgcgcgccggcgccggcgcagcggggctcgccaaattatttgggaatgatgagaaagattacacactttatactgctggagaaaattatctaacaccatcagaaaaaccaacgacaactaccttctccaaaggtcgtggaggaagatgggaaagagtaacatttaaagttgttatttcataccatgggngggtcgttcgatggctggcagaaacagcctggccttaatactgttcaagggggttagtggagaaacatctcggacaatttggttgatgagcgaaaagctaaacagcttgaagcaaggatctttgccgatag

SEQ ID NO: 43305 - DNA, 623 bp, Zea mays
  Clone ID: LIB3062-055-P1-K6-F4
cgcaaattgaaagctcggagttgccctgcctcgagctcgaaggactttgtccagctcctcgcatattgtggcctggtgcagattggagatccgcccggacttggaccgagtcctcctgtctttggacattcattggagtgctccattcattgaggcagcatgcctaagataaagacaagccgtgtcaagtatcctgaaggatgggagcttattgaaccaacaatccgtgagttggatgccaaaatgagagaagctgaaaatgatccacatgatgggaagagaaagtgtgaagctctctggcctattttccgcatttctcatcaaaggagccgctacatatatgatctttactacagaaggaaggagatatcacaggagctttatgagttctgcctggaccagggttatgcagatcgtaacctgatcgcaaagtggaaaaagccaggttacgagcgcctttgttgcctccggtgcatacagacacgtgaccacaacttcgcaacgacatgcgtctgccgcgtccccaagcatctgagggaggaacaggtgatagaatgtgtccactgcggctgcaggggttgtgccagcggtgactaatcttgtcatcatgttgttgggctcac

SEQ ID NO: 43306 - DNA, 147 bp, Zea mays
  Clone ID: LIB3062-055-P1-K6-F5
acgtggttgacttggttggccacccgatgttttcttacaacgagtcatgaaccataccgtcccatcttttgttggaagattttactttggcaaataattttgtggcacgttatatgtaaagatggtacagttttagcttcattgtcc

SEQ ID NO: 43307 - DNA, 579 bp, Zea mays
  unsure at all n locations
  Clone ID: LIB3062-055-P1-K6-F6
cgcgcaggtgcttcttctatggatgaggttcctttcggaatcattgttcgctgtccaacctgcatgatagcagttgctgttgtgcagcctcaggatggaactcaggttgtttcctgttcaaagtgtcgatatcaatatgaattattttctggagacattacgagtattgaatccgaagaagttagcatggatatttcagccctggagaaagccttgagatttattaatatgaggaaagatggtattccagctgctgtccactctattgtgatccgctcaccttcaggaacagcacgtacttacagatttgctacccagaatgtaactcttcctgctcaagaaggagaaagggttaccatttccttggcggccccagttaacgtttaccgtgacatgggacccctcaaggttgctgcgcgctcacaaggatttaaacctggagaacctatgtgtctcactaatcacatcaatgggcaagtctcgaagttgctaagagctccatcaaagaacaagggaacattnttccttagcccatatttattggtcggtgctcttgccttccttgcatctacagatgct

SEQ ID NO: 43308 - DNA, 551 bp, Zea mays
  Clone ID: LIB3062-055-P1-K6-G1
gggctttcttctcctcccactcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctaccgaggcggtggcggctacggcggtcggcgcgagggtggtggtggcggctaccgcggcggcggcggcggctggagggactgatgtgt

SEQ ID NO: 43309 - DNA, 210 bp, Zea mays
  Clone ID: LIB3062-055-P1-K6-G11
cgcaagctatactactactactgctgctgtgtacatgtgcgtgtatgaactgtgtgtgtatggtctcaagtcactgtaattcgtggctgctttccagatcggtcagtgtgttttctcggtttgcttttggatctgatcatcaagttgttgtatcaccagccaccagggaccatgcccttttgctttgatctgcttcgccttttcagttcc

SEQ ID NO: 43310 - DNA, 270 bp, Zea mays
  Clone ID: LIB3062-055-P1-K6-G12
aggatatggatggccagccaaccagccgcggccaacgcaaggccagcgaccgtgcagatccgcgggcaacccgtcaaccagaagacgtcttgctgctcgtcctaagattgcctcatttccttggttccttgtgactatttctacggtttgtgcgcgcacgcaaatgtatttgcattattcctgatagcatctattcgttggccagatgattagagagctgaaaatatattaagaacaataccatagagagaagttcctcagtgctctcgc

SEQ ID NO: 43311 - DNA, 400 bp, Zea mays
  unsure at all n locations
  Clone ID: LIB3062-055-P1-K6-G3
cgttacccgnggggctgggtnngccccggncgtccggcgcgtgggtgtcccntgnttcagtcngcnnccgctgtgctgctggctngccctgntgngttcgtgtccgtccccctggcgtnntcntggcccttcggggcncttgtttctctgtggngggggggtggcgnnngntgtnctggttgcccgcctccgctcgctgggtgnncnnctgnnccgtgntgtcngcctggcggggncgnnngnngnnctggcgctccgtgtggcngngctgnngggggggcttggtgncccgnggcctnngcttggcnctggccgtcgttttcccccgtcgtggctgggnnnnccctggcgttnccccnctttntcgccttgccgcncctccccctttcgcccgctggcg

SEQ ID NO: 43312 - DNA, 630 bp, Zea mays
  Clone ID: LIB3062-055-P1-K6-G4
cacagtcttctggagctgcgatgacatgaacatatattactcttattccagtacctacagattcgagatacactatatttttctggtacatgctggaactaaaactgaaagttcatttaatatcgactgcactgcactgcactgcaaacttcccatccaaatgtttgccaatgacacatatgtcttcatccccaatggcagggtggcattcctcatcgcggaggcgtgcctgctggcaggatcagtgcgcaacgcgtaccacacccggtacaggggcatattctacggcgactcgctctcatgtgagacggtgcggaagggcgtcttcgcggctggtgcggccttcaccttcttcacggccatcctgggcgaggtgtactacctcagcttctccaagtcccgggacgccgccggtggtgccccctacggcggctccagcattggcatgggcccttacaactaactaatggccgcccccggtcgcttcatgctggaggaatgcagcagcagtgttctttttgacgttaccttagtagggacacggtgtaattgggtattggatccggctgtttttggttaaggtcttgtatgaaggtactacttggttgggcctgattactgttggatggt

SEQ ID NO: 43313 - DNA, 265 bp, Zea mays
  Clone ID: LIB3062-055-P1-K6-G5
ggcaattgaagataaaattgccaaagatggtctgattggaataggaattgcgacaactgcggtcggacttctggttggtggaattgcagctgctgttgccaggaagaagtgaggtcaatatattggatcggcagctcattgaactaggggagctcccgtctctgtaattccaacttttctgttgttaccttggtgatattacagttgaattgccactctttatatgtacgaagtaatcgtatgataatgataacaccattgtgac

SEQ ID NO: 43314 - DNA, 524 bp, Zea mays
  Clone ID: LIB3062-055-P1-K6-G7
gaagtgtgttcccctagaggacctagctgcagagttcaggatgcgaacccaggactgtatcaatcggattgttactctggaaagcatggataggttatctggtgtgatggatgaccgtgggaagttcatctacatctccactgaagagatgaaggcagttgcagagtacatcaggaagcaagggagagtgagcatatcacatctggccaacaactcaaaccagttcatcgatttggagccgaaggcccagtacgaggtggagagcctgcaggatgacagtgcagaagcaggcacagaagcatgagaattccttgtgacctggcaccatgtcatgtttccgcgctcaatgatgttttgtagtgtgacttaacatggtttgagttgggcactggccgtataatatatgcagtagtcggtataaacatacttgttctgacatgctagataccattaccccatgcagagaactcaggcttttgttctatcatcatgattgaaaatcatcggttgaccttggtggtgtt

SEQ ID NO: 43315 - DNA, 475 bp, Zea mays
  unsure at all n locations
  Clone ID: LIB3062-055-P1-K6-G8
gggtgaccaccggncgtccggcgcgtgggttgcccntgnttcagtcngcgccgcttgtgctgctggcttgcccttgtgngttcgtgtccgtccccctggcgtnntcttggcccttcggggccnttgtttctctgtggngggggggggggcgnnnngtgnncttgttgcccgcctccgctcgctgggtggccccctgnnccgtgntgtcngccttgccgggccggngggggncctggcgctccgtgtggcngngctgnnngnggggcttgttgncncggggcctttgcttggcnctggccggcgttttcccccgtcgtggctgggnnnnccctggcgttccccnnctttttcgccttgcngcncctcccccttttcgccgctggcgtnntngcgnnggggcccgccccgntcgcccttcccnccngttgcgccgcctgggtggcgnntggcgcctggtgcgggtttttctcctttc

SEQ ID NO: 43316 - DNA, 508 bp, Zea mays
  Clone ID: LIB3062-055-P1-K6-H1
gcgaggcatcctgcgtgtgagcgtgcgataaatagcggctccaggtccaggctgagggagagcgcgtctctggtgctctcgcaaccaccgtgcgcttgctttcctcctgctctactccgttgcacacttgtactaggcctggaggtcctgtagctcgcctggtgctgtgtcggagacggtggcaatggcattgcaggagcaggaggcggacggcgacgagggcggggaggaagacgacgaaggcgaggatgagcggatgacgggatacggtgtgggggagctgatatctgcttgtcccgaggcgtgctgtccgcttgcggcggtgtaggagtaagatattggcgcaataggctcaatcatttttttttttttgcttctctctttctctttttcccttttcttccttgtttgatgtggcgtgcttgttttatttttgttgcctttttttggttctgattgatgagaccaatgttgattatatgatgaagagttgattggtaagaacgct

SEQ ID NO: 43317 - DNA, 651 bp, Zea mays
  Clone ID: LIB3062-055-P1-K6-H3
ctccccgttctgcggaaccattgggcccccttggccttctgcgtatccttcaagctggagacggatccagacattctagttcagaaagcagagacggctctgagcaagtacaggatggacgttgttgtggccaatctgcttgcaacgtacaaggaggaggtcgtcatcatctcgaatggcaaaagcaacaccattcgaaggtgcagcaaaggcgaggatctggaggagcatatcatcaagctcctagagaagagccactccaagtatatttacagcagcacggaagggtgcagtaagaacgactacgaaaagcttataccgttaggcatcaaaagtctggcttaagggaaacattgatcggttctggagctcaaattaatagggaagccccatcagcactcttgtagtgtttggatggatggacgaggaaggatgaagagggatgggataggatcattctaagttgacccatgtttggtttggaggtctagagtcacggtcaaggaatatttttcaaaaatagtggatggggccatcccttaaaaaataagggacggagtcaactcagagttgatcccatcccatctctcgttgacaccgaaccaaacacatcataaagctctacatgcagtgtgtacatttgctggtaat

SEQ ID NO: 43318 - DNA, 55 bp, Zea mays
  Clone ID: LIB3062-055-P1-K6-H5
ctgctctgcacgcccctctccttctccctagtccctccccctacccccgcccgtc

SEQ ID NO: 43319 - DNA, 622 bp, Zea mays
  Clone ID: LIB3062-055-P1-K6-H6
gcgccacccacccacccactcgcttcagccgcctccgccgcgcgtaccaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagtgcggcgaggttatcagcaccaagaggcagccattgggtcccaagcccggcttcatggtcgagggcaccaccattgagaccgtaactcccatcccatatgatgtggtcaatgatctcaagggtggatactaggttgtttggtccatctacctgcagtacccagttctacatctgtgttactctagtgcgtgcac

SEQ ID NO: 43320 - DNA, 611 bp, Zea mays
  Clone ID: LIB3062-055-P1-K6-H9
gccgtggtcgcccacgtgtggcggtgcgcgtgcatagcgcgcgggctcgcgggagacgaggacacccgtctgtacatgaccgccgacgcgcgctcccgcgtccgcccgccgctcccggaaggctacctcggcaacgccatcttccgcgcgtcagcggtggccacggcgggcgacgtcgtctccgagcagctcgacgccgttgcgggtagggtgtccggcgccaccgcccggctggacgacgagtacgtccgatcgctggtggactacctggagcaggtggtgggcgatgtggcggggctccgcaagggggagtgggtgatgccggagaccgacctgtgggtgataagctggcaggggctgcccatctacgacgccgacttcggctggggacggccggcgttcatgggccgcgcgtgcctccagttcagcggcctcgtgtacctcgtcccgggcccggacggcgacggccgcctcgacgtcgtcgtggccatggagcccaagagcctggccagattcaaggagctgttgtacgagctcaaaggtgcaggtgttccgtgcacggcagactgagctgctgcattccgtgcaggttccttggcttgctaccggct

SEQ ID NO: 43321 - DNA, 419 bp, Zea mays
  Clone ID: LIB3062-055-P1-N7-A1
atatatcactcattcttttggtggagccacacatgacacgcgttctcacttattatttgaacacaattatagacgcatgcacagaaaacgaagcgagtacaggattacaggaacacgcctctcttgacgtagcccgaggggaccacctcttatacctgagactcacactctcactcaccacaagcaagcagctaccaaggttcggagagggactcattattgtgaaccatcaaattacacacgcatgcagtacagaattaaacaggtgtgtggttgtgtgctccggagctagctagctcggtcgcgcgccggccggtactacggtcagccgaagaggtggtggtgcttcttctctccgttggcctcctcggcgtccttgtggtccttcttcttctagtggcgctcgtggaatacgtagc

SEQ ID NO: 43322 - DNA, 589 bp, Zea mays
  Clone ID: LIB3062-055-P1-N7-A10
gtcggatataccatatttatatatttgcaggctatgttttctgcgtgttacatacactcgctcctcgtcacaaaattacggatcgcctctgtgcgcatgaactgcgcgtcatcagacgtctggcaggtctgctctgtgcagcacgaatatgttttctttgtcgtctcgtccaatccgtagcgattcatcaacatatgttatttccagccagccctccggattgaatatgtccaggagcatgtcgtagttcttctgaaatatgttcatcagctgctcaggggtgatggttgagctctcgagcttgatgtccactcttgtttggctggtaactctgtacgaagcctcgatggtgagcttccccgtcagtatcttcagtgctctcgcgctgaactctaccacattcaccgccttttcctgtttgacgtcaattatctggaggaagtcccctaggctgatgaaatctcgcagccctaacttggttctcttcttccccagtatggagatcgtgctgtagatgagcttccagcatccatccaccttgtcctgcagcttgacggtgggctccggcgtggggttcctggactcgagc

SEQ ID NO: 43323 - DNA, 590 bp, Zea mays
  Clone ID: LIB3062-055-P1-N7-A12
cttacacaggtcaacggataccaatacacggcaaccattcagatggtaaggtagcagtgttatcaaagataagctagctaaaattaacttgtgctttgtatataagttgcaacatcaattgagaatttgggatatttgccatctggcataagctgatggcgctctcatgtttcatgttcagtgaaatcctctcgtggggagggtgtcctacttgctttcgtgtccttttgccatctccacaaagatcaatcttccacgtagaatcctgccatccattgccttgacagctttctctgcctctgcttgcgatgaatatttgacaaaaccaaatcccttcatccttccagtttggtggtctctcataagtcgagcttcctctacggtgccaaatggtgaaaaaatatctttgaattcttcctctgtcgtatagaatgataatctgctgacaaatatctccgtgctgaagcacctcagaacctgagaggtcaaacccgtgagccttccacctcgcatcatcatcgggatgatctccactctccttacgcttgcctgaaacctggaagcctggaactggaacagtgaaacagcag

SEQ ID NO: 43324 - DNA, 555 bp, Zea mays
  Clone ID: LIB3062-055-P1-N7-A2
ggagaacaagaacgaacattcttctttccaccacgaaaattgtacacccattaaaggagcctctagcagggcacctcgccacagatatcacagcttccttggtcaccaacagactaccatgcccatctgcagcaaagtgtggatataaacatgcaaaacattgtcttacactatagactgtactgtttatagagtaaaatttaaaatagggagtaagatagagaataggatagagaggctgctggagatagcctaagaacatcagttataccccatcaatggatcgacaacgacaactagttgcggctaatccacatggtgtgagcaggaccagccccatcaaggtgatcatgcgacaggagggcacgcctcgctgtccttcgaggtgtcgacctctgaaggcggcatgaactgccacattgggtaccctgggtagccgacgaagggcatcatcagcttctgccctgcagcttggccctgggcatggaatggagttaggggcgcctgggcgaaaggcgccggcatcagggtcggatggggcatgtaggctggagc

SEQ ID NO: 43325 - DNA, 497 bp, Zea mays
  Clone ID: LIB3062-055-P1-N7-A3
gccccataatataattcaaatatccatttggtttatcataatccgaaccaaacaagctataagttcagcaagaaccaacgtgcgatacatagcagcacagaacaacatgcggaaagccttagctaaggaagttcatgaccctaacgtctggggcacagagcaaaacttgaagaccacatactggagattgacaaccgatccagtactaataacagactcagctctagtctcccttccggcggaaagagcatccctccgtgagcctcgcctttcctcccgtgggctggcagagaacagtttggcagcctgggcacacaacaacagtctgggagtggctgaaaaccgtggttatgctgaagcatccctggcacttgacatccatgaagaaggagttgggggactggacgaggcgcttcttcttgtgcttgagcttctcgagctctgccggcgggttgagaaggttcatgtcgttctggagaaccatcttgcctcgggcg

SEQ ID NO: 43326 - DNA, 321 bp, Zea mays
  Clone ID: LIB3062-055-P1-N7-A4
ctggaaacataccaaacacaccctcataagggggaattattacaaggaaacaaatccggaagaatctggcgcctggaacagctagctgtttgaacggggagggaggaactagtcccataatgcacaaacatgtgtgtgctgtaagaaaaatgatgacaaaaaaatcacaaagtctaaaacgaccggcaaatgctttaaaacatgatccccgccgaaacggcgaagggtagcgcggggagggctacaaggccttcggcgggggtgacgcgtcccgcgggggacttggctgaacccgtcggcgtgttggcaggcacatttggg

SEQ ID NO: 43327 - DNA, 492 bp, Zea mays
  Clone ID: LIB3062-055-P1-N7-A5
ggcctgcacgtcccgcggcgcggcggaggccgggcgcggcaggcgcgccgccatctcggggaagttgagcaccgcaccgcggcccttgacgaccagcgcggcggcgtcgtgggcgcgcgccgccatctcggccgtcgggaaggtgccgagccagatgcgcgacttcttgcgcggctcgcggatctccgacacccacttcccccacgcccgcatccgcacgccgcggtacgccgggcccggacgccgccgcccgcctccgtgcccgccgcttttcccacccccgcccgcgcccccgcccctcttgtgcacgctgcccagcgtcgacgccgggctggcgacgtcgtccgagtccgtcggcattgtcagcgtcaagtgcgcgcgggcggcgtcctgcagtgtgcgcgcgcggtcgacgcggatgctgggcgggcctgccgcttggtcccgtaagagctacagacttagctcgaagacttggacccgcagatggcc

SEQ ID NO: 43328 - DNA, 563 bp, Zea mays
  Clone ID: LIB3062-055-P1-N7-A8
gtattaggaagctttattaatcttagacaattacatcaagatgatacaagtggactaagatttatcctggactctacacactaagatgtacacacacaggcaaaaaaagaagaaaaaagacagaaaaaacaaactcatcacttggagcgagctatcaccacaacataattttcaagtcaaccactaaccaggcaaagctagagccgagactgaggctctccaaaagcaacgtcgttgctatgaccaaccaacaaaaggccaaatcaaaggttttcattaaagagaaaaagacactcggtattttagataatgcctttaacaaggtcaatgcgaggcccaaacaactaaggtcactgtttgtatggtgacccaccaatgattgtttgcatcgtctccggggaagtacctgtccttccagagtccttaatcttcaaatagatcgaacagctaaactaaacatgtgtgttgcttgattggagttcgagtggctcgttgattacttgattgactgccccaaccatctccttcggcgacgtaaatccatcaatctggaagtagaacag

SEQ ID NO: 43329 - DNA, 557 bp, Zea mays
  Clone ID: LIB3062-055-P1-N7-A9
gttccaacaagactttccattcaagcagatagccaggcaaggcaagtcttattacagcatcacaacaatgaataacagagatcctaatcctaaccaaaaacaattctcatcagatatgttgtgcgtgcgcaatcgctcaaaccaagcacattctagattgggcacccctcgtcccataacaccataaaacaaaaaacaaaaacatacaagcatgagtgttgaacatgagataacttcacaagatgtatcttacatgatcagtaaccattttcgcagcaggaagcttcatgcgctaaccggaggaggcactttctgttgtggttgtggctttttctcttgactccccttcatatctttggcctttggttttggaggagtgccagctgcctttgctctctgctccttcggtactggtttcttctgatcggaagaaggcgacggtgatggcttcttctgatcagcaggagaagctgaaggcaatggcttctttttcagggttttccgggcattgatattgttgcttagggtaatggagccttgcaacttgagagctgatg

SEQ ID NO: 43330 - DNA, 436 bp, Zea mays
  Clone ID: LIB3062-055-P1-N7-B1
tgagcataatttttgtatgttgattgagccttacttaagggtggagattgcacatatagcggagatgattgaattgccgattgaccatgttgagaagaagctgtcgcagatgatccttgacaagaaatttgaaaagacactagggggggggctggttgactcaaaaaaaatgaggactttgggacagaagaacttggccgggccataaaaaaacgatattttaggggggaaaagggtgggggcagtctttagggggggaaagaaaagatatggatcgggggcagctggctgacttagaacgctatgattggatccccagaatagaaggggggtcaaaaatttattccttaaataaagacagtttagggggagcggtaaaggttcatgtgaccaaaggctagctaaaaatacgagggaatgagctatgcatgtattg

SEQ ID NO: 43331 - DNA, 535 bp, Zea mays
  Clone ID: LIB3062-055-P1-N7-B10
cgacgtcaatgatggcacaggatcaaatatcatttgtcagattcagaacggtaaccgagggcaaatctcaacaacacaactttgagatcctagagcataaaccaaatataaggagcattgtctcggcaaaacagccagtggagtgattccacatttccactagataaggcccccacaacatgcctgacaagagcaactacaggaaaccccaataatataaagagctatatcatgcttcagtctgctccctcaggcggcggatcgtgctcctgacggtgaccgcactagcagtgttcatggtgtaagcaccaccagccttcaccttcccacagtccttgcacccccaaattccaactgctttcctcttcacagcaaacttcccacagaactcgcaaaagtacttggaatgctgagatacctccatcttcttgatttgcttacgcaagctagcaccatacctggttccatatttgccaacaattcctgccttcttagtgcgctgcgtcatcttggcgacacgaaatgaagcgaggtg

SEQ ID NO: 43332 - DNA, 549 bp, Zea mays
  Clone ID: LIB3062-055-P1-N7-B12
gacggggtacctgtgttctccatagactcaaaactagaaccagtttctttcagttttacagtacctggcagcataaattaaactaagtacctcaacacttcatgtagatcaaataactgcagcacacactctactcggagacccaatcaaaactaacaatctcattaggaaatacaagctgctgctcctacactagtgtcctttttccacagaacagccctacaaggctacaactctttcgccacagcagtagcacgtgtcagctgctgtgaccaccgcacgccatgttccgcaacaaactccaagctagccgaaaatggaagctaacacctcctatcctttttttcctttgccctgtgcggcgagcttggctgccacctcctcttctgataaaggaagataatagatcctcggagaggactgtgtcttcttaaagagatcgtcaagtgtcacaacaggaggctccggcttatttggagtgggtggaagcctctctattactagaggcgtcaagtcacccatagggggcttacaaggggaggtggtgga

SEQ ID NO: 43333 - DNA, 296 bp, Zea mays
  Clone ID: LIB3062-055-P1-N7-B2
ttttaaaattttttttaaaatttttttaaaaaattaattttttatatttagtaaaaaagcaaaaaaaaaaaaaaataaaaaaaaaaaaaaaaaaaaaaaaaatgaaagataaaaaaaaaataaaggaaaatgaaaaaaaaaaaagggggggaagaaaataaaaaagagaaaggaaaaaataaagggcaggtaaaaggaagtgagaaggaaaaagaatgtgttaagagcgcaaatcaagctggagctaactttgatgaaaagagtgtcggtcagtgaaaagagtgttgcttagtgaa

SEQ ID NO: 43334 - DNA, 553 bp, Zea mays
  Clone ID: LIB3062-055-P1-N7-B4
acttacaatatagctctttatttatgcatactggatttcacaagcacgtgttatcacttaaccaaagcaggaacacaactttgatgattataacactaataaacaccataagcagagcatcttatattcttatctgaggaataaaccgtccctacgcatatcgtggtctacgtataaatagtccccagaacgagaagtacgctagtgtactattggggatgataacacaagttaaccacccggtactcagctaaccgacacgcacacgcgccatcacaccaacagcagctagcaggccgccaccgccagccactagcaccgaccactgccaaaccgctacgcgccagcagcggacgagtcgaatcaacagtaggccgtgcacttgaccttgcagtcgacggtgcagctgccgccgccgccgccgccgccgtatcccttgccggcgccgctgtacgaggagaagcacttcttggggcaggtgaccttcttcctgtagcagggccccttctcggagcacgtcacggtgggcgccaccacgccgccgcgggcgtac

SEQ ID NO: 43335 - DNA, 516 bp, Zea mays
  unsure at all n locations
  Clone ID: LIB3062-055-P1-N7-B6
aaaacaaaaggagctatgtaaatgcagatggtacagcatcatagccaaacgctgttcaatggctttctagtgttacacaatcaaccaaatgtgctgggatacatttatcatgctagttcgacgttcattagcagtagggggcttcngacgcccccttctgtcgcaaaactggaaggctcgcttctgatgcagtccactgttacttacatggagatgccacacaacagaaatttgccaagctttttatgctgcccaagtctcagtattttacagaagaacacaagaagatgtagatcctctaaccatccagcggttttcaccattcatccaaggccccttcggcagaaagcaccagcagcttgtctttcagggtgaataactcaaggataaatctttgtacagaatcagtaaacgagccggggctcaaattcggcgaaatcaaccgagccagactcgatggggggcatgaggtaggctgccattatctcggacactagagaggcgacaagaggaatc

SEQ ID NO: 43336 - DNA, 621 bp, Zea mays
  Clone ID: LIB3062-055-P1-N7-B7
acacgatattatagttcattgtgcatttttatttggaacaaaatttaaatactagatatgcttttattttaggacggagggagtacattgcacccctgagattaccccctactgtctaacaactgaaggagcaagccgggggcctagatacacgacacatacaaggtagatgccaaaagccaagttgcctacacctaatactgcgtacagtccaagcctaccaacgacattacacaatcagtagcagatcggtatgaagactggatatcgtggcatctgttgagcttaatatcaagagtcgtccagaactcgagatgctcagtaaatgccaggaatgactctgtatggtactttgttgcagtaaatcttccagtacttcccgtactttgatgagcaccggtcatcatccctctttgctcggtcaaacaataatatagtcagaaagatcacgtagaagtatggtaggaagtgattgaaaagagctggaacagtccagaaaaatgcagatagtatctcttggacatagtggaagtgacgtgacaagccccaccatccagaagtcaagaagagactggttttaggttgctccctttggagtctgataagaggcaacaattttta

SEQ ID NO: 43337 - DNA, 544 bp, Zea mays
  Clone ID: LIB3062-055-P1-N7-B9
gttgctccaaaaatttaatgagatctatataatcgagggtcaaatatactcgatggcaaaacgacggtacaacattttgcttaaaaacctctcccttcacaataccattttaacgccgatccttttcttcatatagggcgggccaaaaagggaaaaaaaaacagtatcaacacagcatgctctgctttataagttataaccggcgcactctactcctgcaaccaagtctcatgccatgtagtggtagcttcacagtagcttctcgtttccgcaccctgggcgccctccaaagactatgcgccatatggctctccaagaagaatctgtgcttcctcattagtcatcgaggtagtagtaggacccggccgacttctgttccctgtcctttgtagagtccaacttgtttatacgtggcctatagttggtcgggtctcttctaaaagtaatgtcaagatgcgataagaatttattcatcccggatactaaagactgtggtgcattggcagaacaatcaatagaaggtcgcccctcataaacaatgacc

SEQ ID NO: 43338 - DNA, 567 bp, Zea mays
  unsure at all n locations
  Clone ID: LIB3062-055-P1-N7-C1
aataaaaggacgaaatcaaataattaatacacgtcacggtacaactgagttgaagtttctggacagccgtctggcgaaagcaaataatttattcccccggcccggcccacaagagaatgagaattgacaacgagatatgaaccaaattaaaagagcccagttaacggcggccgtcgcacccaaaagatgaaatttgagtagcacgcaacaatacgttgggggcagggcagggcagggcacttgtttggtcacaaactcatcacacctcgacgctgcatcctgtgggctgggcgaacttgagcgacgtcacggtgttgttgacgccggggtagcccgcggagagcacggcggggcagctgacgaagaggtggtagctgccggagacccagctgccgaccttccacttgacgcggccgtccaccttgacctgcagcgcgacgaagcccgcggcgacgtcctgcttcatggcgtcggcgacttaggcggcaacgggcacggactcggccgacagcacggnggaccagactgtgaagtcgcggtggccctggtactgcggcggcagagaca

SEQ ID NO: 43339 - DNA, 588 bp, Zea mays
  Clone ID: LIB3062-055-P1-N7-C12
gccggccaggcagctcctcttcttcggctcagccggcatgcccccgcgcgcgtccatgccgcagcagcagcagccgccgccgcccccgcacccgcctctgcacagcattatgttggtgcaacccagccccgcgccgcccacggccagcgtgcccatgcttctcgactcggtaccgctcgtcaacagcccaacggcagcgtcgaagcgcgtccgcctgtttggggtcaacctcgacaacccgcaatcaggcacaagtgcggagtcaagccaagatgccaacgcattgtcgctgaggacaccgggatggcaaaggccggggccgttgaggttcttcgaatcgcctcaacgcggcgccgagtcatctgcagcctcgtcgccgtcgtcatcgtcttcctccaagagagaagcgcactcgtccttggatctcgatctgtgagcgagagatcgatcagctggcgaactcgatcgatcggaggagtaaaaaaggaaagttgaaaatttgctgcttccgtctagtaccttcttcttcaccttttgagattgcattataacttttgatcataggatctagagtagccttcttaacac

SEQ ID NO: 43340 - DNA, 407 bp, Zea mays
  Clone ID: LIB3062-055-P1-N7-C2
atgtgtggggtatttttaaaattatttatagtttgtttttagtaagttttaagttatggttatgttagtacatttatataacattgttgttttatgattttgtacttaattattaacaacattcaaatcgtattaaagtctcaagacataataataattattaggtatatggggcggagggagaaaaaagagtatctgaaccaaaagaaagctttaaacaaaagtgaggtgaacaaagtcataaggagatcaaaggatgaaggtgaagtaaacggggagagcaactcgtgctggagagtaatgaatatcctttgcatcacagagaagagaggaggacaagggggggttgtggaaaatcaagggtatcagctccatttgaaagtgcgaggggaagcaaatttacctct

SEQ ID NO: 43341 - DNA, 536 bp, Zea mays
  Clone ID: LIB3062-055-P1-N7-C4
ggtcaaggtcaacgttcttacatgtaaataaactgtgcaattaaacacggagtaaatcaaacacaaaaaactaaagaaaactatgtctgtgtgccgccagattctcaagactacaagcagagtcagatagcaaagccaggagcgggaagaatccactgcgccatcaagaggaggaagaagcgccgggtagaaaagcgcatcctactacggtgcctggatacatacatgacaccacgcagtagagggggtgtgacaacgcaggtgcgcggcagctaagcgccccaaacggtgatcccctgcatcatgttcttgaactcgccgaagtcgacgcggccgtcgcagttgcggtcgacgttgcagatcatctcctgcacagtggccaggttccgagcctcgggcaggccgagcttcttgagcacggcctgcagctcggcggccgagatgaagccgtcgccgtcctcatcgaacacccggaacgcctccttcatgtccccctcgtcgttgacggcctcggtcacagccaccggcatggggcc

SEQ ID NO: 43342 - DNA, 506 bp, Zea mays
  Clone ID: LIB3062-055-P1-N7-C5
agccggccaggcagctcctcttcttcggctcagccggcatgcgccccgcgcgcgtccatgccgcagcagcagcagccgccgtcgtccccgcacccgcctctgcacagcattatgttaggtgcaacccagccccgcgccgcccacggccagcgtgcgggatgctgtatagactcaggtaccagatcgtcaacagcccaacggcagcgtcgaagcgcgtgcgcctgtttgggggcaacctcgacaacccgcaatcaggcacaagtgcggagtcaagccaagatgccaacgcattgtcgctgaggacaccgggatggcaaaggccggggccgctgaggttcttcgaatcgactcaacgcggcgccgagtcatctgcagcctcgtcgccgtcgtcatcggcttactccaagagagaagcgcactcgtgcttggatctcgatctgggagcgagagatcgatcagctggcgaactcgatcaatcgggggagtaaaaaaagaaaggtgaaaat

SEQ ID NO: 43343 - DNA, 587 bp, Zea mays
  Clone ID: LIB3062-055-P1-N7-C6
acaggacagaatataacatattgcagttaattttggttacaataataagagcagagcaccaaattcacagtgcactgctttccctgacgagaacatggtcccggcatgatcaccaccaccagttctaaagtttattggtgggtgttttgacaggtcaaaatggtaaatgtgtaaaaaaggtgtcgaacgactgctatacccccatcactgagggaatgatccacgtgttgaactaaaataaacagcccacaggtctggccggacaagaggcgccatcaacttcaacttacctgctgtagatacacgaccctactttgtagctaaacaagagaatcatggccgacataaagaaaaggtaaaaaccactgcgcagcaccatgggaacggtgctaatccgagtagcacgcccaagaccaacagggagcttggatgccacgtcgccctccacagcaaaagagacaagcaaactcaagtctccattcttctgcaagggccactgaccggagccgctggtgaaagtgaggccattcagttggatgataccagcagtaaaacgaattgagctcgagctgacagccgaaagcttc

SEQ ID NO: 43344 - DNA, 490 bp, Zea mays
  unsure at all n locations
  Clone ID: LIB3062-055-P1-N7-C7
tgattactaattattgatacgctaacattatgaggcgttgctattcaaaggcgtcacttaatggtttggggtttgtttgctccaaagtacgtattcgatgcaatcggccttctcctcacagacttgttaatttgtttagcatagtcgacgggagctgatgttgctttgctccttgagttgcactgctaaccactaacacaacaccgntattatgcttttgtgtgaatcggttgcagctagagatgcaattttttcttactcttcttgtgactggagtaagaccacacactaagcttagttaattcgtaatttgtctgggtgtttttttttgtattggccaagtaagcataaaagatacaaccatagntggtctttcccacggatggtcacacttagacaaaaaggacctccgncctaaaatttagtctttctagcatactttttttatggtcacattcatttaaatgataataaatatagacatacatgg

SEQ ID NO: 43345 - DNA, 504 bp, Zea mays
  Clone ID: LIB3062-055-P1-N7-C9
gctttctttcattgatttttgttttatggcacaaaactagactttgaatttattttaacacacagcaatttctttgcagctatgatctgggaaggtttggttcaaacaacacgctacaacatatcatgaaacaaaaaacagaaacaccatgggggaactatataatgcaactactatccatctgtcatttatgctgagtccatgacacattcaattgcctgtttgcagatcccaaactacccagagctactctctgattacgctgcacccatgatgcattcaattgcttgtttgcagattccagacatagccgcttctggcccatacacctcaattggaacgccgagttctgcaccaagcttacgcattttagccagtccagattggtaatttggaccacctccgcggacataaatgtgcattcttgaagccttcaactaggattccttctcccttaaggctcggatgatgccattgaatgtggtagccacatcagtgaagtta

SEQ ID NO: 43346 - DNA, 148 bp, Zea mays
  Clone ID: LIB3062-055-P1-N7-D10
agaggaaacgtgcacaaaattttttaatcaaccggccggtgttgcctgcatcgccgggaaatgaagagcgccggccgccaacttattttgctgggggggggtaatccgagcttaatctttcggccatgatcacagacttgttgagctg

SEQ ID NO: 43347 - DNA, 530 bp, Zea mays
  Clone ID: LIB3062-055-P1-N7-D11
gtttttattttttttttttttttttttttgagttttttttttttttttttttggcaggcaaaacgacatgtaaaacatgtgctatactagagggattccgggtaccaggaacaaactgaaaaacagggtcccatttagctatacaaaaaggtgattgcctggccggaaggaaaaccgttaacgggcggaaaacctaaaacaggggccaagatttagcttatcatagggaatgagggataaacgacagggatccgaagcttagtcgacctcctccattttgctttcgccggcgtaatcctcaagggggggcatttaagtttgggcctaagaaaactcggcctaatggatgctaaaaccgagctttagcatgcgatggatccgggggccaaaggggtgggggccatccaggctaaaaccggaggtaaggaaagctgtcttaaaaaaaaacaaaacaagacccttgactgactgtgaattcttggaaaccggggggcgcttacggagctaatgaatgagggggttctccgggt

SEQ ID NO: 43348 - DNA, 591 bp, Zea mays
  Clone ID: LIB3062-055-P1-N7-D12
gccagaaaatactgtattagtactccttccattctaaattacaagacattttggctttctataaatacatagatttcactatgtacatagatatatctaaattatgtctagtagtatagtagaatgaatatatctagataattcaaaacgtcttataatttagaacttagaacgagcgggtaataaaaaagtaaaccttctaataaccaaaagtgtgtggattattacaaataatatggtatgttacaagttttactgcaactccctgcgcattaccgataagatggttcaccaactgctactatcttgttatccaactgacacatccgcgcaagcatccacacctctttttgagcaaactgtttcagttccttaagacgactctgaagaatatcatactgagacaaaagcttttgctgtacagcaactatatccactgctttttctggaagcttttgaatttttggcaggaccactccatttagtgttgttcctatggcagctgatgcaatggcagttgctgtaacaagtctaggaagacttgggtcaatgaatgcggaagcagcatctgtagatgcaaggaaggcaaga

SEQ ID NO: 43349 - DNA, 496 bp, Zea mays
  Clone ID: LIB3062-055-P1-N7-D2
gctggtgtttttgttttttttgttttttgttttgtttttgttttagttggttgtttcatggtgatttattgtgtgttgaagtttgttcagtgctttggcgagacgagtggtgtattaaagaaaaggggggggctaataatgcattgtcggggggggggggggtgaaataaagcttggttttggagtgcagctcttaggggctctcggaaatgtctttaggcagaaaatgatttttggtccgaggaggggtggttgaggaagggtcaaatctcctagaatgatctcgtaatcggataaaaaccggttttaacagagaggttaacggttgatcactggggggggaattttcctccaaacaagggagggggaggggttttttgattccagggccccttaccgggggttttgggaaaggaccactggggttattgttgtgaaaggggggtccaacggctcattgaaggagaggttttcgccaaagaaaaaagttcttggg

SEQ ID NO: 43350 - DNA, 522 bp, Zea mays
  Clone ID: LIB3062-055-P1-N7-D3
gtgtgtgttttttaaggagaaaaaacagaagcattagttgaatacaaaagttctttgggattctacatcagtttgacattatccgagaaaatcgttcatccacacaatgtggggttaggcgcgactgaagatgcaaaagtcaaatggcgaggcggcttgttatcctatctcgcgtgatggtaaccagaatgcttcagaagggtggctcaccctgatttgtgctaaccatgccatgtaaattgtaatggcagctatgtaacaaattctgatgatatgaatactaaacttacggctaccaatcactagacaacggctgatgctaaggacctgatgccaatagaactagaaccaaggactgaccagccagaacttgcattgtaaacttacgcagtatccaacatctgcacactggactgcatgccaccaattaggacataagctatcatcaagataaacacccatggcatatccttttggagtgtacatgggatcacctatcctcccagcgttaagactaggatc

SEQ ID NO: 43351 - DNA, 510 bp, Zea mays
  Clone ID: LIB3062-055-P1-N7-D4
atgaatggaagtccctttattacgtggtggcttcagtcaaatataatctgagctgtgaaaaatgatattctaaattctgaaatgttactagttacaaccggatcctgccaaagccatgcatgcactcagctgcgtagggggggtggccaactgaaaatcttcaactgtttatggttgctgcatggctttagatttgctgtacagctgcacaactcaagctcagtattttcagcctttagcacggctgctcggctccgcaatatctccacatgacacaagtgtttatggttgctattctgtaggactccatgtaccaggaacttaaatgcaatattgcagtctttagaagtgcttcaagaaacctataggagctgcaagaaatgcggcagttctgatcagcccagcgatcagccaatcaccaatgaacttgatcctacaagtagagctagagtatcttcttatcattgacattaacccttgtatcaccagattcatcgatcatttccttgc

SEQ ID NO: 43352 - DNA, 552 bp, Zea mays
  unsure at all n locations
  Clone ID: LIB3062-055-P1-N7-D8
acgcggtctccttggcgaggagctccgacaccctcgcggcgaggctcagcttcgcggccggcgacacgccgcgctccccgatgatggactccagcacggcctcgcagaggcgcttgttctcgatcgccacgccgacggccaccggcaccgacgagtgcggggagaaggcgacggtgaggactccggcgggcgagtgcgtgaagaggatggaggcgcccggcgcgaaagtctctggcttgaacacctgcctgaacttctccacggcgacgccctcggcgtccgtgtacaggccggcggccttccagaacgccacgcagttctacgtcactttctccgcgtactgctcgcccgtcagcgggaggatcatcgtcaccctcgtgaacttctcgaagtcgcccgtgacgacgtaccggaagaaggcggcgtcngaggcgagctcgtaggccgtcttgccgccccacttcttggccagcgcgggcacggtcgtgttctccaggtacacgccgatagtcgtgaacttgatgaagttgcctgccatctcgaggcctcgca

SEQ ID NO: 43353 - DNA, 514 bp, Zea mays
  Clone ID: LIB3062-055-P1-N7-D9
cgaccttatttttttaaaaaaattttcatcctgaaaatgaatatccgtcccggcagatattacttccagcaggaaacaataccaatgccttttgcgatgaccatgtcatacagaaggtagaagtgaagctcttctgttgggtgaacaattctttacatgagccttttgctggttgctgcgctagcgctacactatttctccgtcacacaagagaagttcccatgtttctgtttctcccacacagatctgtctcatcttcagcccctgtgagcctgggccgaatcaaatgccgaacaaggtgggcacctcatgggtgccatttgatgctgcagccgacacttggcttttgcacaaagggcagttcttggccactgagcgcacagtcaatcgcgcggcttaggtcccttccggttacaggcacgttgttactgggtcttgagtcatcgaactgtccatggtagaaaagttcaaaaggcctccggccatcctttttgaacaagtagaactctggcgt

SEQ ID NO: 43354 - DNA, 152 bp, Zea mays
  Clone ID: LIB3062-055-P1-N7-E1
gattagaggaaacgggcacaaaatgttttaataaaccggccggggatgcctgaatcgccgggaaatgaagagcgccggccgccaactaattttgctggccgggggtaatccgagctaaatctctgggccatgatcacagacttgttgagctg

SEQ ID NO: 43355 - DNA, 394 bp, Zea mays
  Clone ID: LIB3062-055-P1-N7-E10
gggggaatcaccaatcattttctgaactgtataaaaaaaattgttaactgggacccttgttttttaacaacccacaacatgacccttaggaagggggggggggctttttttaagccaaaagggatttcttattttgtagaaagctccaaaaaagggaacttggcgccagtttccaaggaagaaaacccggcccaacattgggaggtcattcttcttttgcattgcaggattacagagggccagggaaggggccctttttaccttgcttgttccagcgatcaacccattcacctgggcccagggatcgattgttcttgcagaacttatcacaatcaggggcgtcctcaccttttgcagccacacacctgtgatattcaacataacgtgggaaaca

SEQ ID NO: 43356 - DNA, 566 bp, Zea mays
  Clone ID: LIB3062-055-P1-N7-E12
gggtctaagtatccagaattacattatgtttcatgttgacaatgacaagcagatgataccacaagacgaaacttaacacaggttacattggcaactggtgctgtcctgtcgctatacaaaaaatcggcacgtagcctgcgcgggggaggattacggtccacaaggatccgcgagacagcactacagatgtcagtcgggtctcaggaaactaacagttcggatacccggcttcacttacccaggtgagtcaagatcctgctgataagtacctctttcttaccagaaaccgggagatcatgcgcggtcaggtaggatctcaattccaccgtggtcatttccttcagttttccattgtctgcaagttctgcccagtcataagcagcacttatctgcgcagctgcatcagtgacctccttgcgcttttttgaagcattaccacgggaagctttccctgctgccgcttctgcctcctcttggtcataattttcaccatagactgaagtcttgaattcctcaatagcattagctacccctggcttagacaagccttcttcgtcaggcagggt

SEQ ID NO: 43357 - DNA, 510 bp, Zea mays
  Clone ID: LIB3062-055-P1-N7-E2
cacgaaagagggcaagtggtagcttacaatattcttcccaccaaagttctactacatcatacccatcatagacatgttgctaatacaactaccaaacttaagctccatattgaaagaaacctaagtccatagaccgttcaatctgcaacaggggccaagagcaccttactcttcatggacctgctcctctccctcctattcctgctcatatgcaacggcattctggtacttctggtactcaaacaccagatcggttatgttcctctcaccttcagtgaactccatctcatccatgctctcactagtgtaccaattcaagaaagcttttctcctgaacataacaatgaactgttctctcacaccgcggaacatctcctggatggaggtggaattgtcaatgaaggtggaggccatgcaaaggccgtgtgccagcatatcacaaacactggacttaacattgttggggatccactccacgaagtacgacgagttcttgatctggacattgat

SEQ ID NO: 43358 - DNA, 428 bp, Zea mays
  Clone ID: LIB3062-055-P1-N7-E3
accctggcgggcgtacagtcttttggagctgttatgacatgagcatatattattcttattccagtacctacagattcgacaaacactctatttttttggcacaggccggggctcaacctagacagttcaaactagatatacgactgaactgaactggggtcgataccgcccacccaaacgaaagccagtggcacatatgaccaaatcccccgtggcccggcggaggtactcataaaaaaagcacgcctgctggcatgatcaaggctgaacgcacccggggcgggcaacaggtacatataagggcccaacccaatgttagggccgacggagggggaaccccccggggcggccggggccttggaaaacctgtggacggccaccccgcccaaggtggcctacaaaaaggtgaagagggccccagacgccaa

SEQ ID NO: 43359 - DNA, 574 bp, Zea mays
  Clone ID: LIB3062-055-P1-N7-E6
accatctggccgccctgaagcgcgcggctaaccagcacggcgatgcggaacagcggctgattgccatgatggtggccgccctgtcctcccgcattgctccggccgcctccgccccatctcaactcctcgccgacctctgcagcgtcgagcagcgcacgttggcccaactcctacaggacctctccccgtgcttccgcgtcgccctccacgccgccagcgccgacatcgtcgaagcggcgggcgaccaccgcgccatccacctcgtcgacttcgacgtcagcttcccgcagcacgcggctctcatacagtacctagccgaccgacgcgtgcagggcaggtccctgaaggtcaccggcgtcaccgacccgagctcgccgttcacgcagtctctaaccgcatcgctaccagccatcgaggagcggctgaagaagctcgccgagcgagctggcgtggagtaccgctttacagtggtcagctgcagagcagcagagctggatgcctccagtctgtgctgcgagcccggggaggcggtcgcggtcaaccttgccttcgcactctcccacgtgcccgacga

SEQ ID NO: 43360 - DNA, 502 bp, Zea mays
  Clone ID: LIB3062-055-P1-N7-E7
caaatgaatatcatattagcagggcgctcgtgtctcaaagctagcagatgagaggctcaaacatcttcggatcaagcaaaccaactggaacaccgcgaaacacggaatacaagaggcaacattgtctcacagccagatgatggtatactgaaccgcaacacagataaccagctgtcttatcgttctcttaggtgtcttggagatgggtgggtgggcaatgctcatttctttccacttttcttgagacccgagcctccaattgcgcccttctgtgccttggccttcagctccttcagcgccttttcctcatcttttctcttctgcaaataagcaagatcactctgcgcgtactccttcttgtggaccttgggcaccttcagcggattgaccttacctacttgcttcgacatgaccggcgggggcgacagttcggcagacaagggccgaaaccataaactggacagcaccgtcgtaccgcaccgcgacggcaagtaggtgggga

SEQ ID NO: 43361 - DNA, 254 bp, Zea mays
  unsure at all n locations
  Clone ID: LIB3062-055-P1-N7-E8
aaaacttttttgttttttttaaaaatattttttttttttttggggtttttttttttttttttttttattttttttttattatttttttaaattaatatataaaaaaaaattaaaaaaaaaaaaaaaaaaaaaaaaaaaaataaataaaaaaaaaaaaaagaaaagaaaaannntaaataaaaaaataaaaaaaaaaaaaaannnnnaaaananaaaannanannnnaaaaaaaaaaatnnaaaaaaaaaannaa

SEQ ID NO: 43362 - DNA, 512 bp, Zea mays
  Clone ID: LIB3062-055-P1-N7-F1
gcacggttaaaactgagtggacttcaacggttcttaacagtcacgcctcaagacaagaaatagcttcgttatagacgcagcggctgcaaacatgacacgggataaagcactgtcatagctcttaactacagggcaccaaggtaaatggaaggattccatatctaagcagcctccaactcaattatagtacagcagctgaccgcctactgcagagatcactccgggatgatgctcctcgtggcttttaccccatcgctggattaaacaccactactcgatgactcgtggccattggtcatggctgctgcagcattctctagctcagagccaggcgcagacatggcgcttccattaccaccatctagatgcggagctgattgcgtagcttggagaggtacaggagattttgttacgtccctcaggagacccttatttgcccacatgaggccacatgcattgcataatgttcttggtccatgaggtccgcgacgcatcattggtgtagctgttgc

SEQ ID NO: 43363 - DNA, 533 bp, Zea mays
  Clone ID: LIB3062-055-P1-N7-F2
caagtacaagtttgcatacaaaagttgcaaataaaaccattgacgtgtgcccttcgatgctttaatttcagggagcttattccttttagccgatcgaactgaaaatccgtggttcaatcagagtcccggttggaggagcgctccctgccgggtaatcctatgtacagatccgtctccacgtccatgtcattgctcggtgccggcaggctactcggccaaggagggacacagcggttcaggtccggtggcgcctccggtggagactggaggttgcgctgcttatcccgcaactctttgttgtcttggagcagggtcctctccttctccttcagcttggatatctgctgctccagcagttgtgtcttcttccctctgatgacgtgaaggctcttcgccagtttaacctccagattatgcagttcttcaatggagcattcttctaaatattcacccagaaacattcgattggtcttttctagggcttcgagtctacttgccaagcttacggcatcttgtttgacttgcttgatatc

SEQ ID NO: 43364 - DNA, 504 bp, Zea mays
  Clone ID: LIB3062-055-P1-N7-F3
aataggcgactcatagcagccaaaaatagccgactaatagcagctgcatggcttggtcacttcatgacatgaagtatgtttctctaaacagacccctcaattgctgaatcatgcatcttgtatttttttctaacgaagggagacggaataactttctctcttttccccccttctctgagaaacggcacggacccaaacacgcacccctacaaagaatacttctttcaatcgactatgaagcacctctgcttatcaaaatcttcataaccaacgtctacgaggcacaggccttctggcggtgccgggggcgccgtggcacgcctgtccgtggcttccattaggttcagcaaagcatcggcgccagcaccggcagcagcctctcttatggcagtggccacaagaaccctgaccatcttgcgcaggaacctgtttgcgactagctcgacccacatgaccaccatgcctcctctgggatcctaattagcagaatgtagtttggccact

SEQ ID NO: 43365 - DNA, 435 bp, Zea mays
  Clone ID: LIB3062-055-P1-N7-F4
gtgttgtgttcatataaaatgcaaaagcgccacttagttaatgcaagcatcgtgagacacgagaaagcgtaatacataacagctgaaacgtacagacgtgaggaaatttagtgctccccactagttacccaataaactcatgctgatcagcgggggggatccatgctcacagaagggcacctaatctggttaactgttgtgatgatgagccgggagcccaacaacatgatgacaagattagtcaccggtggcacaacccctgcagccgcaggggacacattctatcacctgttcctgcctcagatgcttggggacgcggcagacgcatgacgttgcgaagcggtggtcacgtgtctgtatgcaccggaggcaacaaaggcgctcgtaacctggctttttccacttggcgatcaggttacgatctgcataaccctg

SEQ ID NO: 43366 - DNA, 210 bp, Zea mays
  Clone ID: LIB3062-055-P1-N7-F5
ggttttggtttttttttattttttttttttatttgggtttttttttttttagttttgaattatggagaatgaagttaaaactggaccatttttacatataacgtgccaaaaaattatttgctaaagaaaaatgttccaacaaaagatggggtggtgggggtaatgactcgttgaaagaaaaaatagggtggccaaccaagtcagccacgt

SEQ ID NO: 43367 - DNA, 573 bp, Zea mays
  unsure at all n locations
  Clone ID: LIB3062-055-P1-N7-F6
tgttctcttgttttttgccagaaaatactggattagtactccttccattctaaattacaagacattttggctttctataaatacatagattccactatgtacatagatatatctaaattatgtctagtagtatagtagaatgagtggtaggtagataattcaaaacgtcttataatttagaacttagaacgagcgggtaataaaaaagtaaaccttctaataaccaaaagtgtgtggattattacaaataatatggtatgttacaagttttactgcaactccctgcgcattaccgataagatggttcaccaactgctactatctggttatccaactgacacatacgggcaagcatccacacctctttttgagcaaactgtttcagttccttaagacgactctgaagaatatgatactgagacaaaagcttgtgctgtacagcaactatatccactgctntttctggaagcttttgaatttttggcaggaccactccatttagtgttgatcctatggcaactgatgcaatggcagctgctgtaacaagtctaggaagactcgggtcaatgaatg

SEQ ID NO: 43368 - DNA, 444 bp, Zea mays
  unsure at all n locations
  Clone ID: LIB3062-055-P1-N7-G1
acccaggcgggcggggctggcttctcctcccccgcgaaccaagacctcgctcagtcagggctagtcagggttcatgagcgggggcaaccgaagggagctgctggggagcccccacccaatccaagggtgagtacgggtcgacccacacaggagcacaggaagcggggcggagatgaccctnctcacttactacaggcgaatgagacttacactgcgcacaggagcactagacactgcccgccacgacatggagagcgcctccagggcgttcgcggttcggctaccttatccgccaagaaccccatgctcacgctgtcgagaacatgaacggcaaggagctcgacggcacgaacatcaccgctaaccaggcccaggcccgtggcggcggcggcggcggcaggggctacggcggcagacgcggcggcggcggatatgggggcgggc

SEQ ID NO: 43369 - DNA, 298 bp, Zea mays
  Clone ID: LIB3062-055-P1-N7-G11
gtgtttgtttttgttatattttttttattgttgttgggtttatgtgtgtgtttgaacttgtgttgtgtttggttttaagtacttgtaggggagggaaaaggggaagaacggcaaaggaaaagggccgggtccctgggggatgggaaaagggggggggggtaaaaaaatccaaaagggaaccgggaaaacaccttggacgggctggaaaggcgccgctaattaaaggggcttgggaccatacacacacaggttatacacgcacatgtacacaggaggggggggtggagtttagtttggg

SEQ ID NO: 43370 - DNA, 319 bp, Zea mays
  Clone ID: LIB3062-055-P1-N7-G12
ggggggggggggcacacacgcaaatgtattttcattattcctgatggaatgtattaattggccagatgattagagagcggaaaatatattaagaacaataccatagagagaagttcctcagggctctcgcaaaaaaaaagatagttggcttgaaaacccatattgggggggggggtttgaggggggaatacaagacctttttttggggggggggcaaccttggttttaatgagggggttgaattttgtgggaaaaatggggattggttcatattttttgaaagggggggggggggaaaatggaaaaaaaagagcgggcc

SEQ ID NO: 43371 - DNA, 394 bp, Zea mays
  Clone ID: LIB3062-055-P1-N7-G4
gtgcgtgggtacagtcttctggagctgcgatgacatgaacatatattattcttattccagtacctacagattcgacatacactctatttttttggcacaggccggggctcaacctagacagttcatactagatatacaactgcaactgaactggacgtgggggccaaccacccaaacgaaagccagtggcacatatgtccaaatcccccgtggcccgacggaggtacccataaaagaagcactcctgctggcttgatcagggctgaacgcgcccgaggccggcatcaggtgcatataagggcccaacccaatgttagagccgacggagggggcaccaccggtggcggccggggccttggagaacctgaggacggacacctcgcccaaggtggcc

SEQ ID NO: 43372 - DNA, 394 bp, Zea mays
  Clone ID: LIB3062-055-P1-N7-G5
atgcgtgcggtcaatataagataaaattgccaaagatggtcttgattggaataggaattgcgacaactgcggtcggacttctggttggtggaattgcagctgctgttgccaggaagaagtgaggtcaatatattggatcggcagctcattgggggggggagctcccgtctctgaaattccaacttttctgttgttaccttggtgatattacagatgaattgccactctttatatgtacgaagtaatcgtatgataatgataacaccattgtgacaaacaaaaatcacaaaaaaaaagagggcggcaataaaaaaaaaaaaaagcttcccgcggggggaccaggtggtcttatcaaaacaaccctagcggggcggcgaaatcgtcctaacagctg

SEQ ID NO: 43373 - DNA, 565 bp, Zea mays
  Clone ID: LIB3062-055-P1-N7-G7
gtaaaaggtctaggatgctctttatctgtgatggaatattcagaaatataccctagcttacaaagggtaaaagtgtacgcctataaacgcgaacccctagaaattctctcatccccgaaggtcttcgcttcttaccgtggggaatttcccaacaataaattgagtaaaaatgcacgaaaagaaagcacataaaagaacacaaccggcactgcaaaggctatatattactaataggacgatttgtgaacctgactacaagtctgccttgtctccgagcaaagtctttgtcatctacagaatcattgccaaatctcttgctgctagactcaaacaccacctacctcctccccaacaccaccaaggtcaaccgatgattttcaatcatgatgatagaacaaaagcctgagttctctgcatggggtaatggtatctagcatgtcagaacaagtatgtttataccgactactgcatatattatacggccagtgcccaactcaaaccatgttaagtcacactacaaaacatcattgagcgcggaaacatgacatggtgccaggtcacaagg

SEQ ID NO: 43374 - DNA, 510 bp, Zea mays
  Clone ID: LIB3062-055-P1-N7-H1
agcgttcttaccaatcaactcttcatcatataatcaacattggtctcatcaatcagaaacaaaaaatggcaacaaaaataaaacaagcacgccacatcaaacaaggaagaaaagggaaaaagagaaagagagaagcaaaaagaaaaaaatgattgagcctattgcgccaatatcttactcctacaccgccgcaagcggacagcacgcctcgggacaagcagatatcagctcccccacaccgtatcccgtcatccgctcatcctcgccttcgtcgtcttcctccccgccctcgtcgccgtccgcctcctgctcctgcaatgccattgccaccgtcttcgacacagcaccaggcgagctacaggacctccaggcctagtacaagtgtgcaacggagtagagcaggaggaaagcaagcgcactgtggttgcgagagcaccagagacgcgctctccctcagcctggacctggagccgctatttatcgcacgctcacacgcaggatgcctcgcca

SEQ ID NO: 43375 - DNA, 465 bp, Zea mays
  Clone ID: LIB3062-055-P1-N7-H3
acgcgttcgttccccgttctgcggaaccattgggcccccttggccttctgcgtatccttcaagctggagacggatccagacattctagttcagaaagcagagacggctctgagcaagtacaggatggacgttgttgtggccaatctgcttgcgggggacaaggaggaggtcgtcatcatctcgaatggcaaaagcaacaccattcgaaggtgcagcaaaggcgaggatctggaggagcatatcatcaagctcctagagaagagccactccaagtatatccacagcagcacggaagggtgcagtaagaacgactacgaaaagcttataccgttaggcatcaaaagtctggcttaagggaaacattgatcggttctggggctcaaactaatagggaagccccataagcactcttgtagcggttggatggatggacgaagaaggatgaagagggatgggataggatca

SEQ ID NO: 43376 - DNA, 426 bp, Zea mays
  Clone ID: LIB3062-055-P1-N7-H5
accctggcgtgcgttgttctgcactccccttttcttcttcgtagttcctccccctaccccccccccacaaagcgagagcccaccttgctaaacatgattctaacacggtcttttttagacaaccataggggtcgctctaaggggaagttgctggggcgcgcgcccagaccctcggaacaaggttatacctacgcccacaaccacgctggaggctgctggggataacacgccaagcgccggcgcccggtgccagcgctgttatcctctcatggcggactactaaaggtggctttgactatggagactggacaggggcaggcgctggccatggaagcttgttgcggcttgggctcttggcatcagacttacttggcaccttccggagccttgccaggagccgaggattttgaccccgaagcagaatcg

SEQ ID NO: 43377 - DNA, 447 bp, Zea mays
  Clone ID: LIB3062-055-P1-N7-H6
aacgcgttcagagaaactcaggtttgcacctaaaatgggaaatctttcaacaggcacacacaacaggttcatactactgctcagagtgagcaaagttgctcgcactagagtaacacagatgtagaactgggtactgctggtagatggaccaaacaacctagtatccacccttgacatcattgaccacatcatatgggatgggagttacggtctcaatggtggtgccctcgaccatgaagccgggcttgggacccaatggctgcctcttggtgctgataacctcgccgcactttttggcatccgccttcaactggtcattcttcgccttcctcaggcggaactcttctgtgcagcgggacggctgcacatgctccacacggacatggatacgcttactgatgatgcgcccattgacctgcttgttgacctttacgccgatggcgcgct

SEQ ID NO: 43378 - DNA, 574 bp, Zea mays
  unsure at all n locations
  Clone ID: LIB3062-055-P1-N7-H9
agctccgaataatatagatagccatgtaaatgcatatagagtacagtactcaccagattgcgatcacaaacaacgagtagaaaactaggagtactgcagtaaaggtcgaagtagatacgcaatgcaaggaacaatgcggcaaacaggttttcgttttgccagccggtagcaagccaaggaacctgcacggaatgcagcagctcagtctgccgtgcacggaacacctgcacctttgagctcgtacaacagctccttgaatctggccaggctcttgggctccatggccacgacgacgtcgaggcggccgtcgccgtccgggcccgggacgaggtacacgaggccgctgaactggaggcacgcgcggcccatgaacgccggccgtccccagccgaagtcggcgtcgtagatgggcagcccctgccagcttatcacccacaggtcggtctccggcatcacccactcccccttgcggagccccgccacatcgcccaccacctgctccaggtagtccaccagcgatcggacgtactcgtcgtncagccgggcggtggcgccggacaccctaccctgaacg

SEQ ID NO: 43379 - DNA, 546 bp, Zea mays
  Clone ID: LIB3062-054-P1-N6-A1
aaaaaaaaacattctatttatgccagaattgtgttgatttacaacggaaacgctgttgattcacaagtgtcagaaaaatgaaggggtccgccgcgtttgtcatctcctcacggtagcaggtgttgtcctagtagcagaacattgttttcttctttctctgagccctgacaatctgcttgctgcacatgttctggagcagttcctcttgcctgataagagcctcgtgcaaagccttctttgatacaattagttcagcttccaatgcatccacacgacgcacagcagcgttaagcaactcttctttctcgcaaggcatttcagaaggcttttcttgaagcatctggaccttctcttcaagctctcccagcctttgcaagaccacggcgaataggtcggcttcagcgaacccagggaatggcgaaagaggacggaatttctttttttggacggagtccgggtacaatgtacagtagctttcttttgacccgcctttagatgacaatctcattgtggcaagatctttgattgatccgaccaacattacaa

SEQ ID NO: 43380 - DNA, 581 bp, Zea mays
  Clone ID: LIB3062-054-P1-N6-A11
aagctagccaaagttatgttattatcatgacaattaaaaagtatagtatttaaattcatggctccgagaaacattgctaacaaccagacctaaaaagttctttgcgcatgaacaggtagaaagcgtgtgcaggaggctctgaatcaagaagctgaaagaaaagaaacagaagctagacatgtcttgcactcaatcacggagtggaaggatagggctagccgtgcatcgtcgcagtcttcttgaagtcgattttgtccaccttcacctcgccgtcaatcagctcgtagacgtacaccaccacacggagcccgtcgatgtccatcagcacaaagcttgggttcacgtcgtaagtgatgctgctgtaggcgcccgtggcagatccagggttgatcaccacgcctccctcgtgcttatatgccttgaactggtgcgtgtgcccggtcaccatgatgtccacgtccagctgccgctggagcatcgccagggagtccaggtcgccccatggaacaacctgatggccatggcacagcccaagcttaaactgaccaattgtaagtgtcttagtctctgggtatcgagca

SEQ ID NO: 43381 - DNA, 529 bp, Zea mays
  Clone ID: LIB3062-054-P1-N6-A3
cgagagaattatgcttatataatcgattatttgttgcagaccacgtgcatcgtcttcttgcctgcttcgattccagctaaaaaaattacaattaatccgattcccctcccctaacttgaggggccagcgaaccaccaaccagcccccgactcccagtgccagcctctaggccgagatggccgggtggcagtaggccccgctgacccagccgtcggagatcttcctgtacgccgcctcggtcaggtggatgccgtcccagctgagcgacgacgccgggtcggagcacgcgtacgcgccgggcatgccgcaccgggcgccgttctggtagttgtacttgccgtcgccggcgccgcagcaggccctgaggttggtgctgaacccgaagctgccggggctcttcaccatgtcgtacacgtggctgtagaagtcggcgtacatgacccgcgcgccggagtacttgctctgcaggctcgacaccttggcctgcagcatcgagttgtgctgcgccgacagcgcgttgaagcgcttc

SEQ ID NO: 43382 - DNA, 413 bp, Zea mays
  Clone ID: LIB3062-054-P1-N6-A4
agtctttcttttttttttttattctttatctttgtcacggttattctggagatgaggtggagcggcgtgggcatcgacgagtggtggaggaacgagcagttctgggtcatcggaggcatctccgcccacctcttcgccgtcttccagggcctgctcaaggtgcttgccggcatcgacaccaacttcaccgtcacctccaaggcctcggatgaagacggcgacttcgcggagctgtacatgttcaagtggacgacacttctgatcccgcccaccaccatcctgatcatcaacctggtcggcgttgttgccggcatctcctacgccatcaacagcgggtaccagtcgtggggtccggtcttcggcaagcttcttttcggcttctgggtgatcggtcacctgtacccgttcctcaa

SEQ ID NO: 43383 - DNA, 346 bp, Zea mays
  Clone ID: LIB3062-054-P1-N6-A5
aaattgtaacgatctcgtttgatcaatcggatgaacagtttgcctaaacaagactgcaaagtacaggggattgtacacttggatgttgtttcttgtacttatagatggccaaaaagcacgaggtccgtgagcccggcacgaagcccgctttttgggcccggtccgagcccggcacggtagaataagcgggcgggcttggacaggaaactatgcacggcgggctagcccggcacggtccgtttacctctaagcccgtttttttacactaaaacgtgcttaccggcccgtttagcccggttttctacctgtttttttgagctaaacggaccggtccgtgccgatacga

SEQ ID NO: 43384 - DNA, 403 bp, Zea mays
  Clone ID: LIB3062-054-P1-N6-A6
catccgaaaagccactaaaagcaggtccagtgatgctttcagatttgcactacaagaaagtgggcttttagaaaaagctgcttcctagatacaaccctttgattggcttttgccttttagtggggtaaaagccaaaagtcaaatcaaacacacccttgtacaaacattccggcccaactttctgggcccacctaaagctaccagtctgcgggccctgaagcaactacgcgttcggcttgggcgcgcccgcgccaccgcgcgccgatacgacccggcgccgcaccacggcgtacgccacgccgatagccactagcgcggctgctgcggcgctgacgaacacgcctgtcaccttgtggttgtggcgccagtgcgtctccacgggcgccacggcctgtttgtctag

SEQ ID NO: 43385 - DNA, 349 bp, Zea mays
  unsure at all n locations
  Clone ID: LIB3062-054-P1-N6-A9
acgaccgaaacaatggttcattcggcaacatgcacgactgtatgtatagtttacaacatctgattctgttctcagtaccatctactgcaaaaataagcaagaatgttgttagcatccacatgcgatccatagagggggagttctgcggcaacaaggctctagctctttcctgcacccccacgaaaactggcatacctaaaactcagacaatggatgacccagcccatgtcaccatgccttcaatcctcctgaattggggtgcttgagcttccttcgccttgtttttgaccatgagcctcatcgngctcttggatctaaccatctgtgtccatcttctcggctccatctg

SEQ ID NO: 43386 - DNA, 419 bp, Zea mays
  Clone ID: LIB3062-054-P1-N6-B1
tttttgtgggcaaaaatccaatataaaacctattatgtaattggccgattataccaaataatggcaagttctgggtagtaacagtcacgggtgccgctaaagctgctgcagattattccgtagttaaaaaaagaattactggtgcaagggccatattattattcctcacctgctctgacaaaaataaatagaccgatgagcatagtttgggagcagcacttctcagctcttcacagtggtgacatgcctcagaagcatctgaatgacatctggggagatgctcgcagcctgctggatgagctgttcaactaccgccgaagcctcttcctcgagacgcttgacgttcacaccaaatacaccactgctctctgcgaccttactatggaactcagacttcatctgggcacagaatgcagcta

SEQ ID NO: 43387 - DNA, 523 bp, Zea mays
  Clone ID: LIB3062-054-P1-N6-B10
attcaatccaacagcgactaggtcacttgtaatcaatccatggtaacacatcgtagcacaagagagagcgccagtcttgcaggagagacatccattctcctgcttaaactccacaaacagatagtagcctaacccagacagaatttctgaagcctaaaagatccccccaataccgacgaaaccactgcattccaatcagttgattgcattagccaggcacaggcgctcagagcttgcccttgagcctcttcttcagcacatccatgacggcgccaaagtcggccttcacgctcacaggcgggttggagtacttgcaagccatgtcctcgatcttgctgtcatggtagtcgatcttcgactgcgagaacttgaggccgtgagccgtgctgacgaccacggtgcggtcgttcgtcccgatgacgcgctgctccctgagcttgaacagggcggcgagcgcgaccccggtgtgcgggcaggcgaacatccccgtgcggtcggcgagcgacttcgcgttcatgagctc

SEQ ID NO: 43388 - DNA, 488 bp, Zea mays
  Clone ID: LIB3062-054-P1-N6-B11
atgcgttcgttcatgtgttcggtgaagcggttttgggtgacagggaaggacatgatcgtgcggtggtgcgccagagaagcaacactggctcgccaagaagaacaccaagcgcatgatgagagctcccagatgctatggaagacagcttcagcgggggcgatggcagaaaggccgaggcgggagaggccaagtcctgccaagccacacccggacccgagctacacggcccgagagaaaatgaagcggagcacggcgtgcaaaggggagggccgggtcggggtggcgcgcttgatgaaattggcgaggaccagggactagggacaaccgggggaccccggcggtaagagtgggtgtcctgttcgagcatcagcaccgagcggccgaccgggagctccaagagagagagacgcctaagaaccgcatctgcgggaggggcccgtgaagacactgaagcgaagcgaccagaaaagacaacaaactgcgaaccg

SEQ ID NO: 43389 - DNA, 582 bp, Zea mays
  Clone ID: LIB3062-054-P1-N6-B12
gaaaatccaggcatccagtaaaggggcaaagaaatatatatatcacgttattatttggctacacctccgtgttcattattcaccaaggataaaaattaaatccacttagcccaggagacatccatccaatcttaacccgtattcctccaaccttaacccaataaataacctctgcttaacaccgtcaaaaccaacatggctggaagtgtcaccttccttcagctacaaattgtttcattaatacatggtaacaagaataaactagacaagggcatagggtttcaattctcttagaatagcataataaacagtacggtaattgcagaatggtagtgcacttaatctgcccgggattgaccagcacgggatgaaaggataattccaacaatgagaccgtacagagcaagcgcttctgcgaaaatgaggatgaggatcatgcccacaaaaagcttcggctgttgtgcattcgccctgactccagcatcaccaacaatgccgatggccatgccagctgcaagcccagcaaggccacaggcaagcccggacgaaaggtgagcgtagccatcaaaaaggtagtagggc

SEQ ID NO: 43390 - DNA, 469 bp, Zea mays
  Clone ID: LIB3062-054-P1-N6-B2
cttttatttttattaccttgtgctgtttgtcttttttcagtttttctttcaaaaggagagatgttctcaacccaaatcccaagtgggcgcaggctctagattcatgagcggatccccagtgacttaacatgtctgcccggccacttgaggaagagggcaacacgctgcggccatgaagcccggcggctggcttataacaggcctaaagttctgtgaacatgctaaacaggaccaggtttgcgttacaagaaacccatagattcgtggttgaagctccctaggcaaaatatgcagcaacaaagtaccatgacaagctggcacacgagcgtgcctagtactatgcgacactttctctacattgtgctcccttggcattcccttgtgctctagaatacaaggcaaggataatcttcttccggggacccattggaatgcccaaagcttttagatcactggccggtatatgcct

SEQ ID NO: 43391 - DNA, 566 bp, Zea mays
  unsure at all n locations
  Clone ID: LIB3062-054-P1-N6-B3
gagactgagttaccaaacagcttattgctcatcaaatgaatgatagtgtacagcatacaaggataagcatagtgtttacaaggatacctcagcatgtcgatgaattcagtagtcacctattggcccacgcatgagcatacaaattaaaccctacaacaagcttctcccctttagccatgtacatgactgccataatcttggttagaacttttcgtatctatgtgcatgaagatgagcagacggtcttgtattcctcaaagcaagttcaatatcttctgtagttactgggccaacttcaggcaactcactctcagggacctcttctttcctgccttcaagaactgccattacccgtcttaggggctgcattgctgcttccttgcataccaggcgaatatcagagccagaatacccttcagttttctccacaagaacatcatagggaatctccattgtgccaggtgtatatggcaggagctcttcaaacatagcatgtctagcatccggctctggcaatggaacaagaatacgcttctncagccgacgcatcattgctgcatccaact

SEQ ID NO: 43392 - DNA, 544 bp, Zea mays
  Clone ID: LIB3062-054-P1-N6-B5
cgctaaaccacattgttaacttatataattatatgcctgccttcaattcaggttcttacaagatattccctccgttcttttttatttatcgcggtctagttcaaaaatgaactagtggacgacaaatattcgagaacgaaggcggtacttaccaacagaacagcctgctcgaacctaatgattatttacagcaggtgccaaatgggtactactctggccgcatgctgatcagattaggcagcactgttgctcgaagcttcctcatctcgtttgccgtcacccgggtggaatctagagacagtgaacgcaggttgtgcaggtcattcaggtgtttgaggccagcattggacacccgtgagtttgacacgttcaagttgatcaaagcagtcaggccagagatcagctccaaggttttgtctgtcagattagcattttgagaaagattcagcaacgtcagggccttcagatccttgatgttcttcactccagcatcagtaacgaacccaccacagactgtaagagaaacaagattcttaaaatatct

SEQ ID NO: 43393 - DNA, 488 bp, Zea mays
  Clone ID: LIB3062-054-P1-N6-B7
gttcttttttttattcttaggatgcagaaacagacggcaggtatcataacaaatgaataggcgtgcttggaaattgccacctaatgtaggattgaccctatcaatcccctcaagttcattctgtacctgattactgtactcaaattcccaggtctcaaagtagcaccaaatgttgatggcaccgattctgcaaacattaatcaacaggctgccaaaagcgagggctggtccagtactacctctactggtactcatactatgccaaccatcgatatcgaacttcgatgagctgcctctagtggaacacgggcagtcgacatcggaccaagttactagtactgaaggaacacaatcagatatccattgcctgagagattgacgatgtgcccttcttcctcctgcttttcttgtacttggaaaccttcccctgcttacccgctgagttgtgcttgtttgcagctgcaggcagctgcgttgccagcaggtgc

SEQ ID NO: 43394 - DNA, 431 bp, Zea mays
  Clone ID: LIB3062-054-P1-N6-B9
attgtaccctccatgcaatgtcacaaatgatccaggacacatcttaacaacacacacaggtcgactgggctagccacctctctactctaagaggtgaatcacgtcacaacacacacacaccatcgccgcgaggcagtgctaccgctaccatctcaacaccaggaggtccgtccgtcgacggaaagcacttttaggcagaacgtaacgcacaaaaatcgggcgccgctagatggggcaccggttcttcgtagtacttactactagtagtagggttaacggcggtggggtggagtggacggcactagaagacctactacgatgactgcacgcgcatgctcttcacgtcgttctgcggcacgttcgcgtcggcgccgttgcctcgtgccgtgcctgcgcctgctttacggacgttctcgtcagggacaatggcg

SEQ ID NO: 43395 - DNA, 539 bp, Zea mays
  Clone ID: LIB3062-054-P1-N6-C10
tgttgaccttttttgttggactttgtgtttttgttttaaatccaagatgcaccaaatttttgccgctgtgacaatgcttcgacgtacacaaagatcttacatgtgagccggttcctaggtgaggtcaaggcaataaacatacttgtggaaagaagcaccgctgggctctaaaccgtggcacatacatttggtgtaatgcttgccccgaagaggtaagcttgtggctctttgacgttagagccaaaccatctatatgatgagcttgaaccaacgctggaggatgcttagatcggtgagacgggtacctgataagtagaagtgggcagcataaaccttgccagggggcactatgatggacgtatcggccctctgttagttattaatttgactttggagccagtttatcttgcttcgggtggtggcacaagccataagagagaaggacagcatataccgacaatgagcttactgcttttattttgcgggctggcatgaatcatgatgtaggtgcctcattggagagagaagcttttctactg

SEQ ID NO: 43396 - DNA, 576 bp, Zea mays
  Clone ID: LIB3062-054-P1-N6-C2
atcttattatatgaagcagacggtgcattactacatctaaaatgtcattacaaagtagaatatgtatgaacataagtcataagagcatctcgatgtcgctccacacttttaatacacacagatactatacaagtataaatccattgccttctctggaagcaattcaccacacgtgtgttcccttagttacccccaggaatatggcaacggcagcaacaacggcagcaattgtgcaagcaacatatcctggtttctctcggtggtcatgtacccgcacgcatatcagaacgaaagccccaatgtaccatggaatggcagcaaggaaaaacccagcaatgaacaggcaccagcctaagccgaggccacaacatgggagacgcctcattctcacaggtcttccttcagcaacaggaccatagcctggcacggcctggtacccctgggcgtagtacgtctccgcgtgcgcgtacggctgttgctggttgtggtagccgccgacgtcgtcgaacccgggaggcggggcaggctgcgggaacccgaccggaggatgcccagggccctggaacgtgtccgacc

SEQ ID NO: 43397 - DNA, 284 bp, Zea mays
  Clone ID: LIB3062-054-P1-N6-C3
ttttttttttttttttttttttttttttttttttttttttttttttataaaaaaatttggaaaaccggggggtttccaaaaggatccaagaggcgttccaaggaaatataaggtgaatagaataaaagatggtcaaaaacatggggttgggttgggattgggttaaatgggaaaacgaaggaaataccccaaaaaataccaacgtaatgcattatgggtaaaaaaagtggttgcaaaggggggtgaaaaggaaaaggaaaacctccttatttatggccagcttt

SEQ ID NO: 43398 - DNA, 504 bp, Zea mays
  unsure at all n locations
  Clone ID: LIB3062-054-P1-N6-C4
caacataagcaaaatcatcgtgatactgagctcgcttacaaaatggtattcctctgaatgttttgtttcctatctaaaattgtgaaacgagaaccaaatcctaccctgtaaatttttatcttgtcaactgtatacagatatacagaccaatttacacaatgttagtatgatgctgtgatcagggaggaggaaggaacatcccccaactgctgtcggatcgccaactcatcatctattgccgccttgtaaaggctgtgaagtggaactcgatctgtagccgccggtgcggcgcgccgccaccgtcgatgccgatgccgacctttttctcgatctccagttcctccctcagcgggatggcggccaggaacctcttgatgaactccctgcagcattccttcccggcgacgaccacctcctcggtgccttcagcccgcatctgcgacgagccgtccaatctcagcatgtangccttgtcgcaaccctcgtgcagccttctccctagcg

SEQ ID NO: 43399 - DNA, 456 bp, Zea mays
  Clone ID: LIB3062-054-P1-N6-C7
acgcgttcgtacggcgaagctgtcggatttcgggctggcgaaggaggggccgcagggggacgcgacgcacgtgacgacgcgggtgatgggcacgcacgggtacgcggcgcccgagtacatcctgacgggccacctgacggcgaagagcgaggggggcagcttctgcgtggtgctgctggagctgctcacgggccgccgctccgtcgacaagagccggcgcgggcgcgagcagaacctcgtggactgggcgcgcccctacctccgccgcgccgaccgcctgcaccgctttatggacccggggctggagatgcagtactcggcgcgcgccgcggagaaggccgccggggtggcgcaccagtgcctgcagagcgtgcccaaggcgcgccccaccatgcgcgacgtcgtcgacgcgctcgagccgctgctggcgctcgacgacgacgtgcccatgggccc

SEQ ID NO: 43400 - DNA, 508 bp, Zea mays
  Clone ID: LIB3062-054-P1-N6-C8
cgacttatgagcacatgcatttctaccaggggtacaactaaaatggttcacattacaacacagaaacctgaatccaagcaattgcatttaaaagctagacgagaacgatgacagccagataaaaggtacgtagaagggtaaattacaaagtatggtatcgcactatttatcttccttgtgacaatgtaaccccgtcacgatccgcatcaagctgatttttgtgacgctgaagcctcaccaccctcaggtctgttgatactgatcgtgcgatcctctggctttgaatcagattcagcaagcctttgcttgatatctctcgctatggagaagaaaacctgctccacattcaggttcgtcttcgcactcgtttcaaaaaatctgatgccatactcatcagcaagagcctgccctcttgaaggcggcacagcccgtttgctttcatccatgtgagatgtgatgcctaccaaaattctattcacattgtcggaagcatgtagctctatggttc

SEQ ID NO: 43401 - DNA, 413 bp, Zea mays
  Clone ID: LIB3062-054-P1-N6-C9
atgctttcttttctttttttaggttgtgttatttttttataaccaccattccttccaaaattggcgtagattgatcaaactgtttgtactgtcttggcatcgtgaaaacctggaaactgtacctaacggaaccgccacctgtcattgtggggggccggaaccctatcctatatgatgcaccccagcaatctaccacatcttacgacctacatgtgttcttcacaaaaacggttatactgctcgcggccatcatataaggagcggttccttgctcaaagaattggacgtaccggacaacggtaggtacagattccagtatcaacgaactttgcactgcaagcatgatcgtcctgccacgcaaattctggtatggttcgtggcgaggataaattgacactccctgacgacgtatc

SEQ ID NO: 43402 - DNA, 483 bp, Zea mays
  Clone ID: LIB3062-054-P1-N6-D1
acacggaaatgatactgaaacagatcaacttccacgactcaccactcacgagcgaatacatctggatcaaagcacccactggccacacattactacagtagagagagtacacagacagaagcgcacacatcggttcatgcctacgtactctgctcgcggcaacatgcatccacgatacaccgcttacgaactgtgtagacgattgctaaacaccataaatgactagagacaggcacacctcgatctagcttaaaataccagtagcattactttattactctccgccatgcatgcattcctcgcccggacgcgcacaggacgcctcatttaattaatcgtgttgcagttaacgttggtgctgatcttgtacggcagggcgactccgcacttgctgggcagtgcggaggcgcggctgatgtaggtgccgctcccgttggcgccgttggcgacgttcttgaggcagcctcagatggtgcggcggtc

SEQ ID NO: 43403 - DNA, 522 bp, Zea mays
  unsure at all n locations
  Clone ID: LIB3062-054-P1-N6-D12
gggttgtccaatgcgcatgccaaccaagcaaatggcagccagagcacagaagagatcattaggcccccaagcatgtttccatgattatgggaaaaatccagcatggtggcacaaaagagtgatataaggaaagggcaaggagagggggggaaattctatcccaacttctttagggaaacccccccaggggaaggaaacttaaccgggggaaagatgggccctaaatccggagctgtatgacgggggcggttaaaagcgaacgagccttataaggcacggtacgtattaagatggccagaaccatatacaccgagtgaggaacaatattctactgcgaaaagttggatcgccgcgaagagagttgcccgatggaggggggaaaaaatggtggggcttctcgctggcctgaactaaacccacttaaaagcatagaatgcggagaatgttaccttgagccaggaaaaaaactggggggcccaatggtnccctccggggctggggggggaaaatagtgggggggcc

SEQ ID NO: 43404 - DNA, 382 bp, Zea mays
  Clone ID: LIB3062-054-P1-N6-D2
tttttatttttgtccattatatccattttttcaagaattcaactctaatatattcccggctaaaagggtttgttgttagatgactgacaattgatgcaatggtgcaattttcgacattggggagatcatagaacccagatgtgtctgttacaaaatatattatatacacataccggttggcccgggacgacatgcaaaatgcactctaacaacgttgcacgaacacgctagttcattaatgacaggaaacttgggcagaaattatatgctgttgcactagacagtcataaatgcttgggtaacccatggaaataatcgatcgggggcggacacagccactcctagatagatgtaattatggttgtggtggttcatgctgtgg

SEQ ID NO: 43405 - DNA, 527 bp, Zea mays
  Clone ID: LIB3062-054-P1-N6-D3
acacggtgtaacgcttgatcttgaattaatatgtacttagaaagcatcccgaacaaatatatgatcgaaataaaagatagtcagcagcatagcataagaacgacactggctgttctgcaactgcctcggtttcctccatccaccccacgtctattgctgctgctcgtcaaactcatggccatgatccagaaggtagctggctgtaagctcttcggccttgttgcatgcaaagaaaacttctagcacaagctcacgggtgaaccccattccctcgagccgctggatagcctcccgttcctctggggtaactgtcagcgtttgtggcacagcagctgccagttgacctagtatgttccctccaggaccaccctcaggagattcattcaccaagcggagaaactcagctagattttcctgaatcaaccgcagaatgtgtgggttttgtttacctagctcttgaagcatgggctgcaagatttgaggattagcctgtactaactgaatgagtgctagaaactgtggaagct

SEQ ID NO: 43406 - DNA, 550 bp, Zea mays
  Clone ID: LIB3062-054-P1-N6-E1
gcataaacagctgcaacgttcgttcttatgaaaaaaacaggtaaacagttctttacacataacctggacaggttgcttgtgccgaacacaaagtcagcacaaacgtgacgagcgttttatacaagcaaatctaaatggtgaccacggcaccaagcaaaagtgacatgactgcaagggtaagacagcacaacatgatgcagctcaccaccgattatttgcaaacttaaccagttcactaccgttcagactccagacttcaagttcaatggcctacctgccacccaataacccatctgaggcccacatccccaagttcgactcgggcaacaagcttgtgtgagcaccgacagatcacacgcccagaaccagcaacagggttaaaatgtcctgtgtgaaacagctaatgacacattaggatgaaaataagagaaaaagaatctaaaagcaggacagggcctaggaataggcacctagaatatacactactttgtgcctaatgtggcaggacatttgccctcatatagccataacagtgtcagcatgacaaggt

SEQ ID NO: 43407 - DNA, 432 bp, Zea mays
  Clone ID: LIB3062-054-P1-N6-E10
atgcgttcgatctacaggaaggccacgccacttgaaggagctcgagcagagggcctttgccatggaggagatgcagacgcgcatcggcggggctagagcaacatccctggtccaggccgacggctccaccggcgacaactacctgtcgggcggaggacacaagcttactgcagttcccagtcctcgtcctcccccgcgctgtcgggcgacagctacggtgcgcccagggaggccaagacggatgccgaggacgccacgaccgccacggtagcgtagaagtcaaacttcataattgatggggggagcggggaaagaaaaaaagggaggcacggcaacgtgggcaccctgaaagagggaacgcaccttggagtcaccgactggacccagaggcaggacccgcctcaggtgggcagaccgtggcaggaccacctc

SEQ ID NO: 43408 - DNA, 453 bp, Zea mays
  Clone ID: LIB3062-054-P1-N6-E11
atgcgttcggaagggacctgaggttcaatgttgtgattatttggcatcccaatgaaggcaaagttgataagcagcagattctctcagatcgctgtttctgcattaagtaatttatctgtatgcttgtgagattaggcaccgttcttctgtggggcagttttttgaatactgtgtcaatctaagactgcatgcaaaaagactctggattagaaatactgaaaagcaacaagaaaggccaagaaatcagtgactgaagcggatcaagagtcttaaatgccttcctcacctggtaatagttcagaataatgggttcttctttttttcgtttttgcagtcaccaaatccgtttcaatgtcaaaaggtacagggtccagcactatgcctatgatgtattcaaaacctaataactggtttgtggcatgcaacgaggggtaccatatatagaattataga

SEQ ID NO: 43409 - DNA, 345 bp, Zea mays
  Clone ID: LIB3062-054-P1-N6-E12
ggttgttggtatatacatatatatgacctaataaggaaagcagaaactctgacgatgccgggtgaaaaagagaccaaaccaactggcactcaaaggcggaaagcgggatctcacgccgaggggccatgggctttaaccgggcgctgaagaggggggtgaaacccgggaaagtggccattgtaaaggaagatataaaatacggcgaagacgctgacgcccatgcaagaaacgaaaccagggtggcgtattcagaagggggggaatgcgaccgcggcaagccgggctgtggctaaaacgccggccacaagtagtaggacggcaaacttgacggcactcccaaggggg

SEQ ID NO: 43410 - DNA, 476 bp, Zea mays
  Clone ID: LIB3062-054-P1-N6-E5
ttttcatagagaagataaaacgtcttatgtagtgcgaaacatatggtacactctatatatattacaatatacaacgggatgatagcctgacagtctaacaacaaccaacattgcacactgtggaacgcctacataaaagcacatggtggatctgcgcactcaccaccgacgcaacctgttgtattcctcacaatgctgtacgtactctctctctctctgtatatatatatatggacacacggactcactcgtctgtctttgcacgaaggccacgatggtactcaccgagagcccatatggggaacaagttgcggtagcttgggtaatcgaagcagaggctgcagttgaagcatcctacatgctcttgctgaggaaactctactgtctccagttgcatgttgatcaattcctttgcagcacgatgtaatggcggtggatctcgatcaaactgtccagcataaattaaagcgagcatt

SEQ ID NO: 43411 - DNA, 326 bp, Zea mays
  Clone ID: LIB3062-054-P1-N6-E6
gtctgttctgttactttcatgtacggtctctagggttcttttcatagagaataatatacagattattcgcccaaagagacgtatgttatatatatgagttgtatgcagtcaccgaactggtacaggcttccgctttccatttcctgttgggagtggtgtagtgtaatcctggggtgtgtatttgtttcatcaatcatgccagccgatttgaatctcgtttcaccagcatgatctgatttgggtatacaagtataaaccgcatcgagcgatcttgttgaatataatatctatatggaaagaaccctcgcgcccgtgctgtacgtttc

SEQ ID NO: 43412 - DNA, 466 bp, Zea mays
  Clone ID: LIB3062-054-P1-N6-E7
agtagaagagctagttgtaacattaagctgtctgccattacacatcatatacgtttgcttacagaagtgcaccctagacacacgaggagagcagcagtaaactaacagctgcattcttgctatattttttaggtcattggttacgtgcatgctatacaaaagaaacttctacagtagtacaactactcacgtttttttacttggactttgacagacagaccacgacaccgacggcagctgcagccagtagcagatgctgctagagaggcagcagccttccatgtgagtcaccgagtccccatcaggggccggccagcgaacctagcaaggctggtggatcacgcgaggagcgctgctcttggggctgccggcgtacttggtcggcttctcggagtgcctgggtttctcccggaacccccgcggggcgtcgccgctcttcggggagcccaagttcagcgccttgagc

SEQ ID NO: 43413 - DNA, 532 bp, Zea mays
  Clone ID: LIB3062-054-P1-N6-E8
ctttcttttctatctttttttttttaaaaccttttcaactaataagtaaataagaaagtcgctgaagcaaacaagagaaactgggtcaagagaatttcaggcactaataaaagttctagaacgacaaaccgtcaccgtcaagctgggagtattcttccagatagaacatcagtctagctcataacatacgcaggtcgccgctatgtgctatgacaaccttgctctttggttgcccgctctgccggccctgagcttgcaccttgtacacaacatccattccagacaacaccttgccaaacacaacatgcttcccgtacaaccagcttgttgtcacggtggtgatgaaaaactgagatccgtttgtctctctcccagcattggccatggacagaatgcctggtccagagtgcttgatcttgaagttctcatcagcaaacttcatgccatagatagatgcaccacccctcccatccccaagagtgaagccacctccttggagcatgaagctgggaatgatttctgggaatgcact

SEQ ID NO: 43414 - DNA, 591 bp, Zea mays
  Clone ID: LIB3062-054-P1-N6-F12
aagcagacaacgcatcgtcttatttcttacattagcaacaacgacaagaaagtaagcatcactactgaaccagctgacaacgagacggcacggcatcatgcataaacatgcatgggaggacgacgcataaacgaaggcaacgatgaagacatacagctggtcggtctggaccttgcacacccatatacgtatggaattatataacgaacattgcgtgcgtacgttatacgctgatgatgcgcgaggcctagctagtagctgcaggcgtagttggccttcttgaacatggcggcctgcgcgacggcggcggccttggaagtgagcgcgacggcgatgcagtcctgaacctgctgcgtgctgtaggcgtacttctcggcggcgatggagttgaggtaggccgcggcgccctcgcggaggaggtcgccgtagcagtcggtgcgggtgttgcacagcgcgtcctgcagcgtctgcagcttgctcccgaagaaggcgctgcacacgtcgccgaaggagccgaggatgctgcccagcgacccgatgcacgagatgatggcgtccgggtggctcttccaatagtcgcaggtgccggtg

SEQ ID NO: 43415 - DNA, 510 bp, Zea mays
  unsure at all n locations
  Clone ID: LIB3062-054-P1-N6-F2
gaagcaacatcgtaaacagccataattattctcaataacccggtagcaatgcaggggaattaacaactcttacaacatcaggtgttgtaaaccacacaatacttcagaacagacacacataacacgatagcaggagcaactctcggcagatcacgggataagggcagcacactggcctgatgctgcgtcatcagcaaacttctctagtactcgtcaccctcgtcgccatcctcgccctcatagaactcagcaccgacctgctcgtagtccttatcgagcgccgccaggtcctcacgggcctgagagaactgaccttgctgcataccctaaccgacgttccagngcacgaaggcacgcttggcgtacatgaggtcgaacttgtggtcgatgcgggagaacacctccacaacactggtggagttggagatcatgcacacggaacgctgtaccttggccaggtcgccaccaggcacaacgctaggaggcttggagttgatgccgcacttgaag

SEQ ID NO: 43416 - DNA, 533 bp, Zea mays
  Clone ID: LIB3062-054-P1-N6-F3
caagcagaatggaatctacatttatctagatacgcccaacggagcacagcacacaacagaacgggcgaaccgaccaccttctaagaagcaagctacaactgaacagaaggaagcgacactatactgtactgctgcaacctgaggaagaaacagtccaaaacatcacctgaagctagacaaaataaaacgccaattatcaccacctggacagcgagctgggaagtcgctcaacaccggccacaggttcagacaaagaagtcctaaagggctatcagaaataagattaggtccaaactcttaaggatcagctgcctgtgggggctggccgttagccatggacagcctgtggctggctaacagatccccgacgtgcaccgcgatctcggcagagcatcggaactgccgagttgatcggcttcaagtcgatagggatggctcttgctgcgtccaagaccttacggacatatgctgcatgctctttcctagtacacttcaactcctcgctaatatgggcgactgggctttctagatat

SEQ ID NO: 43417 - DNA, 505 bp, Zea mays
  Clone ID: LIB3062-054-P1-N6-F7
atgctgttcgtagtggtcacccgttcctttttcttgttcgtcttcaacgaccatccatccgaactacatgtgcgtggtcgcacatcacgctcccgctcatgctgatgggctacggcctgctcgtgtgcagtgccacggctgcacgtacacagggggggggggaccttcaaggaggacttggaggacacaaagcctgcaacgatggctgaacaccatacaatccggccgggggcggggcccaggacctggggcaccagcttgggcgctcgggcgggcatctaggccctgacgtcgacagggtactggcccaccgtgttcaccgatttgaacccggcccagatggcgtacacctggacgtaccagcgcgccatgcggatctttacggtgacggactcgatgctcatttcggggacgtacatgggtacctcgctgtgcacgatgatggagagcgtggtacccttggactcccgggcgctgaacacgaagtgcatcaccatgaggaggc

SEQ ID NO: 43418 - DNA, 298 bp, Zea mays
  Clone ID: LIB3062-054-P1-N6-G10
ggctactacacagtaatttccattaaattgcaagcatcctgatacaaaagcaagtgacacctcaaaaggcaacacaccagctaaccatgctcagcagtcaacacaagaagcatgacaggaaacagaaaagtaacaattgatttcagcgctgagttttcaccaatctccacagcctggaaagttcaagccacaacattattaacagaaaagtcgtgtcctacaccaaaccgcaagaaacgaggttacaacttatggtaagaaaatgcagtatcaggcaacaaccaagataggatgaagt

SEQ ID NO: 43419 - DNA, 497 bp, Zea mays
  unsure at all n locations
  Clone ID: LIB3062-054-P1-N6-G11
acgcgttcgttttaagctgctcgttgttaccgacggggacaagggatgcaggtacttgaccaaggactttaagggcagcgtgcccggcttcaagggcgacaccgtacacaccaccggcgcaggcgacgccttcgtgggctccctgctgggggggggggccaaggacgactccatcttccacaacgaggagaagctccgcgaggctctcaagttctccaacgcctgccgcgccatctgcaccaccaagaatggcgccatcccggcgctgcccacggaggccagcggccaataccccatcagggacggacatgatgatggggggaagccccggtgaaataacaagtcactgcaccatgcagccccgacccttgaagttgacggcctggggtgcggatcaagaggactatcgagtattagcaaccgtgtgtgcacctttacgctgagacggngggaacgggtaaattaagctagcttaaggggagattccgcccgggggc

SEQ ID NO: 43420 - DNA, 472 bp, Zea mays
  Clone ID: LIB3062-054-P1-N6-G2
cttatcttgttgtcagattaatatccaattagtgtgcaccacccctagcatggcgcctctagttcaccacattaaacatccaaatttgcaaattaacacattcaaggtgcttacaacataaggcgcgcatgaacagatgtgcaaaccgctcccaaaagcacatctgttacaagttcattacaagctcaccattgagtgaaaacatgagaaccaaaggatccatatcaagtgttcatgagagccaaaaggttgttggaatcttgtcaattgctacttgtacttgacttggtcactacatggcaacagccaatagattaacgccacctaaatccttgaaatgaaaatgtcaaagagcaaggtcctggaggccctcttgcatgtcttggagacaggaccaaaaggtggcaggttgtttagatttttaataaactgtgaatttgttcctaagccaatcttgagagcacatgagagc

SEQ ID NO: 43421 - DNA, 379 bp, Zea mays
  Clone ID: LIB3062-054-P1-N6-G3
ccgatattccaaaccaataactgtttcttattaagtagacaactagacacatagtcataggcgaacgcaatcctggtttctttacactcgaataatcacctcaaatcacaggtttacatgttcactatggcatgccaagacatggataagcatcactccagccagcaacttgaattactagggtatgccaagatacagttagggatcacctgtcggactaactgtccgtgtaaacatccccaatagattgcataaggggaatgcctgccttcttagtaacggtacttggtggagtagtcctttggagcaatcaccagaccacggcctttccgggcgcccctgtatacggtctccacaatgtcgatgaactcttgcttgt

SEQ ID NO: 43422 - DNA, 492 bp, Zea mays
  Clone ID: LIB3062-054-P1-N6-G4
atgctttctgtactgttagatcgtgagatttttaagagcctaaactttattattgttcctccaaacttaaaacacaagttggttgcccgatttatgcagccgcagccaatgggccagggtgggtcgcccaatttcgtgcaacagtttgcaagtaggacacagatgcttacattacatagagggtttcaaaaaaaggtcacatggcaggactaagtttcctgacaacttactagtgactaaccaggtccagctgcatggaagtattattgctggatcatgcaggagtcctaatgcccagaagaagcctgatcacctgatgctggcattataatgccatactctgcacatcctcagtagggccgaactttcgtgctatcacacaaaccctagtgtgctctaatacaacaattctgatcaggttacacgctttttacagtgttgcctgacattagaggggccctattcctaggcctcaaactggggccaacatta

SEQ ID NO: 43423 - DNA, 532 bp, Zea mays
  Clone ID: LIB3062-054-P1-N6-G5
atagaaaccgtagcagtgcaacgacaactcaactagaaatagattacaaaatcgtttctcattacactataacacatatttatgcataagttattgtagtattctatgtttccgttgcaacgcacgggcatccacctagttatatataaggggcataacgaacctgactgacagttttgtacatcatttttgcacgaggtagccatataaaaactcgttccagacatcaggaactccggggaggcaccagtgcgtgcaatccgcgtaactggctgggtctgcgatttgctctttcgtcagaggagcaaactgtttcctgtacaccgtatgatgcccgtccttgcggtagtcagacagctcggtgatgttcagtatctgaacatgtatgcctttcggctccaatgttcgaaagtagtgcttagctttggccatcaagctgtagtctgtagttgcagctttgtatccggttttgtagatcggctctgtttcggtaaggcacttgttcttgacttctacaccccagttgctagcc

SEQ ID NO: 43424 - DNA, 527 bp, Zea mays
  Clone ID: LIB3062-054-P1-N6-G9
tgtttttacatagataccagatattatggatacttagctctttacgatacattatgccacgctacaacatcaagcacagtagccagcgaagtgacggagcagtgtgaggacgctcccacaattattttcttggttacaacaatagtcgggagcaacgttacgatctattttaccttttcctttcccttccccttattggcatcaagctttgcttgcacccgggctgctgacgcggccttcgcttgctgcctcttttttttctcctcttatttggtagcagcagctagctcccgttgcttcttaagttcttcaagtctggctttctcatcagatacactgcctaagcttgaacctttcctcggactgcaagctactagctccacctcaaaaataagggttgcattatgaggtatctctggtggcgagcctgcagctccatatgcatattctgacttgcatgtaatttttgcaacctcgccaaccttcatagtcttaaggctatatcccatgctctgatgacagcgcct

SEQ ID NO: 43425 - DNA, 608 bp, Zea mays
  Clone ID: LIB3062-054-P1-N6-H10
ctttcttacatagataccacatattatgcatactcagctcattacgatacgtgatgacacgctacaacatcaagcacacggggacagagcagcgaccaactaaggtgagggcagtgatacaagaattaactggggatcaacagtgggtaaaaacagcgtcacgatctgtataagatgatgctttagctccatccgagagccatcaatcggtggttgcacatgacctgcgtgcactgggctgagactgctgaatcttttgttaccacctcatgtagagaacgctatagcttgatccgaaagcggacaaggcgctgcaagcaaagcatggtgaatagatccactaccttaaatggagccgaggctgcaactgtaagatgctagctacaccatacatataaagctggaatctggaggccagagatacggcctgccgcaacctccatatgcgtggtgggactagcatgtagcaggcgcagcctaggcaaccgctatagccgtaaggctatataccatgcttggctgacagagcctatgacaattccaaaggagaaagtagagtcctctgcatgggtggtatcgaaaacttcaccagcctcagcaagtgtacc

SEQ ID NO: 43426 - DNA, 566 bp, Zea mays
  unsure at all n locations
  Clone ID: LIB3062-054-P1-N6-H11
atgcgttcgttagcgagaatagcctatatagcacgcaaatgaaacactcgagcactggttacactggcagacaaacaacccgtgcaaaaaataaaagatcaaaagtatgaaccatatcgggatgggatgggatgcgatgcgatgcacagcagggcaatgcaagggcccgttgtgatttggattaggcgccccagatttactggncggatcacatgacgatctcgggcttgaggatgctggattcgatctccttgtgcgggagcacgacaccgccgttgctgtagatctcgtcgcaaacgtggacgtgctcgccgaggatgggaatgtcctcgacgcgcgcccacttgacgacggtggagtgccagcctatgatgctagatggagacgcatgcgtgctgcttgacgcgcgcggcgcgcatgacggtgcagcgggacaggcgcaccccggcctgcaacacgcagtctggaccgaccgcgacgtggggcccgatgaggcagccgtccccgatgaccgcgggcttgtgcaccaggacgttggccaggacgtgcgcgcccgacgcgagcct

SEQ ID NO: 43427 - DNA, 250 bp, Zea mays
  Clone ID: LIB3062-054-P1-N6-H12
gtgtttgtttaattattatttttttggtctgactggctatatatgttgtacgtgattggatcgattattcattcgcttcagtgaccataaaaaaccatgaggacccccaatagagagcctaaaacaaaaaaagataaacgcaaaggcgggagggttcttgattgttaaaaaaaaaaaaaaaaaaaaaaatcaacaacccaatccctgacaatcggggtaggggggggggcccgaatacctttttcccgcc

SEQ ID NO: 43428 - DNA, 374 bp, Zea mays
  Clone ID: LIB3062-054-P1-N6-H2
ctttataacggttgttaaaactgtttgtttttagagatggacagagagcacggcaacaacgacctctgcaccacccataacttcacatggaaccatagatgtgaaggaccatagcaggagctcatcaaccggttggtcacagattgaaagagcagagcttcagggttataggcacaagattgaatcacccgcggtttcacaacataatataaagggtcttataagtaacatgaaataagttggcttagccctgggatacaaagcataaggggggcggttcccttggcaagcacagatccttatacctaattatttatactggtagaggaccaacacaccatggttgccgccgttttgatacttagaaaccctgg

SEQ ID NO: 43429 - DNA, 510 bp, Zea mays
  Clone ID: LIB3062-054-P1-N6-H3
gagagaaaactcgagatgaatttggtgtccgtccgagatgttacatctacaatacgcagtacacaacagcctgcccatcctttacactcgttttacagatgacacaagtgctactccagacacaagtgctcctcctaaaacgagatctcgctcggcgcatggaacgttcgcccacggcagatcgcttccaggttctctccggcgtaggaggagagcggagaaacttcaacgcctgtcatatacaagggcacagagtgcgtcaagaagccgccagcggcgactacccatctgctgtggaggcggagcagcatgagcttcgcgctatcaggggtgtcatacgttgcgccgctggcgttctttaccggcgcgaattcctcctcccgcatgacctcgaaaagtgccgtggacggggatgatgtgaaggcgtcaaatataaactgttcaagcttcaggcccgtagagaacccatggatggaagggatcttcttcttagctagcatggatacactg

SEQ ID NO: 43430 - DNA, 341 bp, Zea mays
  Clone ID: LIB3062-054-P1-N6-H4
atgcgttcggtgttgcttaggacttaacctacaataaagcctgacgggggtaacgaggcacccatcgatccgcagtccatgctgagctgatgcatggggctgctggagccgaggatgaacacagctctaacaactgacacagagcgacccggggggagagcacatatgggccacaacaaacacgagacgaacggagataaacactcatggactagggtaaacaacacgggcacgaacaggataacttggcctcgcgggccccaccgacgaaggacgccaggccccgcgcgagtgggcgtatccaccgccacgggtgccaccgccggagcagcacgcgacca

SEQ ID NO: 43431 - DNA, 387 bp, Zea mays
  Clone ID: LIB3062-054-P1-N6-H5
ctttgttttcacatgtaatcatttattagcataaaacgggtcggacacacactactggtaaaggaactaccacaccactacattctagcttgcatcatccgacggcacatacacatcagacacacacgctgaactgaagctacacaccactacgtgctaagctgtactaagagcctttatttaaccgtttgggcagctccgaagaactctggcacacacttagctgagcgcttcacgtagcgcctgtagcacacgtcccgggggtcgtaaatcatcccgaaacgctcggcgtagccactagaccactcgacactgaccaacatagaccatgcgaagagaacgtgcacgtcacggcgcaagactattgatcctttgacaaccgacatg

SEQ ID NO: 43432 - DNA, 492 bp, Zea mays
  Clone ID: LIB3062-054-P1-N6-H6
tttgtttttgttgttcttttattttatttgttgttgttttttgtttgtttaagacaataacccctctaaattgttggcacacaaccaacccccaaaggaatgggcttaagagtgaaaacaacccccactctttgctgtcatgaaatggatattggtgcaattatttaccgcgggatgtatacactgcagactgggctgattctctataaggagcaaacggtacaataagctttaggtgcctacagacccttataggggggtcaggagaaattgagggcatacaactgggggggggctaaaactaattagtggtggcaccaaaaacttcatccgggggcaaccgcaggtttttcccggtgtgggcactcctttttatggaacccatttatcaactccctttgcctttgggtcacctccgtcggaaccctgatattgaagggtacatactgattcccaaacactggcgagttcctcgcttttattcctttgccc

SEQ ID NO: 43433 - DNA, 543 bp, Zea mays
  Clone ID: LIB3062-054-P1-N6-H8
accgatcaagctatagcaatctattgagattgaaagaaatgagaaccgtcaggctcttttaattcgtctgaaggactctatacagctcatctcccagcgcggctaatgtgaccggtttctggatcaggccattgactgctgacctctggcatctatcccggatgttgtcgacgattcttgctgctagggcaataatcaacggctgccaactattgctactgaacttgctgatcgcgcgggctacttcgaatccatccatcgtctgcatgtcaagatcaagaaccaccagctggaaggacgactccgcagcgaaggagctgatgcattggacgccagaagcgaccgaaaggactcggcaaccaagcttctctaggagcctgtgagttacagctcggttggtgcagtcgctgtccgcaaggaggactctgagcccattaaagttgggaattgcggatgatctgtacaaatctgaggacgctccagagaccggagtcacaggttccaactggaactggaggactagcatgatagtttctccgatgc

SEQ ID NO: 43434 - DNA, 389 bp, Zea mays
  Clone ID: LIB3062-054-P1-N6-H9
ctttagaactgttgctaaaactgtccgtttctagagatggacagagagcacgagaacaacgacatctgcaccacccataacttcacatggaatcatatatgtgaaggaccctagcaggagctctgcaacccgttggtcacagaattggagagcagatttcagggtgctatacattaaattgaatcaccggagctttcacaacataattaaacggtctgataagtaacataaattaaactggcttagcactgggttacataggttaaaaggagcagtccctttggcaggcacagttccttatacctatattatctatacgggtaagggaccaagccaccatggttgccgccgctttgatacttagaaaccctgggccaaagcatactata

SEQ ID NO: 43435 - DNA, 130 bp, Zea mays
  Clone ID: LIB3062-024-Q1-K1-H9-SP6A
aatcgagggtgcgctttacttgttgtcttccactcagaaagacatctgacggcgactgattggcgttcgcttctcaacccgaccaacctagcctcagtgcgtgcggtgtcactcactagaggctcagagg

SEQ ID NO: 43436 - DNA, 460 bp, Zea mays
  Clone ID: LIB3062-027-Q1-K1-B1-SP6A
gcggtagagattcgtgttagttcgccaacatctctctttagatgttttctggtgtacaaagtacatacagaacgacagcaagaaacaaatcagatccagacatgagaaaaaaaggctgaaactctcgacgatctgactggcctctgaatgaatccggagagcgttaacgaaaaggaaccatcattcaattctattgccaatttgccattcgtatcgcgtagtacatggcactactgctacaagctcacgacaagtcaaagcagaattcgcctcgtccgtggatccgatcgctcagagacagagacgcaggtccgtgcagaacccgaggtcgtggccaccatccaagtcgagcggcgccgggaggttgagatcgagcgacgggcgcgcgccgaccgaaccgtggacgcgtcgtcgccgtcgtccacgacgaaggccgacgacgcgagtcgctgtggcagtc

SEQ ID NO: 43437 - DNA, 72 bp, Zea mays
  Clone ID: LIB3062-027-Q1-K1-B1-T7A
catgtgcgacgcggcgcgaggtacaggggcgtgcggacaggcgtgggcggtttgcggggagaccgggcccgc

SEQ ID NO: 43438 - DNA, 449 bp, Zea mays
  unsure at all n locations
  Clone ID: LIB3062-032-Q1-K1-G2-SP6A
acgtanaactgaatccatttgtccactcagatctgtatctgtggcaaattatgaacggttgttattgtccctaacagcctccggggggttcagcgtccagctgctcctacgtcaaaaggatatacaaggccgaggtagtatagtaaatacataggcagagtaactgtagcacatcgattgttaaggctgccacatcgaagaggctacatcagagacattcctgcagttacattgaactgcaacatttttcttaaaatgctaattgtttgcacgatcatctgagtgcaaaagtttgtgctcagaaatcgcgtatcattttcttgctatcgttggacggattataccaaacatttgtgctcagacatcgcctgctatttctagtcgccggtgaccctccacgggcgacctccgtccgagctgctgcacgcttggttgccaacaaagctgtc

SEQ ID NO: 43439 - DNA, 556 bp, Zea mays
  unsure at all n locations
  Clone ID: LIB3062-032-Q1-K1-G2-T7A
gngaacaataactggtataagtgatatggatcctttaaggtggaaaaactcccaatggcgcaatattcaggttgcatgggatgaagcagcaccaagtgagagacgcaccagggtttccctttgggaggttgaacctgttatcgctccattcttcatttatccctcgccattgttcactgcaaaacgtccgaggcaacctggggtaacagatgatgatagctcagaaatggacaatctttttaagcggaccatgccatggtttggtgaggaggttggcaagagagatctgagtactcaaaacggtttagttcctggattaagtttggttcagtggatgaatatgcaacacaacccctctcttgccaacacggttatgcaaccggaattgctaaattcgttagctggaaaacctgtacaaactctggctgcggctgatctatctaggcaaattagcttccagccccagttcctgcaacaaaataacatccagttcaacacttcgctgctaccttcccaaaaccaacagaccgaacagttagcaaatgtaatagctaca

SEQ ID NO: 43440 - DNA, 543 bp, Zea mays
  Clone ID: LIB3062-039-Q1-K1-C12-SP6A
ggataatccgagcaagtaaccattatgcagtgtccacatcgcgagctagcaatgtattagtaccgtaatctagctgatctgataaagccaatcaactttgcaacaacacactacagacgttataaggaaaactttaaacataagcatgtcgcggcgcaacttgagataacattgtccagagcatgccgttacgccattccactgctttggtaaaagatatggatatgaaggcactgccactagcttcgggaaggctgtgaaaggtaggcacgagcctcacttccagagcttgcgcagggacatgttcttctccgtgtctttcttcatcaccttggccactagcatctcgaagtcctcctgggtaacgtgcacccttctctcacgaagagcaaacattccagcctctgtgcagacggccttgagctcagctcctgaggccccattcatcttttccgcgatctttttcagatcaatgccacgcatcaagttcatttttcttgaatggatcttcaagatatcgaaacgtgaatcctcgttaggatt

SEQ ID NO: 43441 - DNA, 561 bp, Zea mays
  unsure at all n locations
  Clone ID: LIB3062-039-Q1-K1-C12-T7A
ggaacatgcaccatccattatatttatggatgaaattgactctatcggatctgctagaatggagtctggaactggcaacggtgacagtgaagttcagcgtactatgcttgaacttctaaaccagcttgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggcgcacgttacccaggaggacttcgagatggcagtggccaaggtgatgaagaaagacacggagaagaacatgtccctgcgcaagctctggaagtgaggctcgtgcctacctttcacagacttnccgaagctagtggcagtgccttcata

SEQ ID NO: 43442 - DNA, 347 bp, Zea mays
  Clone ID: LIB3062-042-Q1-K1-A4-SP6A
cggcggaagggacgataatccacttttattcacgaattgttcgggcctgccatgaattttttcctacgatcgagataatccacacttattcacaaattattgggtcctgccagcctcagcagcgcttaatgaatttttttcctacgatcgcccgatcttttccaccagggggttttcgatctccattcttttcctcatcaggagggggtacttttggaggagctcccggtcctgctccttgtcgccggccgggactgccagctttgagccaagggaggtcttttccaggttgccctggtacaggcacgagatggggacgaagctaccttgcgcgttgacagccaccc

SEQ ID NO: 43443 - DNA, 557 bp, Zea mays
  Clone ID: LIB3062-042-Q1-K1-A4-T7A
agaaaacaccccctctaaatggtgggaagttaggattctactacaaagaccatgagatcctccctccacttccagtgggtttccatcggtacactgtcgaaaacctcaacgatgtctcatcagacgctctgttggagcgtgaagtggaagaatttgacccaccgtccgaggttcgtgccatcattgagggccaaatgctgtcgatgcgaggccacgccgagaggtttggcatgccgaaccctcccaaacggatcatagcaaccggcggggcatcctccaacgaaagcatcctcaagtcagtcgcgcagatcttcggctgccctgtcttcacagtccagagacctgattcggcatcgctgggcgcagcgctgagagctgcccacgggtggctgtgcaacgcgcaaggtagcttcgtccccatctcgtgcctgtaccagggcaacctggagaagacctcccttggctcgaagctggcagtcccggccggcgacaaggagcaggaccgggagctcctccagaagtacaccatcctgatgaggaagagaatggagatcgag

SEQ ID NO: 43444 - DNA, 494 bp, Zea mays
  Clone ID: LIB3062-053-A4-F1A
gatcaaacgacgctggcaaaccaaattgtctttcacaggctacagcacatgttaaattatcggataaatttaaaccacacccaatttctttcccggtgtacccacacatactaaaaggaggtttctacgatattaatgactattctacaacacggaaaagtctgattcaggcaagtaaaagaaaaggttaacagaattcacttaagctagtttataatacatccgaatccttgtgctccaatgaagacttcctactccaatcctatcctgcttccgtactagaaggctgcagctatgtacaacgagaggtatcccacaaaaggtagctatgtggtgccttcactcaaccatgagattgagctctccctcttgacgatgcacttttgtaattgctcctaggaaccttctcgccaggaactttagagattatgagggaactttgcaatccctctagcaaccttgaagttggttgaattcgcctgttagaccgtctg

SEQ ID NO: 43445 - DNA, 476 bp, Zea mays
  Clone ID: LIB3062-053-A4-R1A
tatgacaaccacaatggaactggtcctcgtgaagaatgggtgccattgagacaagagggggataagccgcctcagatacgtcttgcacaccctgctaccctctccaaattcaaaactaggaaacggcgcagggaaacagcaggcagttgtttatgggtcattggagatcatgtagacgcatgggtcaataattgctgttggcgagagggagttatttctcagaattatgagactgacgagacgaaatatgttgtacatttttcagttggaggtggtggtgaatccttagtagttgatgcttggagtcttcgtccatcacgtgtttggaaagatgttcaatggatagagtggtcccgtgcaagagaaaggaaatccaagtctaataagggcgattcacctcttgagaaacgccaaaagacagacttgcttcaagcaggtggcaatctatctgttgttgacgaaacgggaggatcttc

SEQ ID NO: 43446 - DNA, 220 bp, Zea mays
  Clone ID: LIB3062-012-Q1-K1-B4-M1
ccggcgtgccgttctacgtggaacgagctgctctactggaagctcttcttccccagcaacgatcaggttctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctc

SEQ ID NO: 43447 - DNA, 219 bp, Zea mays
  Clone ID: LIB3062-012-Q1-K1-B4-N1
gagaacaagagcatcgacagcgtccatatccgaaatcaaaacaaaacatttgaaccccatgtctttgttcatctagacacattttctttgggctagcccctagcagttggtttccaggcgtatgtatgcaggcaccaatgcaccatcagagaacctgatcgttgctggggaagaagagcttccagtagagcagctcgttccacgtgtccggcacgccgg

SEQ ID NO: 43448 - DNA, 568 bp, Zea mays
  Clone ID: LIB3062-029-Q1-K1-G6-M1
cggaaaactctttaaaacgttttcaacttcatcgtctcagcgaaacacaagccagtaattttcttcaggacctggtcacctgatcacttcgaggatggagagtggttcagcggtgggtcttgtcgcaggaaattgccctacaacaagggagagtacagagagggtaacatcgagcgtgtcatgagacagatcgagcttgagtccttcaacaaggctgtagccgcgcttaggggttcagcggacgtggatagactgagactgatggatacctacagcctctcgtccttgagaccggacggccacgttgggccttacagaacaccctatccctttgcaaggggcagcagtaaatccacgcccgtccaaaatgattgcttgcactggtgtgtaccaggccccattgatgcatggaatgatcttgttatgaagatggccctggatccatgaaaaccttatggatttgtatggtgtgctcttatggagtaagtagcagctaagtgggcacaaaaaagtgtgtccgttttggtttagctgtaaaataggagtgctagcaaatagagaaacctca

SEQ ID NO: 43449 - DNA, 444 bp, Zea mays
  Clone ID: LIB3062-029-Q1-K1-G6-N1
gggggggccaacctgtaaaaccagaaacaatggggattttttgcccagttgaaacttataaagttttaaaacaacatacacatttttttgcaacaaacccaaccctggggtttttttttttgctagccctcttattttacagttaaaccaaaacggacacctttttttgggcccacttagctgttacttactccataagagcccaccatacaaatccatagggttttaagggatccagggcctttttaataacaagatcattccatgcataaagggggccgggtacacaccagggcaagcaatttttttggacgggcggggatttactgctgccccttgaaaaggaatagggggttttgtaaggcccaacggggccgtccggtttaaaggacaaaaggctggaggtatccataagtctaagtttatccacgtccgttgaaccct

SEQ ID NO: 43450 - DNA, 645 bp, Zea mays
  Clone ID: LIB3062-046-Q1-K1-C3-M1
gatgacggtgctccactctccggttggagttaggagcatcgtgacctccttggtggctttcttcatcctagccagctccatcgtgttcctcctcgacagaggccaggaagagcaagtgcaagtggcagtcgagcatggacgccaagaagtgcaggtgaagctggaatccgggctgcaagaaccggcgataagagggacaacccaagagggggacgccagcaacgaggagtgcaactggtccaggggaaggtgggtctacgacaacgtgtcccgcccattgtacagcgggctcaagtgctccttcatcttccccgaggtggcctgtgacaagtatggcaggaaggatgccatgtaccagcactggagatggcagcctcatggtcatggatgcgacctcccaagatttgatgccatcaagctgcttgaaaatctgagaaacaagagaatggtgtttgtgggcgactcagtcaacaggaaccaatgggtctctctcgtgtgcatggtggaggcctcaatacctgacgacaggctcaagatacgcaccttcaatggctcactcatctccttcaaggcattggaatacaacgcaacgatagatttctactggtcaccactactggtggagtctaacagcgacaaccccat

SEQ ID NO: 43451 - DNA, 416 bp, Zea mays
  Clone ID: LIB3062-046-Q1-K1-C3-N1
aactgcaacataactgtgatatatagaaaccgtagcaatgcaacgacaactcaactagaaatagattacaaaatcgtttctcattacactataacacatatttatgcataagttattgtagtattctatgtttccgttgcaacgcacgggcatccacctagttatatataaggggcaaaacgaacctgactgacagttttgtacatcatttttgcacgaggtagccatataaaaactcgttccagacatcaggaactccggggaggcaccagtgcgtgcaatccgcgtaactggctgggtctgcgatttgctctttcgtcagaggagcaaactgtttcctgtacaccgtaggatgcccgtccttgcggtagtcagacagctcggtgatgttcagtatctgaacatgtatgcctttc

SEQ ID NO: 43452 - DNA, 515 bp, Zea mays
  unsure at all n locations
  Clone ID: LIB3062-032-Q1-K1-G2-F3A
cacttcgctgctacctccccaaaaccaacagaccgaacagttagcaaatgtaatagctacaccaaaccaattgggaagtgttatagtaccacaaaaggcagttcaaaattgcagttctgaacagaaacagaatctggttacacaaccactgcaagtcagccaaccaatggttagtgtggcacagcctcaacttgtccatactcaactccagcaacctcaagtagttctccaggctcagcctcagcaacctcaagtcattgtccaagctcaactacaacaacagcaacctctggttcaaaatcacaccaccatacaaggtggccttcaacaaatccagcttctgcagcaacagcaagttcagcagtcagtgcaggaacaacagcaaataaagatacagccttttcaggtacctaatgatgccaacatggtaacacagttatctgatcagatgaaaatacaactattgaaggctctacagccacagcagcctctggtcatggaacangcagaaatga

SEQ ID NO: 43453 - DNA, 563 bp, Zea mays
  Clone ID: LIB3062-032-Q1-K1-G2-R3A
ctcgtccagctgctgacgctggttgccacaaagctgtctccgtagtcgctggccagcctcatttgcctctcttcctgcggcgaaagaatcctgatgcaccgcacgcagttcacgaagtcctcccatgggtcatcaccaactaataggacatccttctcgtgatcttcgtaaaccagtttccagccaactctgttttggtcgctgagctgcccctcaattccaaacatacgagcaacgtcatgcttcagttcatcgtacccagaatatctgttgatgtcgatagatcttccaacagcgccgcgcttgtgcaccttggtgtatgttcgcatacgttgttgagcaggacctgtagcccgggaatttctgtttaagaattggatatcattgatcgatgaatctatggaattgaacgcgatatcagcaacgccaaatggatgtgagatcattgaagatgataactcttgctgagaatcctttgatgaaatgtagttagagatgccgtttcctggcatctgatccatgtacttgtcagcttcgaaagcagttccaagcacatcgtcttc

SEQ ID NO: 43454 - DNA, 603 bp, Zea mays
  Clone ID: LIB3062-026-A1-F5B
cgaacgtgagcaaggttatgacccaccgcctccaggcagccatcgagcggaggtcgctggagggcgtgaggctggagctgtgcgcgccggaccgggcgggcctgctgtcggaggtgacgcggacgttccgcgagaacgggctgctggtggcgcaggcggaggtgtcgacgaagggcgaccaggcgtgcaacgtgttctacgtgacggacgccgccggcaaggcgccggaccggggcgccatcgacgccgtcagggagagggttggcgcggaccgcctcgtggtgagcgaggagccccgcccgccgcagcagcagctgtacccggacgcctccgggccaggcagcggcggcggcggtggcctcgggctggtatacctcggcaacctcgtgaggaggaacctgtacaacctcggcctcatcaaatcgtgctcgtgaaggccggccgggtgctcgggtcgagacccgcgtcgtggaggggacggacggacacgcgccattgctctgtgtacgtactgtattgtacatacagggcaccgacgtcggtcgtcagatccagtgaccggcaccgacgccgtggcgtggagcaggatggctagccgtacgt

SEQ ID NO: 43455 - DNA, 559 bp, Zea mays
  Clone ID: LIB3062-032-Q1-K1-G2-F4A
cagccttttcaggtacctaatgatgccaacatggtaacacagttatctgatcagatgaaaatacaactattgaaggctctacagccacagcagcctctggtcatggaacagcagaaaatgatatttgatttgcagcaacaagcagtaaattctcagtcaactgctcagcagtgctcacaggtagctacccaagtggttggtttgcatagcagtagcactaatcagtacccgacgcagcaaaagactcaacctctcaaaacatttcaagattttcctgggaatgctgtttctattgtaaaaccagaaattgtcacctccgtgggtgctcgctctttgcatgtgcctggtggggtgcagtcaatgaagatggatgaagttccctcttcttcaacatcgccatccacaaacaacaatcctgttattttgcgatcaactccaagtagctccaagaaccaatgtttacctactgcagcaaaggctcctcagtcatctgttgtattgggttctacacttgaacagggtatgaagccttgtgacagtacacaacacccaatggtga

SEQ ID NO: 43456 - DNA, 618 bp, Zea mays
  Clone ID: LIB3062-032-Q1-K1-G2-R4A
ccgggaatttctgtttaagaattggatatcattgatcgatgaatctatggaattgaacgcgatatcagcaacgccaaatggatgtgagatcattgaagatgataactcttgctgagaatcctttgatgaaatgtagttagagatgccgtttcctggcatctgttccatgtacttgtcagcttcgaaggcagttccaagcaaatcgtcttcgttaagaggctccatatggccatcgatatttgccccaaatagaaagttatttcctgcatctgtaacctcaaactcactatctggaactgcttctctcaacggttgatgttgattgaaggatgaaggtggaaaactttgttgcagcgatccatcagcctgtgaaaggcaaactgaagtcgctgaagatgatgtatccaaataatccagctgattgttgttcatgtagtcttgtccagtagctggcctttcttcagccagcttgggaatcaccattgggtgttgtgtactgtcacaaggcttcataccctgttcaagtgtagaacccaatacaacagatgactgaggagcctttgctgcagtaggtaaacattggttcttggagctacttggagttgatcgcaaaataac

SEQ ID NO: 43457 - DNA, 499 bp, Zea mays
  Clone ID: LIB3062-047-Q1-K1-E5-F2A
gataacaactaagtgcatatatataatacaccaacaatatagcgccagcaacgaaacaatacagatttttagaacgaagataacgcagcgcatacactattatatatacaaatttcgcgttagccactttgaagtacagacatgcacaaggatagcacatctggttaaaccaatataatgccgcgaatgggactatcccagtctttatcttcttagaagcactgatgtcagccccactcatgcagataacatgcgatgcgatggtccttcctttcaaggcaacgacaacttcaaggatatatctgaaccatcatcacagtcgagcgagcttcctgaatgcaatgcagtcattacagattcagacgactgcccgtcttcagtaaggatattttctgcagcagcagcaaccaccattgtgccagccgttagcacctgaggcatttgttcttttagacgcctgttctcatcttctagctgtgtgcccttttgcagtaattcg

SEQ ID NO: 43458 - DNA, 496 bp, Zea mays
  Clone ID: LIB3062-047-Q1-K1-E5-R2A
ctgatggtggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttatacagatgagaggtgaagaccttgagggattgagtgtagaggaattgcaccgaatggaaaggaaacttgaagca

SEQ ID NO: 43459 - DNA, 511 bp, Zea mays
  unsure at all n locations
  Clone ID: LIB3062-002-Q1-K2-B3.F2
aagaaaatagcgcatcaagcttggttgggtgtatccatgggtggatttcattttcaggccccaaaaggcttgcagctagctaaccagccgtttcttgcatccacatactacagatttatttttattttttttacttttcaagtacaagtttgcatacaaaagttgcaaataaaaccattgacgtgtgcccttcgatgctttaatttcagggagcttattccttttagccgatcgaactgaaaatccgtggttcaatcaaagtcccggttggaggagcgctccctgccgggtaatcctatgtacagctccgtctccacgtccatgtcattgctcggtgccggcaggctacgcggccaaggagggacacagcggttcaggtccggtggcgcctccggtggagactggaggttgcgcttatcccgcaactctttgttgtcttggagcagggtcctctccttctccttcagcttggatatctgctgctccagcagnttgtgtcttcttccctctg

SEQ ID NO: 43460 - DNA, 592 bp, Zea mays
  unsure at all n locations
  Clone ID: LIB3062-002-Q1-K2-B3.R2
ggnttggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaacgaatgtttctgggtgaaaatttagaagaatgctccattgaagaactgcataantctggaggttaaactggcgaagagccntcacgtcatcagagggaagaagacacaactgctggagcagcagatatccaagctgaaggagaaggagaggaccctgctccaagacacaaaaagttgcgggataagcgcaacctncagtctccaccggaggcgccacc

SEQ ID NO: 43461 - DNA, 550 bp, Zea mays
  Clone ID: LIB3062-052-Q1-K1-A6.F2
cgcttgaacttgtacacgaggcaatatagactatggacatcagaattctcaaaagtcaggttcggtcgcaaatatcctgggattaagtgctcgaagcatcactgttaactgtgaattgccattctaaagtctctggaacattgcaagattgacttttgaattttctacagtgcatcccaaggatatcaacaaatgcagtgcaaatgaaatgtgatggttgcaaagaggattctattgcgtcctcctgatctttgaaaatgtgccggtctcggaaaagtaagtactttgagttccgcctccgagaaggtttccttggacctgtggatttgacaactctattccctgaactggtgtaaatgccaaactggatgtcaatcctgatgttgcaccactgctaccatagctcttctccttgaactttttcgccactttagcagcaagtttgctttgtccagctgaaacacgtagcttgccactccctgcttgtccaagcatgccataaccttcccccaaccatcacctagtgagctctcctccggaatcccaactg

SEQ ID NO: 43462 - DNA, 634 bp, Zea mays
  unsure at all n locations
  Clone ID: LIB3062-052-Q1-K1-A6.R2
tcccggggnatgcgctcaaaaaaaaaagtgcttgttttgtagagagcagaatggggtacattgcaccaaacctttctgcaattgttggcagtgctgttgcttccaaactgatgggtactgcaggtggtctgggagcacttgcaaaaatgcctgcttgtaatgttcagttactcggtgcaaagaggaaaaatcttgctggattttctactgccacttctcagtttcgtgttggctatcttgaacaaactgaagtatttcagagcacccctccacctttaaggactcgtgcctgcagacttattgctgcaaaatcaactctggcagcaaggattgattcaattagaggtgatccaactggaaaagctggacggaacttgttagaagaaattcgtaagaagattgagaagtggcaagaaccgcctcctgcgaagcttccaaagccactcccagttccggactctgagcctaaaaagaagagagggggcncgtcgtcttcgaaagatgaaagaaagatatgcgcagactgatatgatgaagcttgcaaatcgaatgcagtttgngattccggaggagagctactaggtgatggcttgggggaaggttatggcatgcttggacagcagggagtggcagc

SEQ ID NO: 43463 - DNA, 328 bp, Zea mays
  Clone ID: LIB3062-053-Q1-K1-B8.F2
ggggggggtttttggggggggggggggggttgggtttgggtgttttttggggggggttgttttttgttttgggtgttttttgtgtggggggttttgggggggggtttttgggttgggggggttgggggggttggggggggggggggggggggtggtgggggggggggggttttgggggggggggggggggggggggggggggggtttggtttgggggggttggggggggggggcctttggggggggggggggtgggggggtgggggcctttcgggggggggggtttacggggtgggggggtggggggtttttttttttgcccgggggg

SEQ ID NO: 43464 - DNA, 359 bp, Zea mays
  Clone ID: LIB3062-053-Q1-K1-B8.R2
tcgtaaaaaaaaaaaaaaaaaaaaaaaaaaaaaaaaaaaaaaaaaaaaaaaaaaaaaaaaaagaaaaaaaaaaaaagaaaaaaagaaataaaagaaaaaaaaataaagaaaaaaagaaaaaaaagggggggaacttttgatggggggtcgttttttcgtgggttttttgtgtgacatcgtgtgggctttttttggggggggggggtggtttaatttcctcccgtccgtctttcttattggggccgggtggggggaaaccccgggttggggccttatcgaatagggttcccaccgattggccttttggcatgtggcctttttttgcacggttgtttggcacgctgttgtgtttgcctacg

SEQ ID NO: 43465 - DNA, 330 bp, Zea mays
  Clone ID: LIB3062-010-Q1-K1-A1-R2B
tcgcgcaaactcaggggaggtgcgcgcaagcaagaccacgagggagcagcgggcatgcaggcaggcagccatggggaggtctccgtgctgcgagaaggcgcacacaacaagggcgcctggaccaaggaggaggaccagcgcctgatcgcctacatcatggcgcacggcgaggggagctggcgctcgctgcccaaggccgcgggactcctccgctgcggcaagagctgcaggctccgctggatgaactacctccgcccggacctcaagcgcggcaacttcaccggcgacgacgacgagctcatcatcaagctccacgccctgctcggcaac

SEQ ID NO: 43466 - DNA, 582 bp, Zea mays
  Clone ID: LIB3062-047-Q1-K1-C6-F2B
ggtctcaagcattagctatatatgttattttcccatgcaacatgcagcttgcacaaggggaagtacgcactcaacttttacccacctagaaaagaaaaggctaaatataatgaaaactaacaactttagaaacaggtagctagctagccgactaatcagccaccgacttccttgcttgaacggattagcttggtctggatcagctgctggacacgctagctacaacaggtaataatccatgggggcggcgtccagcaagctggcgctctggacaggacggtggaagtgggtgtcgtcgtcgaacagccacgactcgatcgcagacagcggcatcatcagctggaacggcgcggccggcggcttcgtctcgtactcgaacaccggcccaccagcggccggcgcgacgacggcggtgccaccgccgtacgacacctccgaggaggacccggtggacgcggtctcggcgccgccgggcgtgcccggagccccgccgcggcgcttcccgttcaagccggcccatccgtccagcatccgggagacgttggtcgcggtgagaacgtacgtccccaaggcggcaagcgc

SEQ ID NO: 43467 - DNA, 336 bp, Zea mays
  Clone ID: LIB3062-047-Q1-K1-C6-R2B
gtggacgccggaggaggacctcgtcctcgtctcctacatccaggaccacggccccggcaactggcgcgccgtccccaccagaaccgggctgatgcggtgcacaagagctgccggcttcggtggaccaactacctccggccgggcatcaggcgcggcaacttcacggagcaggaggagaagctcatcgtccacctccaggccctcctcggcaacaggtgggcggccatcgcgtcgtacctgccggagcggacggacaatgacgtcaagaactactggaacacgcacctcaagcgcaagctgcaggccggcggcggcgacggcgacggcgacggggcg

SEQ ID NO: 43468 - DNA, 508 bp, Zea mays
  unsure at all n locations
  Clone ID: LIB3062-047-Q1-K1-E5-F2B
gataacaactaagtgcttatatataatacaccaacaatatagcgccagcaacgaaacaatacagatttttagaacgaagataacgcagcgcatacactatatatatacanaatttcgcgttagccactttgaagtacagacatgcacaaggatagcacatctggttaaaccaatataatgccgcgaatgggactatcccagtctttatcttcttagaagcactgatgtcagccccactcatgcagataacatgcgatgcgatggtccttcctttcaaggcaacgacaacttcaaggatatatctgaaccatcatcacagtcgagcgagcttcctgaatgcaatgcagtcattacagattcagacgactgcccgtcttcagtagggatattttctgcagcagcagcaaccaccattgtgccagccgttagcacctgaggcatttggtcttttagacgcctgttctcatcttctagctgtgtgcccttttgcagaaattcgccgatttgt

SEQ ID NO: 43469 - DNA, 501 bp, Zea mays
  Clone ID: LIB3062-047-Q1-K1-E5-R2B
aaggatgctgcccctccacgcgccggccttaacttctctgcccgatccccgcgtaccctgatggtggatccactggccttcggttttctccagctggagagccaggcgtggtcgtacgacgagagagaggatcggaggccgcggcctgtcggatatggcgccgagaggcgggagatacggcggatagagagcgcggcggcgcggcaggtgaccttctccaagcgccggcgcgggctgttcaagaaggcggaggagctcgccgtgctgtgcgacgccgacgacgcgctagctgtggcttccggcgccggcaggctctcgcagttcgcgagctccagtgtgaatgacatcgttgacaagtacagtacacattctaagaatctggggaaatcacatcagcagccttctattgatttgaatgtagagcagagtaaatacagcgggttggacgagcaacttgctgaagaaactaatggtcttatacagatgacaggtgaaaacctt

SEQ ID NO: 43470 - DNA, 104 bp, Zea mays
  unsure at all n locations
  Clone ID: LIB3062-032-Q1-K1-G2-F10A
agcagcnggacgccgaaccccccggaggcggnnagggacaanaacaaccgggcataaaangccacagaaacagaaccgaggggacaaangganncagngnacgc

SEQ ID NO: 43471 - DNA, 327 bp, Zea mays
  unsure at all n locations
  Clone ID: LIB3062-032-Q1-K1-G2-F7A
aacgatagcaagaaaagacacgcgagttctgagcacaaacttttgcactcagatgatcgtgcaaacaattagcatttttttaaaaaagttgcagnncaatgtaggtgcaggaatgtctctgatgtagcctcctccatgtggcagccttaacaatcgatgtgcacagtactctgcctatgtatttactatactacctcggccttgtatatccttttgacgtaggagcagctggacgctgaaccccccggaggctgttagggacaataacaaccgttcataatttgccacagatacagatctgagtggacaaatggattcagtttacgt

SEQ ID NO: 43472 - DNA, 331 bp, Zea mays
  unsure at all n locations
  Clone ID: LIB3062-032-Q1-K1-G2-F8A
gctccaagaaccaaggggnacctactgcagcaaaggctccncagncatcgggggganngggnncnacacttgaacagggtatgaagccttgtgacaggacacaacacccaatggtgatggccaagctggctgaagaaaggccagctactggacagatacatgaacaacaatcagctggattatttggatacatcatcttcagcgacttcagtttgcctttcacaggctgatggatcgctgcaacaaagttttccaccttcatccttcaatcaacatcaaccgttgagagaagcagttccagatagtgagtttgaggttacagatgcaggaa

SEQ ID NO: 43473 - DNA, 379 bp, Zea mays
  unsure at all n locations
  Clone ID: LIB3062-032-Q1-K1-G2-F9A
ggggcgagcggaancgcgacaanccaagaccaccgagcaacgacagccatttctnaaacagaaacngccgggcgggaggacctgcgcaacaacgtatgcgaacatacaccaaggtgcacaagcgcggcgctgtggagacctatcgacagcaacagatattctgggtacgatgaaccgaagcaagacgttgctcgtatgtttggaattgaggggcagctcagcgaccaaaacagagttggctggaaactggtttacgaagatcacgagaaggatngcctattagttggtgatgacccatgggaggacttcgtgaactgcgtgcggtgcatcaggattctttcgccgcaagaagagaggcaaaatgatgctgggccagcga

SEQ ID NO: 43474 - DNA, 432 bp, Zea mays
  unsure at all n locations
  Clone ID: LIB3062-032-Q1-K1-G2-R5A
cattgggngtngtgtactgtcacaaggcttcataccctgttcaagtgtagaacccaatacaacagatgactgaggagcctttgctgctgtaggtaaacattggttcttggagctacttggagttgatcgcaaaataacaggattgttgtttgtggatggcgatgttgaagaagaggacttcatccatcttcattgactgcaccccaccaggcacatgcaaagagcgagcacccacggaggtgacaatatctggttttacaatagaaacagcattcccaggaaaatcttgaaatgttttgagaggttgagtcttttgctgcgtcgggtactgattagtgctactgctatgcaaaccaaccacttgggtagctacctgtgagcactgctgagcagttgactgagaatttactgcttgttgctgcaaatcaaata

SEQ ID NO: 43475 - DNA, 483 bp, Zea mays
  unsure at all n locations
  Clone ID: LIB3062-032-Q1-K1-G2-R6A
tgancagataactgtgttaccatgttggcatcattaggtacctgaaaaggctgtatctttatttgctgttgtncttgcactgactgctgaacttgctgttgctgcataagctggatttgttgaaggccaccttgtatggtggtgtgattttgaaccagaggtgctgttgttgtagttgagcttggacaatgacttgaggttgctgaggctgagcctggagaactacttgaggttgctggagttgagtatggacaagttgaggctgtgccacactaaccattggttggctgacttgcagtggttgtgtaaccagattctgtttctgttcagaactgcaattttgaactgccttttgtggtactataacacttcccaattggtttggtgtagctattacatttgctaactgttcggtctgttggttttggggaggtagcagcgaagtgttgaactggatgttattttgttgcaggaactggggct

SEQ ID NO: 43476 - DNA, 413 bp, Zea mays
  unsure at all n locations
  Clone ID: LIB3062-032-Q1-K1-G2-R7A
gaagcgaatttgcctagatagatcaggcggagccagagnnngnacaggntncccagctaacgaatttagcaattccggttgcattaccgtgttggcaagagaggggttgtgttgcatattcatccactgaaccaaacttaatccaggaactaaaccgttttgagtactcaatctctcttgccaacttnctcaccaaaccatggcatggtccgcttaaaaagattgtccatttctgagctatcatcatctgttaccccacgttgcctcgggcgttttgcagtgaacaatggcgagggataaatgaagaatggagcgataacaggttcaacctcccaaagggaaaccctggtgcgtctntcacttggtgctgcttcatcccatgcaacctgaatattgcgccattgggagttttt

SEQ ID NO: 43477 - DNA, 431 bp, Zea mays
  Clone ID: LIB3066-037-Q1-K1-D7.F4
ccgccgcagacatggaccacttgcgcccgtaacacccgcgtcacggacgccgccacgaacgacgtcgccagcgccgccaggtacagcgacgacgtgaacagcgtcagcagctggctgtcgaacttgcagtactggttcgtgtccttgttcgccgccgccttggcgtacacggaagggaagaactccttgaggaacgacgccatggacgtgacaccgccggagatgccgatgtcgtacccgaagatgaggccgcccgatgacgccaccaggcaggtgaagaacacgaacggcgtcatgcggccggggtacgtcttgcccccggccgcgttcaccaccacgccgcctgccattgccgcgggcgcgggcggacagctggggcaatggcaacgcgagaaacaacacgagacgacgaggaacggcggacgcgcggg

SEQ ID NO: 43478 - DNA, 478 bp, Zea mays
  unsure at all n locations
  Clone ID: LIB3066-037-Q1-K1-D7.R3
actgggccaaatgccagcctgnacaggggccagggtgggctcgatgtctcactctcaccgccgactaactttccatcaaaattgattcttgttcatactccatagcatgcacagattgattgaactgctacttgagattcttgtcattgttattagagagagagacagagacagaacgattggcatagcatgcagaattgtttggaagaagctagcaaagcagttccttgtttgtatcctctgtaccagaagatgagtttgatctaggattaatccctgcaaggcaaggtaaagtaaattcatgttgtactcaaaactaacttctcccatatctgtacgtcgtataaaacaaatccctgcaatgtgcaaagattgtcccgcgtagtgattttttcgtctccagcaagatctcaaacaagccccaaatctaagtgtaacatgtttgcattcgaattaaaaaattgaatcccttattgtg

SEQ ID NO: 43479 - DNA, 304 bp, Zea mays
  unsure at all n locations
  Clone ID: LIB3066-037-Q1-K1-D7.R4
aaaaaaaaantaaaaaaaaaaaaaaaaaaaaaaaaaannnnnaatnnnaaaaaaaaaaaaaaaaaaaaaaaaaaaannaaanaaaaaaaaaaaaaaaaaaaaaanaaaaaaaaaaaaaaaaaaaaaaaaaaaanaaaaaaanaaaaaaaaaaaaaaaaaaaaaaaaantatannnnnanaaaaaaaaaaaaaaaaaaaaaanaaaaaataaaaaaaananaaaaaaaaaaaaaaanaaaaaaaaaaaaaaaaaaaaaaaaagaagaaaaaaaaaaaaaaaaaaaaaaaaaaaaaaatatttatt

SEQ ID NO: 43480 - DNA, 223 bp, Zea mays
  Clone ID: LIB3066-042-Q1-K1-H8.R3
tacgtgttggcatcagccccatgcatgacattaaaacacagctgacagccggctacccaagtaaataaggatacgcgacatacactgtcgtgccaattagtatggctgcttcttcttttttaatattattagtcaacattttatttcattttccttgtactgatgctactccatgcatcttaattatattcatatatatatacacgtcgccatatgacatttt

SEQ ID NO: 43481 - DNA, 273 bp, Zea mays
  unsure at all n locations
  Clone ID: LIB3066-042-Q1-K1-H8.R4
taattaatataatcagcanaanatgtacgactcgtcgtccttttgcttggcgcggtcgaaaggactggatgggaccgggtatcatcgatcacttgagcaatggcgggatgctctgctcgttcctgaagtagtcgcaggggtccaccttggccttggtcctggcgagcctctcgaagttgccattgtagtancttctcgccccagaccctgccgctgtcgtaggtggagacgtcgccgaccacctcgttgacgccaaggtcgaggtccctgtag

SEQ ID NO: 43482 - DNA, 227 bp, Zea mays
  Clone ID: LIB3066-045-G6-F4A
tacatcgcttccatcgatgttgtgtgcgtcaaagctgaattcccacccaacctgcgtaggcctgtactatactgtttcccttgtttttgtcggccgtttcgtgtagttcgagaataaatgatgagtttgcttttgaacctgtatatatttcgcctttggataattcggggacaaacaagtcaaggtcgttatataccgtctttttgaataattattacgattaaaaa

SEQ ID NO: 43483 - DNA, 753 bp, Zea mays
  Clone ID: LIB3066-052-D12-F4A
atgactatagaatggcccttaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaggtaccacgcggagtgcgtgaagcagtggctgatggtgaagaacttgtgccccatctgcaagacgacagcattgtctgccaacagaagacaaggacagtgagcgggaatggagaagcctgttggttatttgctttgacaaacgttcagc

SEQ ID NO: 43484 - DNA, 345 bp, Zea mays
  unsure at all n locations
  Clone ID: LIB3066-052-D12-R1B
cgcttcccccttccacccgccgatcgccctccgcctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttaganaataatggttttgtactcccncaaagtcattaaattcttaccattcaagacttcaagaagaag

SEQ ID NO: 43485 - DNA, 685 bp, Zea mays
  Clone ID: LIB3066-052-D12-R4A
gacggccactgttgttgtgtccatgatattctgatgggttgaatggtgcaacattagaagaaacagttgattcaaaagaagggtcccaaggcccaagcataggattttgaggtgcatgagaagatgagcttgagcttgcaaatccattaacaaaatgatagcttccagcaactgcagcatttttccttttaatatgctctctagcactttcaccaatactgtcatttctgctactctcatccatagttcctgggacttggttttgaggcaacacttgattccctgatccaaagctctgagcatgagaaacatgtctgttcattgatgttgatgacatgcagggattgtacatatttgatgcgaagacaaaaccagaatcaacacctaaattcgggggtgggttatgaacagactgatggtgatgatttatgctcatatcatagtaacttcgcacaccagagagaccaatgttcattgcatttcctacaactctgacagcatgttgtgcaccttgctcagatatctcactaccattgcctccttgagcttgccctctctctgagtctgatgtaagattaatgacttggggagtacaaaccatatttctaaatgccataacaccaattattatttcccttagcttcaagaatagctaaggcaggctaagtcaaacaactatgcctta

SEQ ID NO: 43486 - DNA, 242 bp, Zea mays
  Clone ID: LIB3066-045-G6-F4B
atcggcggctgctgggagccaagcaactgtttcgatcgaggttgtgtcgtcaaagctgaattcccacccaacctgcgtttgcctgtactatactgtttcccttgtttttgtcggccgtttcgtgtagttcgagataaatgatgagtttgcttttgtacctgtatatatttcgtctttggataattcggtgacaaacaagtcaaggtcgttatataccgtctttttgaataattattacgatt

SEQ ID NO: 43487 - DNA, 58 bp, Zea mays
  Clone ID: LIB3066-052-D12-R1C
cgcttcccccttccaaccgcctgatctgcctccgctcgctctcaccgcggcagggcga

SEQ ID NO: 43488 - DNA, 398 bp, Zea mays
  unsure at all n locations
  Clone ID: LIB3066-020-Q1-K1-F1
cccacgcgtccggtggtggtctcagtcctcgcgcagccgggcaccaacatactgctcccgaggccgggctatccgaactacgaggcgcgcgcagggctgcacaacctggaagttcgccggttcaatctgatccccgagagagggtgggagattgacatcgacggtctggagtcgatcgccgacaagaacaccaccgccatggtcatcataaaccccaacaacccttgcgggagtgtctacacccgtgagcatttggccaaggtcgcggaggtggcaaggaagcttggaatactggtcatcgctgatgaggtgtatggaaatctggtgtttggggacacccctttcgtccccatggggtgtcttggccacattgcccctgggttgaccatangatcact

SEQ ID NO: 43489 - DNA, 425 bp, Zea mays
  unsure at all n locations
  Clone ID: LIB3066-001-Q1-K1-C3
cccacgcgtccgcggacgcgtgggcactcgcgaactccatttcgatcccatttgaaatcaacccatcctcgtttcctccgtctagcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttccgttggcgctgaatatgttgntgagtctactggtgttttcactgaccaagaga

SEQ ID NO: 43490 - DNA, 176 bp, Zea mays
  Clone ID: LIB3066-011-Q1-K1-G4
gagcggaattggatgggtttgaatcccaaacaagtcaaacttcttctcaatttttttcaagccgactcaatccatgtgttttgggaataaccgaccaagcccttagtgtgtttgttacttcattccgcatggtttgggcctttgaagttaaaagaatcataagaccttgttcggtt

SEQ ID NO: 43491 - DNA, 107 bp, Zea mays
  Clone ID: LIB3066-035-Q1-K1-C8
cccacgcgtccgcccacgcgtccgaaccactacgatacacccgttataggttgttatcggtaaacttttaacggtcattctatttcaaaagttttgcattttgcact

SEQ ID NO: 43492 - DNA, 384 bp, Zea mays
  Clone ID: LIB3066-021-Q1-K1-B3
tgattatacagtattctgtctctatagattgtagctgcagcagtctgaacatgaaattaacgaacaacctcggtactgcttggccaggatcccggtgctttcaactagttagggctcgttcggttagctctcaatccatgtggattgagtgagattggatgagtttgaatcccaaacaaattaaacttaattttttccaatcccatctaatccatgtgtattgggaataaccgaacaaggctttactgttttatctgtccagcagtaccgaggttgttggttaatttcatgataagagagcgagtttcagcaatgttcgtatactgattatacagtattctgtctctatagattgtagctgcagcagtctgaacaaacatcaat

SEQ ID NO: 43493 - DNA, 438 bp, Zea mays
  Clone ID: LIB3066-019-Q1-K1-H5
tgcccatgttcggctgcaccgacgccacgcaggtgtacaaggagctgcaggaggccatcggcgcgtacccggacgccttccaccgcgtcatcggcttcgacaacgtcaggcagacgcagtgcgtcagcttcatcgcctacaagccccccggcagcgagtagagaccgtggctagatcgaccaatggccatgtctctgcctgttgatcggatcaccttcttgcattggttcctctctctctccctccttgtttttccctttatctcatcatttctttgctactgcatgcaatggttccttttgcttccaacaattctcctgctgatgtatccagcatggcatcatccatctacaattacgtacgtagtgcaacgactgtcgattcgttgggtgaggaacatatatgtgaatgcaagctccggctaccatacatgtgtaa

SEQ ID NO: 43494 - DNA, 409 bp, Zea mays
  Clone ID: LIB3066-002-Q1-K1-B12
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatg

SEQ ID NO: 43495 - DNA, 353 bp, Zea mays
  Clone ID: LIB3066-027-Q1-K1-H12
gtcgttgtgagaattcttaattcatgagttgtatggagggacttatgtcaccacaaacagaggctaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaatgacgatgctatcacatcgagcccgttcctggggacccagatcaatatatctggaatgtagcttat

SEQ ID NO: 43496 - DNA, 399 bp, Zea mays
  Clone ID: LIB3066-021-Q1-K1-G1
atcacacacactcgcgaactccatttcgatcccatttgaaatcaacccatcctcgtttcctccgtctagcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagaagttgctgtgtttggctgcaggaaccctgaggagatcccatggggttccgttggcgctgaatatgttgttgagtctactggtgttttcact

SEQ ID NO: 43497 - DNA, 415 bp, Zea mays
  Clone ID: LIB3066-051-Q1-K1-D3
aagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcg

SEQ ID NO: 43498 - DNA, 316 bp, Zea mays
  Clone ID: LIB3066-031-Q1-K1-E3
cggacgcgtgggctttgctgttgtgatcttcctcttccttggttcggttgagggattcagcgacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctatgaagggtgttggcaaggcttttatcaccgcttttcgctctggtgctgttatgggcttcctgcttgcatcaagtgggcttgt

SEQ ID NO: 43499 - DNA, 409 bp, Zea mays
  Clone ID: LIB3066-040-Q1-K1-D6
cccacgcgtccgcccacgcgtccgatgtctgtgaaagaaattgagcctgcacttgggagcagctcatcatctccaccgtcctgatgatttttggtattgctctaatcagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcccgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgta

SEQ ID NO: 43500 - DNA, 434 bp, Zea mays
  Clone ID: LIB3066-029-Q1-K1-G8
aaggtccactactctgctgatgacgctctcatactacagcaaaaagcccaggatgttctgccttacttggatggccgttgcgtttatcttgttggaatgatgggttcaggcaaaactacagttgggaagatactatccgaagtgttaggttattcgttcttcgacagtgataagttggtagagaaggctgttggtatttcatctgttgctgagatctttcagctccatagcgaaacattcttcagagataatgagagtgaggtcctgagggatctgtcatcaatgcatcggttggttgttgcaaccggaggtggtgcagtgatccgaccaatcaattggagttacatgaagaaagggctgaccgtatggttagatgtcccactggatgcacttgcaagaagaattgctgctgtaggaaccgcgtctcgaccact

SEQ ID NO: 43501 - DNA, 406 bp, Zea mays
  Clone ID: LIB3066-009-Q1-K1-C12
aaaggggtggtgattacagtgaaatgtctaaggcgtacagaccattccatgcagatgcaacggatgacttcaagtatggagttagagctgtgcatggaggtggaaggtcatcagccagagaaaccattggcagggtggctgcaggagctcttgcaaagaaaattctaaagctcaaatcaggagtggagatcttggcatttgtttctaaagtgcaccaagtcgtactttcagaagatgcagttgattatgagactgtaaccttggaacatatagagagcaacatcgttagatgtcctgatccataatatgcacagaagatgattgctgccattgatacggtacgagttataggagattcaattggtggggtcgtcacatgcattgcaagaaatgttcctcgtggtct

SEQ ID NO: 43502 - DNA, 426 bp, Zea mays
  unsure at all n locations
  Clone ID: LIB3066-030-Q1-K1-F10
attggaccgtctaacccacaagtggaacattgaaaatttcaatactacagagcaccagatgcaagacacaccatacttgtccagtcgatataccagtagagatattctagccttgggtatcagagacttcaattcctctcaacttacttaccagcaagaacttcaacatcttgaaagttgggtgaaagaatgcaggttggaccaactaccatttgtgcgacaaaatttggcatacttcttattgtccgctgctggctgcatgtactcccctgaactgtctgaagctcgcactttgtgtgcaaaaaatggtgcgctcataactattgttgatgacttctttgatgttggaggatcaaaagaagaacttgaaaaccttgtcatgttggttgagctgtgggacgagcatcacanaattgagttttactc

SEQ ID NO: 43503 - DNA, 423 bp, Zea mays
  unsure at all n locations
  Clone ID: LIB3066-007-Q1-K1-B11
cccacgcgtccggctgcgctgctgcctacagctagagatgcatcgatctcagttgcccgcctcctgtccgccatggtggcggcggcctcccgcgatccacgacacgaaggcgtccatggtgcccgcgtccgaccggtagtgcttctgcgtgaactcgaggaactcgcgccacgtgaagtccgggaacgcgcgcgggcggcccgcctgcttgttctcctggaggagcgcgcccggcgggcggacgacgcggtccagcggcgggttgaggaagaaggcgagcgaccggcgggcgccgtcgccgctcaccacggcgcggtgcangcagctggtgtgacgcccgtcggtgagcgcggcgaaggtgtcgccgatgttgaccacgaacgcggtcccgcggggccgnaccgggcgccacggtccgccgcc

SEQ ID NO: 43504 - DNA, 391 bp, Zea mays
  Clone ID: LIB3066-047-Q1-K1-A9
gagtcgctctgcactgcacgactcctcccccatctaccactacctgtctacctaccgagcccatcgactgcccctcgcaacgcaatggcgctcgccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagtgggcggtcgacagctggaagtcgaagaaggcactgcagctcccagagtacccgaaccaggaggagctggaca

SEQ ID NO: 43505 - DNA, 438 bp, Zea mays
  Clone ID: LIB3066-011-Q1-K1-D4
gcggttgattgatatattgaatcccgaaaacagggctgggagaataaccatcatcacaagaatgggacctgaaaacatgagggtgaaacttccacacctgatacgcgctgtccgtggggccggtcagatagtaacatgggttactgacccaatgcatgggaacactatgaaggccccttgcggactcaaaacccgctcgttcgacaggattttgggtgaggtgcgtgcgttctttgatgtccacgaacaagaagggagccaccctggaggagtgcatctagagatgactggacaaaatgttacagagtgcatcggcggttcacgtacggtgaccttcgatgatctggggtcacgctaccacacgcactgcgacccaaggctcaatgcctcacagtctctggagatggcatttatcatcgccgagcgccttaagaaaag

SEQ ID NO: 43506 - DNA, 434 bp, Zea mays
  Clone ID: LIB3066-011-Q1-K1-D6
cccacacatccacatttccaataacacatttcatcgcaacatataccatccttcactggtggcatcatgaacacatgtgggtgaaacttacacacctgatacccgctgtccattctgcccgtcagatagtaacatgggttactgacccaatgcatgggaacactattaaggcccattgcggactcaaaaccctctcgttcgacaggattttgggtcacgtgcgtgcgttctttgatgtccacgaacaagaagggagccaccctggaggagtgcatctagagatgactggacaaaatgttacacagtgcatcggcggttcacgtactgttaccttcgatgatctggggtcacgctaccacacgcactgctacccaaggctcaatgccttacagtctctggagattgcatttatcatcgccgaacgccttatgaaa

SEQ ID NO: 43507 - DNA, 437 bp, Zea mays
  Clone ID: LIB3066-031-Q1-K1-F6
cggacgcgtgggcgagcaagccttaacccggcaagactccaccaccggtcttttctacgactgctccgcccacatgctctgggtcggcgagcgcacccggcagcttgatggcgtccatgtggagttcctgagggggatcgccaacccccttggcatcaaggtgagcgacaagatggagcccggcgagctggtgaagctgatcgacatactgaacccgacgaacaagcccgggaggatcaccgtcatcacaaggatgggggcagagaacatcagggtcaagttacctcaccttatccgcgcggtccgccaggctggacagagtgtcacctggatcactgacccgatgcacgggaacaccatcaagactccttgcggacgaaagactcggccatttgactccattctggccgaggtacgggccttcttcgacgtgcacg

SEQ ID NO: 43508 - DNA, 293 bp, Zea mays
  Clone ID: LIB3066-008-Q1-K1-A2
cgcgcgcatcgccgccaaggtggccgccaaggcctacgagctcggcctcgccagccggcggccccgacccgacgacctcgtcagctacgcggagagctgcatgtacacccccacctaccgcagctaccggtaaggaccacccatgccgccatgcgtggcatggagccatggccggcgctagaggagtgagttttacacgtacgtactttgattttttttatgtactgtatttctgtgtacggcaaaatacaccacacccacatatatacggaggtgaagttgattcttctgac

SEQ ID NO: 43509 - DNA, 446 bp, Zea mays
  Clone ID: LIB3066-021-Q1-K1-B5
cccacgcgtccgcccacgcgtccgcggacgcgtggggatgtccaaacatactgggtctccgatcgaagagtgccgcccgaagatctggctgatggactccaagggcctgatcgtggtgtcacggaaggactcgctgcaggcgttcaagaagccatgggcgcacgagcacgagcccgtggcaaccctgctggaggccgtgcagtccctgaagccgacggtgctgatcggcacctcgggcaagggcggcaccttcaccaaggaggtggtggaggcgatggcgtcccagaacgagaagccggtcatcttcgcgctgtcgaacccgacctcgcactcggagtgcacggcggagcaggcctacacctggaccaagggccgcgcggtgttcgcgagctgcagccccttcgacagcggtgagctggacggcaaggtgctggtgctcgggcagt

SEQ ID NO: 43510 - DNA, 456 bp, Zea mays
  Clone ID: LIB3066-019-Q1-K1-E9
cccacgcgtccgcaagtcctggggtccacatgatgatgcaattactgattaggaatgagagagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagt

SEQ ID NO: 43511 - DNA, 424 bp, Zea mays
  Clone ID: LIB3066-004-Q1-K1-D6
tgcgtgttaagctcatcatgaaagaaggggtgaagaacttcaacccggtttatctctgggacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctat

SEQ ID NO: 43512 - DNA, 325 bp, Zea mays
  Clone ID: LIB3066-032-Q1-K1-F11
gcgtccacgcgtgcgcccacgcgttcgctagctttgttgctgaatgcggagccagtctcgagcgaggggggggcttgagcgagatggaccacgcggcggacgcgcaccggacggacctgatgaccatcacgcggcacgtgctgaacgagcagagccggaaccccgagtcccgcggtgacttcaccatgctgctctcccacatcggcctcggctgcaagttcgtcgcatccgccgtcaacaaggccaggcttgcacagatcatcgggctcgccggctagaccgacgcgcagggagaggagctgatgatgctggacgttctgtccaa

SEQ ID NO: 43513 - DNA, 407 bp, Zea mays
  Clone ID: LIB3066-049-Q1-K1-C1
cacaccacaccacacctgctcgcttccactccgctcgtctgacatctcgtcccgtcgttgcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtagcctcccgaagatctcgaggagacgaagaagctgctggataagctcgttgtgctcaagcttaacggagggctcgggacgaccatgggctgcactgggcccaagtatgtcattga

SEQ ID NO: 43514 - DNA, 388 bp, Zea mays
  Clone ID: LIB3066-021-Q1-K1-G2
atcacacacactcgcgaactccatttcgattccattttaaatcaacccatcctcgtttccggcgtgtggcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaagactccaagacccttctctttggtgagaaggaggttgctgtgtttggctgcaggaaccctgaggagatcccatggggtttccgtggcgcttaatatggttgtgagtctactg

SEQ ID NO: 43515 - DNA, 397 bp, Zea mays
  Clone ID: LIB3066-021-Q1-K1-G3
atcacacacaatctcgaactcgctttggatttcatttagcatcaacccatgctcgattccggcgtggagactctctcatggtaatggcccagatcaagatcgggatcaatgggttcggcaggatcggaaggctggaggccagggtggacctgcagagcgacgacgtcgagctcgtcaccgtgaacgaccccttcatcagcaccgattacatgacctacatgttcaagtatgacactgtgcacggacagtggaagcaccatgaggtcaaggtgaaggactccaagacccttctctttggtgagaatgatgttgctgtgtttggctgcacgaaccctgaggagatcccatggggtttccgtggcgctgaatatggtggtgagtctacttgtgttttcac

SEQ ID NO: 43516 - DNA, 315 bp, Zea mays
  Clone ID: LIB3066-004-Q1-K1-G9
gcaagatcaagatcggaatcaacggtttcggaaggatcggcaggctcgtggccagggtggccgtgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtcgggtgaggctggtgctgagtatgtcgtggagtccaccggtgtcttcactgaca

SEQ ID NO: 43517 - DNA, 400 bp, Zea mays
  Clone ID: LIB3066-054-Q1-K1-H1
cccacgcgtccgcccacgcgtccggtgcgtgcgttcgtgcagtcacagacaggcgtccgggcaccgtgtctttcaccggcacgcaggacaagtgcacggcgtgcgacaagaccgttcacttcatcgacctcctcacggacgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaagataagtgcgcagcatgccagaaaac

SEQ ID NO: 43518 - DNA, 464 bp, Zea mays
  unsure at all n locations
  Clone ID: LIB3066-020-Q1-K1-A12
cccacgcgtccgcgggaggcgagagtgcgtgcgtgcagccacaggcaggcgtcggcgccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgctgcttgccagaaaacagtgtacccgctggagaagttaactctggaaggcgagtcctaccacangagctgcttcaagtgctcg

SEQ ID NO: 43519 - DNA, 441 bp, Zea mays
  Clone ID: LIB3066-015-Q1-K1-C5
cccactcgtccgtccactcgtccgattgtgggcgagtgcgtgcgttcgtgcagccacagagaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagataacagtgtacccgctggagaagttaactctgga

SEQ ID NO: 43520 - DNA, 435 bp, Zea mays
  Clone ID: LIB3066-048-Q1-K1-B3
cccacgcgtccgggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacggaag

SEQ ID NO: 43521 - DNA, 345 bp, Zea mays
  Clone ID: LIB3066-006-Q1-K1-B8
ctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcattga

SEQ ID NO: 43522 - DNA, 392 bp, Zea mays
  Clone ID: LIB3066-038-Q1-K1-D2
cacccgtctgccgctgtgccgcacggccctcaccccgcacgagacccgtccttgaggggcacgtcctatatcggtggctcctgcctctcgccgccgatacagtgcctctcgcggtctcgctcccactcacaggtctattggtttttttagttcctaccttagcttcttggaggtgtttgttgccgtctcacccgcagttcttgagacatgcagagccagatagtgtgccacgggtgcaggacccttctgatctacccaagaggtgctccgagcgtgtgttgtgcggtatgccatgtggtcaccaatgttgccgcttcagcaatggagatggctcgacttatatgtcgtggcttgcagacattattgatgcatgctcgcagtgcaacaactgt

SEQ ID NO: 43523 - DNA, 468 bp, Zea mays
  Clone ID: LIB3066-001-Q1-K1-B7
atcgccgtgtgcgccgacgaccccgagtaccgtcactacaacgacatcagcgagctctgccctcaccgcctacaggagatccgccgcttcttcgaagactacaagaagaacgagaacaaggaggtggccgtcaacgacttcctgcccgccgccgctgcccgcgaagccatccagtactgcatggacctgtacgggcagtacatcatgcagaccctgcggcggtagagcgtgtcctaccagatcccatgcgagctgagctgacgcaagagcacagatcgacagaatccttgtggtctagtctcatgcatggatagccaggtcacatggcttgtcgacgaccatgcatctgttcttcccagcgattctagcctgtatctgcccttatttatagtctcttgggtttggtggaatctgtccacagtgtggcttgatctatgtactactcttctacatttctaccagaacgaa

SEQ ID NO: 43524 - DNA, 428 bp, Zea mays
  Clone ID: LIB3066-053-Q1-K1-D6
cgcggcagacggtagccgacttcttcgaccggtgcaagcaagacccagatcactgggggagaatatctggagcagggctgcagcgcatatacgagaagtacacatggaagatatactcagagaggttgatgacactggccggggtctacggtttctggaagtacgtgtcgaagctcgagaggcgggagacgaggcgctaccttgagatgttctacatactgaagttccgcgagctggcgaagaccgtgccgcttgcaattgaccaaccgcagtagcttgcgcaactgcgactgcgtagcacttggtacaagactgaaacctgaaggaccttcagtaatttaggcgcggcagacggtagccaataaaatgtgccggagctgaactggtttttattatgtacataatggcagtataacaaaattactgaa

SEQ ID NO: 43525 - DNA, 351 bp, Zea mays
  Clone ID: LIB3066-009-Q1-K1-B9
gctagctctctgttgaccattgcgtattctgaaccatcgagccatggctgccaagcgtactggcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcacgaagcaattgtgctccccccatgggttgcacttgctatcaggccaaggcctcgtgtctgggattacattcgggtgaatgtaagtgagcttgc

SEQ ID NO: 43526 - DNA, 420 bp, Zea mays
  Clone ID: LIB3066-043-Q1-K1-C2
gatcgggattgtgggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaaggtaactc

SEQ ID NO: 43527 - DNA, 430 bp, Zea mays
  Clone ID: LIB3066-030-Q1-K1-G10
cggaggaacaaactttagagtgttaagagttgaagttggtgctgggtctgtggtcacccgtcggaaggttgaacttcccatccctgaggaattgaccaagggtacaattgaggagctattcaactttgttgccatgactctaaaggaatttgtagaaacagaagatgggaacgatgaacaacgagcgcttggtttcacattttctttcccagttagacaaacatcagtatcttcggggtcattgattaggtggaataaagggtttttgattgaagatgcggttgggaaagatgtggctcaatgcttaaatgaagctcttgctaggaatggactaaatgtgcgagttactgcactggtgaatgacaccgtggggacattagctctaggacattatcacgatgaggatacagtggctgctgtgatcattggt

SEQ ID NO: 43528 - DNA, 280 bp, Zea mays
  Clone ID: LIB3066-043-Q1-K1-F11
atgagttgaggcgcttacacaaactttcattccggcctcttgttccatagtttttcttgcatgttacatctcaccgatgaataaaatgtatgtatcagacttgtctcgtttttttgcccatccaagcagcaaattagccgctggcacagcatgcggtaataatcttgtcacagtgctgtaattgggagcgtttttcttgttagaagtgtttctggtttgtttgagcatttacggatcgatttttctttctgaagagtatataaacattttactcacctgt

SEQ ID NO: 43529 - DNA, 338 bp, Zea mays
  Clone ID: LIB3066-015-Q1-K1-F12
cttactcggtcgcttcaagtcgatacctatcattgttgagcttgacagcttgaacgtctcgggtgatgtttggttcggttctggaattgcactgaatgggaaagcgtccatcactgcaaaacctgtcgtcaagctataaattcaatacggatcactgattggtgaataatgatctcagtcgccttgaggacctttagataagaataagcgtatcaccacgtacgcttacttacccaagtgacggatcatcgctcgtggactctcctgaatatccagacaagtccgatgatactacggaccatatcaactgccagcatattgcaatcattgtacatgta

SEQ ID NO: 43530 - DNA, 320 bp, Zea mays
  Clone ID: LIB3066-025-Q1-K1-E5
cgcttcctaccagttaaggcgacatcagatttgcagctagtacagtctgatctatataccttggttgatggcttcgttacacgtaattcagccagaacaaatctatcaaatccctcaattgaacttggtcctgagttcaagaaggttgggagcttccttggtcgcttcaagtcgatacctagcattgttgagcttgacagcttgaaggtttccggtgatgtttggttcggttctggaattgtactgaaggggaaagtgaccatcactgcaaaacctggcgtcaagctagaaatcccagacggagcagtgattgggaataa

SEQ ID NO: 43531 - DNA, 438 bp, Zea mays
  Clone ID: LIB3066-006-Q1-K1-G12
cacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattc

SEQ ID NO: 43532 - DNA, 443 bp, Zea mays
  Clone ID: LIB3066-015-Q1-K1-G12
cccacgcgtccgccacaccacacctcctcgcttccactccgctcgtctgacatctcgtccggtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatggtctgcactgggcccaagtctgtcattgaagtccgcaatgggttcacattccttgac

SEQ ID NO: 43533 - DNA, 440 bp, Zea mays
  unsure at all n locations
  Clone ID: LIB3066-025-Q1-K1-A10
cccacgcgtccgcgaagagcttcacgcgaagcaatcacaatggatcgtacctgatcaagaactacgagaatccttgaggctcgctgtagccgaagtcctgttgccagcctaccgatcttttatcaaacgctttggcaatcttgtggacaacaacaagaacccgcagaagtacgtgcggtacagcccagaagcagtggaccaacttctaggccagttcttcgaagggcagcaatgggcggagcaaaagcgctgagcaacatagagtgagagtgacggcatgagtacagccagatgccagtaagttcaacagcacagatttcttccgaagcaaccaccagttccttctcgcactacatataatatatagtgacataaacgtctgctgtgcaagcactacctagttntcttttctcagaaaaagcgcgcctaagtttcttttc

SEQ ID NO: 43534 - DNA, 446 bp, Zea mays
  Clone ID: LIB3066-023-Q1-K1-H9
gaacgtttgtgtcatctatccttaattcgcttcctggtgttgatcccaatgatccatctgtggaagatttgctggcatcgttgcacagccagggagagcaagagaagaaggaagacacgtcagacaaaacagaagacgagaagaactgatgtagccatgttcacgcctccatgcgcacaaagaaattgaagaccggtctgcgtttactctcttggtcgtggagtttgtttatcctcatataaccgtgctttgattataacttaccgccgagggaatttgtattatgacgctgcaacaatcttctctccatatatgttcaagggattttcgtgtttcaatgctctccaaaaaaaaacaacatccctaaagatatctaagcttacatacctcaatttacaacaaaaaaaaggggcgccgctcgcgatctctaagtctagatcgcgagc

SEQ ID NO: 43535 - DNA, 360 bp, Zea mays
  Clone ID: LIB3066-021-Q1-K1-H6
gtgatccatctcttgcttctatcttcttgatgaataatggcaagtacatcatacacaaggtgaatgacagtgagttgggtgttttactcggtgatgagtggataaagcagatgacaaatagagttcgacgctggagcatggattatcagcgggcaacatggggcaaggttacaactgtgctgcaaagtggtactccaggcattggtggactcccagccaaggcaatgctgcagaaactgcgaatgtttaatacatattttgaggagatctatgcggcacagtcagaatgggtgatagcagatgaccagctaaaggttgacattagggcagcggtggaggagacagtgatgccagtttacg

SEQ ID NO: 43536 - DNA, 394 bp, Zea mays
  Clone ID: LIB3066-018-Q1-K1-H6
gggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgct

SEQ ID NO: 43537 - DNA, 473 bp, Zea mays
  unsure at all n locations
  Clone ID: LIB3066-007-Q1-K1-G6
gagaagcgatcgggattgtgggcgagtgcgtgcgttcgtgcagccacagacaggcgtgcgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccaganaacagtgtacccgctggagaagttaactctggaaggcgagtcctaccacangagctgcttcaagtgctcgcacgg

SEQ ID NO: 43538 - DNA, 411 bp, Zea mays
  Clone ID: LIB3066-008-Q1-K1-C6
cccacgcgtccgcccacgcgtccgcccacgcgtccgcccacgcgtccgagcacacacgggcgcatcagggcctagctcgagtccactacttgaaaaacaggaaaaaggttgcgtttgaggagatgacgaagctcgtggagatagccagccactgcgcgtcggcatatgaaaagcggtcggaatacggtgagcgcgaagctgcgaggagcgacctgaacatggcgacgcttcttgatcctaccaggacttatccttacagatacagagcagctgtactgatggacgaaggcaaggaggaggaggcgatcgcggagctgtcaggagccatagctttcaagccggaccttcagctgctgcaccttcgcgcggcgttcttcgactccatgggcgagcgcgagagcgccctgtggg

SEQ ID NO: 43539 - DNA, 313 bp, Zea mays
  Clone ID: LIB3066-012-Q1-K1-F3
cgtggaaaactttccggttccaaaggacctttggccccttccttttaagaacctacctgggtaaaccctttttgaaaaggctcctgtcctaatacttgtataaaatgaaaattatgtggtagccctatcatggaaccgaagtatcagagaagtagttgactggatgtcaaagaaaagtggtattcctgcttctgagcttaaggagcacctattcatgctgcgtgacagtgatgctacacgccatctgttctaagtatcagcaaggttggactctttggttctcggtgaacgacaaatccttgctcaagtcaaa

SEQ ID NO: 43540 - DNA, 453 bp, Zea mays
  Clone ID: LIB3066-052-Q1-K1-G8
gtcatgcactggagacgttggcactacatatacagcagcttatcatggatagtaacggggggggtgtttccattgatggcgcccaactttcctttgagacaggtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgcacttgcttatggaaagactcctgaacagttgcacagtgagaaagttccagaaaatcttatccctcataagacttttaagggcaaccggccatcactaagtttgcttctgcctacactatccgcatatgaggttggacagcttttatccatctatgagcaccgga

SEQ ID NO: 43541 - DNA, 349 bp, Zea mays
  unsure at all n locations
  Clone ID: LIB3066-027-Q1-K1-E1
cggacgcgtgggctgaaaggagagctctgctgggagaatcaaatgaatttgttggagacaaggttgcgtatgccctgtctcagggactaaaggtcattgcatgtgttggtgagacacttgagcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgcctncctgagggattggctaaagaccaacgtcagccctgaggttgctgaatctactaggatcattta

SEQ ID NO: 43542 - DNA, 304 bp, Zea mays
  Clone ID: LIB3066-014-Q1-K1-H11
ctgcaaagagctggcagcacagcctgatgtcgatggtttccttgtgggcggtgcttctttgaggcccgagttcatcgacatcatcaacgccgccgccgtgtgaagtccgctgaagatgttccaacccttcaccctgttgcggtgatgtgctgaagacagatcagactatttttttgtttaaccgtgcagtgctatgtaagctactaactttgcgctggtgcggatgctgatttccctccccctagctttttgtgaggctactctacagcttgattcagcttgctaataatgtttgcctctggac

SEQ ID NO: 43543 - DNA, 422 bp, Zea mays
  unsure at all n locations
  Clone ID: LIB3066-047-Q1-K1-C9
cccacgcgtccgcggacgcgtggggttcgcggagatccaggcggccacccagaaggtcnacgagaaggccatcatcggcgtgggcgggttcggcaacgtgtacgtcggggagatcgacgacggcaccaaggtggcggtgaagcgcgggagcgcggagtcggagcagggcatcaacgagttcaacacggagatccagatgctgtcgaagctgcggcaccggcacctggtgtccctgatcggctactgcgacgagaaccaggagatgatcctggtgtacgagtacatgcacaacggcgtgttccgggaccacatctacggcagcgaggggaaggcgccgctgccgtggaagcagcggctggagatctgcatcggcgccgnccgggggctgcactacctgcacacgggcacggcgcangggatca

SEQ ID NO: 43544 - DNA, 431 bp, Zea mays
  Clone ID: LIB3066-047-Q1-K1-D1
gcacatctcttgcctcctctttcgcgctgtccggagaggaggggcaggaggagggggcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcagggggagcagatcagccggacgcac

SEQ ID NO: 43545 - DNA, 374 bp, Zea mays
  Clone ID: LIB3066-047-Q1-K1-D10
cccaaggtcgtcgacgcgttgagggaggagcacgacgcgatcgccaagaacaggaggggcccggatgcccccgtcacgtgggccgagtacagatcgatgaccttcaccaatcaggtcatcatggagatggtgaggcttgcgaacatcgtgccggggatatttcgaaaggccctgcaagacgttgagatcaaaggctatacgattccggcgggatggggcgtcatggtgtgcccaccggcagtgcacttaaaccccgacatctatgaagaccctctggcgttcaacccgtggagatggcagggcaaacctgaaatcaccggtgggacgaaacacttcatggcgtttggaggtggcctcaagttttgcgttggcac

SEQ ID NO: 43546 - DNA, 391 bp, Zea mays
  Clone ID: LIB3066-047-Q1-K1-D11
ggaaaaaggacacatcacccaaaggcacagggaatcgcaccatcgtgggacccgtgcagcgcgaccgcccagccgccggatctgcgccggcgacgcgcccggacgtcggatctacgccgccgcaggaggggggaggcggcgctgtggccgttctctgcccgtgagcgcccggatccgtcccgccgcaaggattatggatccgaaagagaagccaaatgtatcgagcagtccaccaacaccacggctggactgcataaaatgctttgatatgctctggttctgttactcaccattccaccagatgcagaattattaccggtatggggagttcgacacctgcttcggcaagtggggcgatcttatgggctgcctcgctctcaagaacaaagcg

SEQ ID NO: 43547 - DNA, 327 bp, Zea mays
  Clone ID: LIB3066-047-Q1-K1-D12
cttgcgaatgacattgattaagctggcaaaatttgaaagagagcaggcaacatgggactcgcgtaagaagacggtctggtgaaatccataactttgcaaattctgttttgaagatgagcaggtcacagataaaattgaactctgaaattgtgaaacacctgggtagtatccatgaatatttggagatgatgatatcagttcatcatgcatttacagatcgctctaatgctttacattacgtgcaaattctgtcagcagatctgttttccttgcatatcagggcaaggagacttgaatcgtcgtacgcacgaaatatggggcacgagt

SEQ ID NO: 43548 - DNA, 403 bp, Zea mays
  Clone ID: LIB3066-047-Q1-K1-D2
cccacgcgtccgcaggttataccgccttgcttcaatgggctttgcaacatttgggggcttccttcttgcaaagcgtgcaatacaacattttctagaaagaaagcgccggcatgaactgcaaaaaaggtgcctaactccttatgtcatttccttttagaacattcaaatccaattgaaatgtagtagcattatttaagtgtttgggtttttaaagaggtttatatttctgttttagccatggatagaatgtaagtgacttgtgctgttacgatttatttgtaagaactttgtaacctctgtatgcctatctattgacacatgtgcaacgtgtagctaattttaaatttgtagacgtcacatgaaattggagaagactatactgcagggtgattaagtgaatatg

SEQ ID NO: 43549 - DNA, 412 bp, Zea mays
  Clone ID: LIB3066-047-Q1-K1-D3
ggctcttgggagccaagtagtatgaaggttgcgagcatctggccgtccttatgggggctatcacccaggactgcttagagatactctagcttttcatggttgtgctgaactgttccaggatattcatacagaacttattcagtatagaaggaatcagatgattaaacgaggaacagtaaaggagcagctaacagttgattcagtgtccaggaagatggctgggttgtgtccactcatgccagaagaggttggacttctacttcaagcattaggttacccaccaactacaataatattcttggctggttccgagacttttggtggacaaagaatgcttattcctctacgagctatgtttgctaacctagtcgatcgaacttcattatgtattcagagggagctgtttgattta

SEQ ID NO: 43550 - DNA, 425 bp, Zea mays
  Clone ID: LIB3066-047-Q1-K1-D5
cccacgcgtccgcaaggattcacggtgcctcagtcacatgtttgctgctgaaattggcatgcatcgtttcttgctctcgagtgctgtccggacactaaatcccaaggaagctgattggttctatacaccagtttacactacttgcgatttaactaacgctggactgcccttgccgtttaagtcaccacgggtgatgaggagcgcgatccaatatatttcaaacaaatggcccttctggaataggactgatggagcagatcatttcttcgttgttccgcattttgcagcatgcttccactatcaggaagaaaaagctatcgagcgtggaattcttccattgctgcgacgtgcgacattggtccaaacctttggacaggagaatcatgtttgcctgaaggagggttccatcattattccaccctatg

SEQ ID NO: 43551 - DNA, 388 bp, Zea mays
  Clone ID: LIB3066-047-Q1-K1-D6
gggctctgctctatctcaagaagacttcattcatgtgggcaccagcagtcactcaggggggggggcgggcgaccagggagattaagaggcgatggtccgctgcaatgcatgcatgcggatatatgcatgcgtaaacacatcgagacgccgaaaaattgttcttttatatttatgtatatgtacatgcatatgtctcctgattcaactttgatgtttattgtctctttcgctttcgtactgaacttctgtgtgtaagttgatatatggatcaatagattgttattcactatatatactatggcttcttgcagctgctgattaaaaaaaaaattggccatgcctgtcacaaatggcattcgtccaaaagcgcctgaacaataaaaagggg

SEQ ID NO: 43552 - DNA, 410 bp, Zea mays
  unsure at all n locations
  Clone ID: LIB3066-047-Q1-K1-D7
cccacgcgtccgcggacgcgtgggatcgcgaggccgaggcttgtcccgtccccgcgcgggtccgctcctctcacccacggtttctggaggacaattctttgctatctagccttcctcaaaagtaaaaagggtaaatgggatcagaaggaccttcagttgtcactgtccatgttactggatttaagaagttccatggggttgctgagaacccaactgagaaaattgtgaccaatcttaaatctttcttggaaaagcgagggttgccaaaaaatcttgtcctcggaagctgcacagttctcgaaacagcaagggaaggggcacttgccacattatataaggttntagagtctgctgttgcagacagaggaactgggtcctcggcccatggacaagtaatttggatccacttt

SEQ ID NO: 43553 - DNA, 388 bp, Zea mays
  unsure at all n locations
  Clone ID: LIB3066-047-Q1-K1-D8
gcctccttccgcattggccggcggagccacagcactcagccagcctctccatctggctgcagtccccacgcgctgttccatccaaccctagccaccgttggtgcctcggcggcatgccctcgtttgccttcgtctccgctcggtacgccgcggatgcggaggcggacttcctccgcatctccgcctcgcaggaagaccttctcgcccgcgcccccttcatcaccttcaacccggaggaggaggaggaggaggaggccgaggtgtccagcacgccgcctctcacacaccaggccccgcagaggcagggggaagagggcatcgccatgtgctccatgcccttcacccagccttcctccccttctncggctccctccccttccttggggag

SEQ ID NO: 43554 - DNA, 422 bp, Zea mays
  Clone ID: LIB3066-047-Q1-K1-D9
cggacgcgtgggcggacgcgtgggcggcggcgtcggcgtcggcgagctggaggcgtggctgcgctggcaggccgccgcccggctggacgccgtcacgcggagggagatggctccgcacgacacggaccgcgacggtgccgtcacgctgcgcgagttcttcgcagactggatcaacatgggacatgacaaaatggggtggtggatgcacaagtttgcgagcgcggacagagacggggacggctcgctcaacgccgtcgaattcaacgacttcctgcatcctgaagacagcagccaagagagcgtgatgctgtggctactcaaggacaagctaagcgagatggaccacgacggagacggcaggctaagccaggaggagttcgtcgcccaatctcacatcatcatctccggcgcgcgtcacgccg

SEQ ID NO: 43555 - DNA, 171 bp, Zea mays
  Clone ID: LIB3066-047-Q1-K1-E1
cctctacacgttcatcgacagtaaccccatcgagtagggtcggtacgagtagaaaacgacgagccggctagaccaccatgagggagcgtcgaggacccatcagttgcgtcgccccctgcgtcctacctccccctcactccttcctgggctttacgctggccacactgccga

SEQ ID NO: 43556 - DNA, 263 bp, Zea mays
  Clone ID: LIB3066-047-Q1-K1-E10
attcccattcgaccacgcgtacgcgtaccgttcgatctaacgttggtctaaaacctatctccctgcttcacctttcggctttgggtgccacagcacaacaccttaacctactatagcatgcttatggcataccatgtactgcaagtcaacttggtgttgaaaaatgacctcataatagtatcgctcttctatccgactcacatctactctatggcttacatcttcagatatccacttgccattacttcacacagcaactaagc

SEQ ID NO: 43557 - DNA, 419 bp, Zea mays
  unsure at all n locations
  Clone ID: LIB3066-047-Q1-K1-E11
gcacggacgagaaggcgctgatcgagatactgggccaccggacggcggcgcagcgcgcggggatcgccgtggcctacgagggcctctacaacgaacccatcatcgacagactccactccgagctctccggcgacttccggagcgcgatgatgctgtggacggtggacccggcggcgcgtgacgccaagctcgcccacaaggccatgaagaagcagggcgagcggtacgtgtgggtgctcatcgaggtcgcctgcgcgtccgcgccggaccacctcgtcgccgtcaggaaagcctaccgcgaggcctactccgcctncctggaggaggacgtcgccgcgtgcccgctctacaaggacccgctcctcaagcagttcttggtgcggctcgtgagctcgtaccggtacttcggcgagctcgtc

SEQ ID NO: 43558 - DNA, 392 bp, Zea mays
  Clone ID: LIB3066-047-Q1-K1-C8
cccacgcgtccgctaagctgtcgtcgcagaatcgcacgtacgcgcgatcgagaaggcaggaccaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccaccttcgctctggcctgcacaggggcaaagttgtgataccggagaacaagcccttcatcttcgtgaggggcaa

SEQ ID NO: 43559 - DNA, 250 bp, Zea mays
  Clone ID: LIB3066-047-Q1-K1-B12
agccaacaaaaagagaaaacctaaataaaaaaagccaccctatacactaaaaaaaggaaacggggaaaagggcatggcgagagaaacgagagcaacacacacaatggggagctcaaagaccatagatgcgtacacactgccactaaacgagctcctgctccagactttcgcgaccaccgaaaaggtaaaaacagtgcacgaactgaattgaaaggaccaaatccaaaagacattcaaccaagtgcactaa

SEQ ID NO: 43560 - DNA, 219 bp, Zea mays
  Clone ID: LIB3066-047-Q1-K1-B2
cccacgcgtccgcccacgcgtccgcggacgcgtgggcagcagtctagtgtatgtaggcgcgcgtatcatatcccaccggtgcctagtttcgtcgtccacaaggaacttagaacattgtaaatacctggaaataaatttgcagcttagctctaaagtaaatccagcccaagatttgtgaacatgcatgtatgtcattagcaatggaagcccttgtttatc

SEQ ID NO: 43561 - DNA, 271 bp, Zea mays
  Clone ID: LIB3066-047-Q1-K1-B3
ctagttctagatcgcgagcggctgttctcgatctagaactagtgttctacatggcgagcttcccagcagggaggagcgacacgccgcctatcaccgtggcactggcactgtcacccccatgaaaccgcagcaacacgcgccttcctgttcctcgagcgatccagatcgggcgtccgatgtgttcctggaagcgtcaccgaggcataactcgccggtcccgatccccaccgcgcacaggcagcagcagcagccgcatccgtacttcaaggtc

SEQ ID NO: 43562 - DNA, 402 bp, Zea mays
  Clone ID: LIB3066-047-Q1-K1-B4
cttccgcaagaaagggaggggcgcggacaagaagctgctctcgcggcgggacatcggcttcgatttggatggcagaagcggcgacaggatggacctcttggagacgtccgccgctgtccgcaagagcttctcagatcggcactgcacgacgcggatcgagaacctgacgctgagctgcctggattctcccaggagacccaatgtcgacacccgggagtaccgggtgtttgtaggcacatggaacgtgggagggaagcctcctgacagcagcgttaacctccaagagtttctgcagatcgaaggcttgcccgatatatatgtcttggggtttcaggagatcgtgcctctgaacgcgggcaacgtgctggtcgtggaggacaacgagccggcgggcaagtggat

SEQ ID NO: 43563 - DNA, 433 bp, Zea mays
  Clone ID: LIB3066-047-Q1-K1-B5
cggacgcgtggggatgtggacccccagggccgggcctggacccagcgcggcacaagacagcatgcccagcagggaggagcgacacgccgccgagcaccgtggcactggcactggcacccccaggaaaccgcagcaacacgcgccttcctgttcctcgagcgatccagagcgggcgtccgaggtgttcctggaagcgtcaccgaggcagaactcgccggtcccgagccccaccgcgcacaggcagcagcagcagccgcagccgtacttcaaggtcagcagcaggttcgagtcggagatgaaggaggccaacgagatgctgatggagtccaagaagctccgcgtcaacacgaccaagcccaagaccaagaccgtgacgttcgcgccgtcggccgtggagcgcgagcagccgggcccgggcggcgagaggagcggc

SEQ ID NO: 43564 - DNA, 398 bp, Zea mays
  Clone ID: LIB3066-047-Q1-K1-B6
aaaaaatgtgatgacaaaatgcagcatcaaaaacatgggagctaagcagccatctggcggcgcgatggccacatccaaatcccttctttacaagaagatacctacggtcgccgcatcgcgcaattgaaggcagaactcggatcggcgagtcagtcggcattgtgcatggatgaatctgggcctcgccgcccccgtctacgccatgggctgcgtgctccacctcaccgcgtgggcgctcgtggccgccgtcccgtgcccggaccgcggcaacgcgctgcaggcgcaccacctgccggccgcgccgtcgcgcgccgcgttcccgtgggcgccgaccctcctcgccttacaagaacgcctcgccgaggagggcaagcgcaaggacaggcgccactcgtgcg

SEQ ID NO: 43565 - DNA, 436 bp, Zea mays
  unsure at all n locations
  Clone ID: LIB3066-047-Q1-K1-B7
gctagcgatggctggagcccgggcactgctcatcgtcctcgcggctgccgtcgcgggcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggtgcggaggctcgccaaggaggaggtcaagacggccgcgacgcccgaggcgcggagggcgctgaacctctgcaagacctactacctggacgccgncgacaacctcggcgcctgcaagcgcgccatcggcttccgcgacgccgtcaccatccgcgccacgatgagcatggtggcgcacgacacgcagaactgcgac

SEQ ID NO: 43566 - DNA, 436 bp, Zea mays
  Clone ID: LIB3066-047-Q1-K1-B8
ctctcctctctcatcaggagtatattgggcgggatccgagacggccgtgccgctggcattgctcgatcgaggagggaaaaaaaacaaaagggaagcaggcaggtcgtcgagaggggaggaattcgcaaaccatgctttcagcctccgatccttcctcgagtgcttgctgtctggcggaacttcaactgaaacagctgacctgactactagtgaagcaaataaccaggagagctctgtccaggacggtttagacaccacttgtgctaaggaaaacaagggaaacgacggtgtcgataatgctgctgagaactcgactcaaatttcagaatcctctgatggtggccaactatcactgcaggacaacaagatgggtgattctgatgctgcagatgcgaatagatcatcagcatcttcgacgatcgtgtctgaaagcaag

SEQ ID NO: 43567 - DNA, 421 bp, Zea mays
  unsure at all n locations
  Clone ID: LIB3066-047-Q1-K1-B9
aaaagttaggaggggaacccatcagtcaagagctacgcaaacgcacagcgatgcagaagcacgagataccagccaccatgcgcctgtccctcctcctcgtcgtcgtggccgccctctcggcgcgcaccgcggcgcagctgccgctggcgggcggcggcggcggcgccctgaagccggacttctatagccagtcgtgcccgcgcgcggagcggatcattgcggaggtgatgcagacgaagcatatggcgaacccgacgacggccgcgggcctgctccgcgtcttcttccacgactgcttcgtcagcgggtgcgacgcgtcggtgctgatcgcgtncacccagttccagaagtcggagcacgacgcggagatcaaccactcccttccccgggacgccttcgacgccgtggtgcgcgccaagct

SEQ ID NO: 43568 - DNA, 431 bp, Zea mays
  unsure at all n locations
  Clone ID: LIB3066-047-Q1-K1-C1
cggtacgcgtgggattcaccatgccgaccgaagagggttccgacggcggtggcggggccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcanagaaggctaacttgggtacttcatctggatcatca

SEQ ID NO: 43569 - DNA, 372 bp, Zea mays
  Clone ID: LIB3066-047-Q1-K1-C10
agctattccaattcgctcggaaaattgaggaattaatgtacaacatgagccctggggagatgcccttccaagttggaatgtcaaaggtagattttcgcaagatgttgaagtctagcttaactggacttgacaagacaatcaatgcaatgtatagaaaactacagaagaatatgactgccgaggaattgctgccttcgctatgggaaaaatgcaagaaagagtttcttgataaatacgcaacattcctcaagttgatttcgaaaatatatcctgacgagaaagtgatatctgtgaacgaaatgagagatactctagcttcactgtagctatttcgttagaaagttcgcatgtccgttggtttgcttgcgcata

SEQ ID NO: 43570 - DNA, 264 bp, Zea mays
  Clone ID: LIB3066-047-Q1-K1-C2
cccacgcgtccgcggacgcgtgggtacaacggggacatataataacataatagctgatatacaaggtggcaacagatcgcaccaccagcaaccagcatccaaccacagaagggttctgcatgcaacacactgatgggatctgctaagccaacttgccatgaagaatcaattctgaccacacatactgtgcaggcacacttgactaccagctgagagcatcgcgcaccatagctctgatcaccacggtgtaaacaccacttgtgc

SEQ ID NO: 43571 - DNA, 407 bp, Zea mays
  Clone ID: LIB3066-047-Q1-K1-C3
cgatcatatagatggaaacttttcactttaaaaaaaaaaaaaaaaaaaaaaagaagaaaaaataaaaaaaaaaaaaaaaaaaaaaaaaaaaaaaaaaaaaaaaaaaaaaaaaaaaaaaaaaaaaaaaaaaaaaaaaaaaacaaacattcaactacattccttttttaataaaaccacctaacttcatttaacttccctttatttttcaccttactttacttctaaaaccctgtctttacccattttaaaactcgtaaaatctcatcctactttaaacatttgcacttttatcaaataggccctttcccatcttccttcctaacaattttagccccctaaatggcccttttaacaatctttgtaacgcttaattaattactgaatctcccctttttcccccccttttt

SEQ ID NO: 43572 - DNA, 319 bp, Zea mays
  Clone ID: LIB3066-047-Q1-K1-C6
ggagctacttcggcctggtgctggagaagaagatgcccctcaccatcgaccgcctgctggggatggacaagacgaccgagcccatagtcaaggccatgtcggacaagactaccgacttcgtccccatcttcgccaaggccatggagaagctcagcgccctcaaggttctcacggggaaggacggcgagatcaggaagacgtgctccgagttcaacaacccgcagaacaccagcggcagcacgtcggtgatacggatcagctccatcgacgccgaccagatggccggcctgtcgcagccagggtcgacgtccaggaaggt

SEQ ID NO: 43573 - DNA, 431 bp, Zea mays
  Clone ID: LIB3066-047-Q1-K1-B11
ggccttcttcgcgtgtttccctctttttcttaggccgccctctacacttctcgacggaaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggccgatggagtccatcctcggagcctgcagcaacggg

SEQ ID NO: 43574 - DNA, 414 bp, Zea mays
  Clone ID: LIB3066-047-Q1-K1-C7
cgacaagatggcgtgcacaaacaatgcgatgagagccttgttcctcctggtcctcgtcggcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaaggg

SEQ ID NO: 43575 - DNA, 326 bp, Zea mays
  unsure at all n locations
  Clone ID: LIB3066-046-Q1-K1-H4
gacaacagcttgacgaaacgaacaatgatagacgaggttggttactagtgtatagccactagtaggaagcagaaaaagaaaacagatggaaatgcccacgctatctatgtgcatcgaagaaggccggcgatcgcccgttctcctctcaaaactgcgctcgtgatcctggctcgccggcgccgtcgaaccctcctccgtctcctgcacccatcatcgccgggacgccgcggcgcccaccacggtcaatccgtcctcgcccacgtcctncagccgctgcaggagcgggtcgggcgtgcaggccggcggcgcgtcgaagacggcgagcg

SEQ ID NO: 43576 - DNA, 202 bp, Zea mays
  Clone ID: LIB3066-046-Q1-K1-H5
ataccaggcgcggtgcctgccacgcggtggtggcggtcacggcgccggacgagggggccgatgcgcaacgccgtaagcggcgcaggactgctgaagtcgacgggtcgccagaggtggccggcactccaggtgtccgtccggtgggcagagacatgttcgaagagctgcctgacgatcttgtcgtctccatactacgggactg

SEQ ID NO: 43577 - DNA, 423 bp, Zea mays
  Clone ID: LIB3066-046-Q1-K1-H6
agacttcttacgttttctatttgaactggacattgttgatgaaacaacccagttaaaagatattagagcagaaagtcactctataaataatgatggaacgaatgttgctgatgatggcttaggaaaatcaaattcaacgagtccgatgtcttcatctcaaagtgtgaaacagcttgataaaggaagtcctaatggccttgtgcgcagtgaatcatttgaaattcattccatatcacccgctaagcaactgacaacagcagtttctacgtgcaacgatgttgatgaatatttagagaaaacagcttttcagaagggtcgttttaaggtgatacatgattatagcaagcttgaaggagcaacgccaagagagaaggaattattagatcgtataagtagtttagagcaaatgcttcttgctaccca

SEQ ID NO: 43578 - DNA, 345 bp, Zea mays
  unsure at all n locations
  Clone ID: LIB3066-046-Q1-K1-H7
caccggccgtcgagcgagcagtctcccaattccacccaataactaataacatgtccgcgaacgccaggttccttggaccactatatccaggagcgacgaagtgatccacccgccagccatggagatgaagaaggtcctctgcgccgccctcgtcgccgccgcctcggccaccgncgtgctggcctcggtcgcctccgaggcgccctccgaggcgcccgccggcgcggccggtggtgcggctggccctagcgcaagcggcgccggcgcggccgccgtgcccgcggccgggccgctggtggcttctttcttggcttactacttcaattgaccgacaacccccggggc

SEQ ID NO: 43579 - DNA, 239 bp, Zea mays
  Clone ID: LIB3066-047-Q1-K1-A1
cccatgtatacattgttcctgtttgtttcgactttttgtagcttctggccaccaaagactgctgccaactgccaaacactcagcttttcagccagcttctataaaaatccgttggataaaacccttccaaattaaccataacatattatccggtgaatcctcgcaattataggtaatccgcactttattggaccctaaccccaatggcaaatttaattttcccccgttccaaccatggg

SEQ ID NO: 43580 - DNA, 374 bp, Zea mays
  Clone ID: LIB3066-047-Q1-K1-A10
cccacgcgtccgaatcaacccttagtggtccgaaaggtggtccggtggcctggccgccacggccagcatggtgcccggtgcggcctcggtcagcgcgaggcgcagccccggcgcggcgcgggcgtggctgcccggccacggcacgagcgcgtatgcggcggcccagccctggcgcggcggcccccgtccccaacggcgcgaggcgtgttgccccctccgtctgcgcgcgagcgtactgctccggcagcgcggtcccggccaggcgcggttgcgcggcctggcgcggccctgacggctacggttctggcgccgcttcccgtggcgcgggagtcacccgacccagcggatctggcacggactcaactgtccggcac

SEQ ID NO: 43581 - DNA, 389 bp, Zea mays
  Clone ID: LIB3066-047-Q1-K1-A11
cccacgcgtccggttctagatcgcgagcggtcgccctttcttttcttttttatatggtatcggtcgctttgaaaccatcaaatttgatctccttccatatttcacaagctgcggctagttcagcactccatttgcaagctgctttgataatttcattaccttcactagcaagatcgcgcccttcgttactagcttgtacacaggcttctaaagccacacgattagctgctgcaccaggtgcatttccccaaggatgtcctaaagttcctccaccaaattgtaatacggaatcatctccaaagatttcggtcatagctggcatatgccaaacatgaatacccacagaagccaccggtataacacctggcatggatacccagtcctgagtg

SEQ ID NO: 43582 - DNA, 396 bp, Zea mays
  unsure at all n locations
  Clone ID: LIB3066-047-Q1-K1-A12
caggcgctcacgttctgcgacaccatgtacatgaacacgcaggacaccatcggcgcggcgcagcgggccatcacgttcaaggacaccggcaccgccaagatcatgctgcagctcgccgtccaggacttcgactcgtgcgaccgccccttcacccaggccggcgtccccaaccccatggggaagtttgacaaggagctcaaccagatggccaacaactgcatggctcttgcaaacatgatatgaaccacgcatgcaaccccagcgtgaggtgccatcgcatgcaaggaatgcttgcattcatttttcatttaattaagaattcattgaaattatgagttatatatattgagtaactctatgtatttgntcctgacctgcactatntattcaatagta

SEQ ID NO: 43583 - DNA, 352 bp, Zea mays
  Clone ID: LIB3066-047-Q1-K1-A2
cccacgcgtccgcagtaatgttgtaacttgaaaaaaaataagatttattttcattggaacaaaaaaaaaaaaaaaaaataaaaaaaaaaaaaaagggcggacactaatgcagatccaaaactaacatacacaaacatgcaaaaaaatagctcaacattaaaaaaaaaaaaaagggaattcacttttcgaggatccacatttacttccactggcaacacactggttatacccaatttaatcgcccttaaatccattacccgtgtccgcagtttgacatcatagcgactaggaaaacaccgaacgacctaacctaaatgccttcaagctgaatgcccatttggacacgctctgt

SEQ ID NO: 43584 - DNA, 367 bp, Zea mays
  unsure at all n locations
  Clone ID: LIB3066-047-Q1-K1-A3
cggacgcgtgggtgcatgttccagtgaaggccgcgccatccatgtcggacgccggggtggggaagctaagcctaggcgcgaaggcgctgtcggagggcggcttcgagaagctgtacaagcagacgttctcgtccagccccgacgagcacctgaagaagacgttcgcttgctacctctccacggccacggggcccgtcgccggcacgctgtacctgaccaacctgaacgtcgccttctgcagcgaccgcccgctctccttcgccgcgccgtctggccagaccgcctggagctactacaaggttatgatccnccttggcaagatcgcgacggtggagccggtgacgatgaatgagagcccgccggagaa

SEQ ID NO: 43585 - DNA, 398 bp, Zea mays
  Clone ID: LIB3066-047-Q1-K1-A4
gcggagcgcgccgaggtggctcggtcgcgcaacctcgccgcctacgtcagcgggcgggtggccgccacgaaccgcttcaacgcggacgtgctgagggccacgacgcggcgggcgctggcgaggtacgatggcccgtgcatggcgaccaaccccatcgaccggtgctggcgctgtcgcgccgactgggcgacggaccggaagcggctggcgcagtgcgcgcgcgggttcggccacaggagcgtcagcggcgcggccggtaagctgtacgtggtgagggacccgagcgacgacgagatgatcattcagcggaacggcacgctgcggcacgcggtgatccaggaccggacgatgtggatcgtgttcacgcagatcacgctgcagaacgtgcaggacgtgat

SEQ ID NO: 43586 - DNA, 157 bp, Zea mays
  Clone ID: LIB3066-047-Q1-K1-A5
agctgttcagtcagcttctatagaattcgattgagtcaaaccattcaaaattaacataaacatataatcggttgagtagacgctatagtagtaatccgtcactttatagatcctaaaccccatggtcaactttatcttcccccgatacatacaatgg

SEQ ID NO: 43587 - DNA, 434 bp, Zea mays
  Clone ID: LIB3066-047-Q1-K1-A6
acttactcccagggctgcgtgaatatttttcccaaacagatgatattcatataacggcaaggattcctgcaatggagagcatggctgatgtgaatttagcacaaaaggacgagaagcttaaagaagttgactccaaaactaaaccagaagatcaacaacaagcagaaaataaaaatatgggaacaattgatgaagaatcagatgacgatgaggactatcatgttcctgaagctgatatagaggtgaaatcactaacaaatctgacaatgaagctaaacacacagatgagcctccagaaaaaattgatttatcttgcttttctgggatacttcatcatgatccggatgagaaaagccgcaactgttggacagtacctgatagcaagcttttcaaagttcgtagcaggaaattcccaaatgacaaatcgaaggtct

SEQ ID NO: 43588 - DNA, 433 bp, Zea mays
  unsure at all n locations
  Clone ID: LIB3066-047-Q1-K1-A7
cccacgcgtccggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgacggaggctacttcaatgcaataatgaccttcccccagaactatcccaacagcccgccatcagtaagatttacttctgggatgtggcatccgaatgtttatccggatgggcgtgtttgcatttctattcttcatccacctggtgaagatcccagtggttatgagcttgcaagcgaacggtggacaccagtgcacacggttgaaagtatagttctgagcatcatttcaatgctctctagtccgaatgacgagtctncagcaaa

SEQ ID NO: 43589 - DNA, 378 bp, Zea mays
  Clone ID: LIB3066-047-Q1-K1-A8
ccgaatccccagaccaaatcgccgtcgccgtcgccgtcgcatcgcagcagcgggagtcggagggtcccggaccgaatccatttgcagacacccaaggccaagatccatcgctcgttccaaccagccttcttcttcttctgcttggtcgtctgatctcgttttccattcgtgtccaatccgatccagccaaccgctgtgaatgatggcgctcaacctgtcccaccagaccggcgcggccgtggcggcggcaccggcggcgccacgcgcggacgtcgtcgcggcggcggacacggcgccacgctcggccgttgtcgccgaggcgggcaccgtggcgccgacgcccgcgtcggcgcccgccaccgctccggcgctccagct

SEQ ID NO: 43590 - DNA, 430 bp, Zea mays
  Clone ID: LIB3066-047-Q1-K1-B1
cccacgcgtccgcccacgcgtccggataaaattagtgaaaagaaaatgcttagctgggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgctcagcgcacaactgtgtgtcttgatttttcttctgtttatcacggcattagtgccatgccgttttatgttacagtgttgtgtgctcgcaagcatccgaaaatatgcgtctgagtttagggttgggtcaaacttgtcgaatttggggttctgttataatatgttgagcatgaataaagatggatgctggtgactctgtcgccatcgccgtccatcatgagtgtcctgt

SEQ ID NO: 43591 - DNA, 312 bp, Zea mays
  Clone ID: LIB3066-046-Q1-K1-H3
gaaacaagtgcacacaaataaatacatcgctcactagattgccaagagcaatggcctgtaggtcatccatcctgctcgtcatggtggtgctagctacgctattcgtggttggttcgtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgca

SEQ ID NO: 43592 - DNA, 329 bp, Zea mays
  Clone ID: LIB3066-047-Q1-K1-B10
cccattccaccgacgcgtacgcaccctgcaaataaaccctatagattatgatcaaaaacttccaaaattataaccggaagggagaaataggcgctcggcttaacaatctacacactaacattcatcatcttattacaacgcaacctatacaagttatctcttaaattgaatttaatagccgatcttatacaactgctggaactgaaaaaccacaacatcacccaccttaatcaactgtcagcaaatggtcatgaatccagattccctacactcctagatgcccaatcccaatacctttttcaaaagatactcatccaaacttgctgata

SEQ ID NO: 43593 - DNA, 369 bp, Zea mays
  Clone ID: LIB3066-044-Q1-K1-E7
gatgatttcgaggttgcaactaattgctcgttagagctggactgcgtgaggccatctagtgccccaaaagcttcaggtttatcaaatggagggggcacagctgtaaaaaagatccaagtcaagggttcaaaaggttcagacgttaggggagtgaatcctggaaaaaggtcatcgccattacagaagaagccgagtggaccctcaccgacgctaatcaagaagggcggaggtgaaggaaggaagactccaaatggtaaaacaggaaccaagaagtaagcaacccagatgaaacttggttttgctgtgaccaacttcaccttggttagggacagattaacatgttgatactatcgggtgatacattgatat

SEQ ID NO: 43594 - DNA, 387 bp, Zea mays
  Clone ID: LIB3066-044-Q1-K1-E8
ggcgacaacttcacggtcccgggggaggcttcccttgccacgtccggcaagtcggtcaaggccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccggcgacgacctgaggggcatgctcgagatggccggcggcgacatcaaagtgctgttcagccggtccgacgacctcgagacctggctcacgggcgtcatgacg

SEQ ID NO: 43595 - DNA, 435 bp, Zea mays
  Clone ID: LIB3066-044-Q1-K1-E9
cccacgcgtccggattcctggcaggtacctggtggtggcactgctgcacctcccatgctacggcctgttcgccctggtgctgaggctcaagcatatgttgctggaaagctggttccctcaaacttatgcgaagtaatcaaggacgacaatagatggagttggttgtctctatacgcttccttcagcaaaaaaattaagcggaggttctgcaaactgtatgcaccacggaatcacattgaaatagatcacacttgtctgtcgacgggtttctccggaagtggacatgtagattgacagagcatgttccaaaaattttgagaccagcagcttatttaaatcagctgttgtctccagcatcataccccctttttttacccccaatggagatatcagacatgtgtacagtccgctaatatattcaatcatttccagcag

SEQ ID NO: 43596 - DNA, 404 bp, Zea mays
  unsure at all n locations
  Clone ID: LIB3066-044-Q1-K1-F1
ccgtctcgtctcgtggtcacttanncaccattggcaagggagaattgggttgacctggtgccttgactcgcatcanggagagcttggcgagataattgcacctggtgctccagnnggcttcctcnngtcttcaacgcnttgttggtggagggaacccgggctctgggacttggtgtctcttcctcctggagccgcctagtctgttgaccctatggcaagaagtccaagctttcggtttcaccgtgtacccccatccccccaggtggtccaacatccgtggttggagcccatacccaacagtgtcctgtccacccacttctcttcctcgagcacacntgatgnttgctgtccttgctcgacnaatgaggccatctatgacnatctgtccgccgcttcccttgaca

SEQ ID NO: 43597 - DNA, 456 bp, Zea mays
  Clone ID: LIB3066-044-Q1-K1-F11
cccacgcgtccgcccacgcgtccgggagtacgtcaccaaggtgaacgatctcatcggtgccggcaagtcgtaccgcacgctgagcgacatcctcgacaaggacatccagaacgactgcgtgaagaagcagggaagccactcccggaacctgcgcagggtccgtctcggcctcggcctcatcaaggccctcttcgagcaattcctcgccaccgagggttcattgtatgatgctgctacgacagcttacgggcaggtgtgcgcgccgtttcatagctgggcgatcaggaaggctgttggcgctggcatgtacacccttccaaccagggagcagttggtagtgcggctgaacgaaactgatctctcggtgcagaagcagatgaggagatacattgacgcttctagtcctatcatagagtacatcgataaccttttcctctcgaggaacattaatctaga

SEQ ID NO: 43598 - DNA, 127 bp, Zea mays
  Clone ID: LIB3066-044-Q1-K1-F12
cccacgcgtccgcattgttggttcttgtctctttttgtcatgaaaagaacgatgagctctatgattctcatcagctgataaatgtaatgtctgaatttctgtcggtgacaaattaatgatcccattc

SEQ ID NO: 43599 - DNA, 388 bp, Zea mays
  Clone ID: LIB3066-044-Q1-K1-F2
cccacgcgtccggcagccgccgcatccgtcaccttcacaccgcgtgcgtgctctctctcgccctcccgcctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactgaaccggtcttcatcgagggggcagctgccgccgcaagagctgcttgacgatctctgcagccggttccttctgaatgtgcccaaagaggagctggagtcgttcgagcggatcctgttcctgctggagcaagcgcactggttctatgaagacaacttcgttgagcacaac

SEQ ID NO: 43600 - DNA, 376 bp, Zea mays
  Clone ID: LIB3066-044-Q1-K1-F3
cacacattcatactgttgcttggattatgctcaggacctgtggcacaggcactggatgacagggcttgggtgagagacatctccaccactctctctctacaaggaatacattaatacctcatgctttgggatatcatggaagggttggtgctttctcaagaagaagatcatcatatttggagacacgaggcttcgggaaggttttcttctaaatcctgttacaagtcattcttcagaggatccatcacttttgaaccttggaggagggcgtggaaatctgggcacctctgaaatgcaaagtattcttatggttggccattaagaataagtgttggactgcggataggctggagcggcgtgggatgttcacccgaca

SEQ ID NO: 43601 - DNA, 288 bp, Zea mays
  Clone ID: LIB3066-044-Q1-K1-F4
tgacgcatcatgtcatcaacaggagtctgcgccagaatcgcagctgaggaggaggaactgccacgggccagctgatgcaaattagcgcttggctggattggcagaactcatgctcaattaagtgctgtgtccattttagcatttcacctatccttgtcgtttaccacaactgacttccatattcgggtacccctgtttcctgtgaccttacatatataggacataatggtgcgaagtctcgcaatatgtaatggacataagtggcgtgttcatatattattgctggag

SEQ ID NO: 43602 - DNA, 359 bp, Zea mays
  unsure at all n locations
  Clone ID: LIB3066-044-Q1-K1-F5
actacacggagctggcggaactggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaggtcgctgcaggcgctgctgctctaccacgtcctcccctcgcgcctgccctccgactcctggcccgcggcgtcccaccccacgctgtccggcgaggaggtcgagctcgcccccgccgccggcgccggcatgcgcgtcggccacgccgncgtcacgcgcccggacgccgtgctcaagcccgacggggtcattcac

SEQ ID NO: 43603 - DNA, 399 bp, Zea mays
  unsure at all n locations
  Clone ID: LIB3066-044-Q1-K1-F6
cccacgcgtccgcccacgcgtccgcaaactttcgtgagttcatgaactatctgaagaacaggaacgtggatcttacaaatgtcaagctgagcctgtcagaaggtgaggaggacgagtggttcaggcacagggccagtagcctctcccagcttaacaacacggagagcagccaccccacgagtgcagaagactccaagtcccactcccaccccgctggcgctgctgacaaaggcaatggcactacaccaggcacgccaccatccacgagccatgataaaacaacgaccagcgcagcgacagcaggcacgccggccatgaagaggtcctcgtcgggcagcaagctgcagcgcaagaggcctncacggctggcagtgagcaagagccggctgggcaagggca

SEQ ID NO: 43604 - DNA, 443 bp, Zea mays
  Clone ID: LIB3066-044-Q1-K1-F7
atatcgcatagtttttcgagatgccaagacatgatgcacttaaagctcttgaaatctacagaagggctggccaacaggtgactccagagttcacaagaggatgatcattaaagtatccgagactctaaaaggtcaagacactatgaacatgtactcttatttaggttattcgacacatttcaggctgggaatctatctgatttctacgagaattgccggggattagaacttgctaggaattttcagattcccactctgagggaggagagggcttgtactctgactagtcttcgctatgtgcactggattatgatatgacatcttttacatgagaaaattctcagccaccacaaacatttcttgctactatggaggactatgttaatgaagcttcacgcatggtccctgttcgagaacccctgatcatcgtatgagtactggaa

SEQ ID NO: 43605 - DNA, 331 bp, Zea mays
  Clone ID: LIB3066-044-Q1-K1-F8
gtgaaagcttagcggttcgggatctatccaatctggtaaaaccggacgatatgatcaccgcgtaacatcttgtgacacttcttgcaatcgatcccaagtactcccaaaacgactggctgtaaagctatgagacacttgatacatttgtggtacctatgtcatctaaaaagctctatgaagacaacgaatatgctctctacactgtgacactatgcgctaaggttgctgacaactttaaggtccgtgctcgcgagaagggtactcagatccgtgatttctagtccaggcctgaatcacaagaaagccggatgcaggagatggagaagctact

SEQ ID NO: 43606 - DNA, 452 bp, Zea mays
  unsure at all n locations
  Clone ID: LIB3066-044-Q1-K1-F9
cccacgcgtccgaacaatccttgcacccctcccctccgtcaccccaccacatccggccagcgcaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgncgaggtggcgtcccctgccgctgatgggcctgctg

SEQ ID NO: 43607 - DNA, 346 bp, Zea mays
  Clone ID: LIB3066-044-Q1-K1-G1
ctgccatcctctccaacacgaagatggcgttcatcagcaatgtcgcagtgaaggcggcgggcgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggaactgaagggcccctgcaagtcctccatcatcatccgtctcga

SEQ ID NO: 43608 - DNA, 467 bp, Zea mays
  unsure at all n locations
  Clone ID: LIB3066-044-Q1-K1-G10
cccacgcgtccgggacggaggagggggagacggggaaaccgatctcaacgaggctcttacgtcgcaggtgcgccgccttgccatggagatccggcaacttgctaattcacgaccaataactgttctcaatggaggttctggacaatcaggagtatcaggcctgatagtacctgcagcaactgttggagcactaggttatggttatatgtggtggaaagggatctcgttctcagacctaatgtatgtcaccaagcgcaacatggcaaatgctgtttcaagcatgactaaacatttggagcaagtgcaaagttctcttgctgctgctaaaaggcatttgacacagcgcattgaaaagttggacgataaattggatcagcagaaggctctatctggacaaataagagatgatgtcactgatgcacgtctgaagcttgagaatatnggttcagaaatcaagaacatcaaag

SEQ ID NO: 43609 - DNA, 420 bp, Zea mays
  unsure at all n locations
  Clone ID: LIB3066-044-Q1-K1-E6
gtctcggtctcgcaggggcagggctgggcggtcgacggaggccaattctccaacttcctggctccgtcgatcatccagcaccagcaggagaatcccgtcgaatccccctctcaaccaagggcgcgcgcgcgtgcgtatgcctnctccagatccaaagcaacagacagcgagggggcaccggggtccgccgcatgtttgcgatttatggaggatcatgctttcttgcttactacattagctcctgacgcgccgacctcccctcgcgttcattgatttctgttataattactaccgagctactatctccacattattattggtaaagaaagaaagggcgcctnctctaatttgatgggcattccgtttccttctcaacttcaacgccaacaacagttgatgctactatggttggaaatcggg

SEQ ID NO: 43610 - DNA, 320 bp, Zea mays
  Clone ID: LIB3066-044-Q1-K1-D11
tgcacagccggcattcaatatgtacctgccgctcggcgccggccggtacgaatggacccgggtagccagcggttggtgacgacgtacatgcgcgggcgcgccggccggaaagctagcagcagtggcgcataagaatgacgagctaggaggaaggaaggagacgcgccactgggcaagtacatatacaaagtgaccgacgagcgtacagtggtatccgtgaatcatgtactagcatagacatagcatttgaacagcatgaggtgtacatacccccctagttcgttcagaagaatgctggtgactgtaactcctgtttctgc

SEQ ID NO: 43611 - DNA, 331 bp, Zea mays
  Clone ID: LIB3066-044-Q1-K1-D12
cccacgcgtccggttctagatcgcgagcgggcccttttttttttttttttttttgttttggtttttttttttcagccttaggtactcactagcgtttccttctcattatacccttattcgttctcatacagatctcctggacgaagaaacatacaaaagctacatcaaaatcaaacggctattttgttctccttttgctcattaggagggctctccagttggctgtccgtgtccggttgggaggccccgggcgcactggggtgggcggctgcccgcctggccgggcagccgtaagcgccgagcggcgtgccggcatctccgttgcggtgtg

SEQ ID NO: 43612 - DNA, 328 bp, Zea mays
  Clone ID: LIB3066-044-Q1-K1-D2
ggccgccgcggccgacggatgctggcgctgcggggtgtacccggcgaggccatcgagccggcgccgtgtggcgtcgctgatctccctcgcgcggacatcgcggctccgcgccgtgacggacgcgctcccggcgctccgtggcgcggcgcgcgaggctgccggatcgtcggcttggcctcggctcctaacggatcggccggagcttccggtccgataagcgggcggctggcctctcgagctacacgtgcgctacaaagctgggctctgctcgcgactgccccggaaggggcgcgcctgtggtgctcatgaacccgagctggcggcttcg

SEQ ID NO: 43613 - DNA, 360 bp, Zea mays
  Clone ID: LIB3066-044-Q1-K1-D3
cccacgcgtccgccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaggctattt

SEQ ID NO: 43614 - DNA, 303 bp, Zea mays
  Clone ID: LIB3066-044-Q1-K1-D4
cggacgcgtgggcaagggaaggtcgaggcacgagagcgctagcggcggagctagcgagcacccggcgtcgggcgacggtggcgccatgggtggttggtactccgccattgcggccaccaggctgaagatgctgcgccgcggatgccggggtgccgctgccgtcctccccgtcgccagccacgacagcgtcaccggcaaggagaggaagaggaagtgcaggaagcacgcctctatcctgggcgactccggcaccgtcgacccggacttctcgcggcggtaccggctcggcgcggagcttgggcg

SEQ ID NO: 43615 - DNA, 436 bp, Zea mays
  Clone ID: LIB3066-044-Q1-K1-D5
cccacgcgtccgggagctcaagatgatgagcttgatgaagaagactttaaggaggaacagaactctgtagcgcgtctcattcacatgctgcacaatgatgatcctgaagagatgctgaagatcttatgtactgtacagaagcatatacttcagggaggcctcaagcgtctaactttcactgtgccttcgttagtattctcttctcttaagctggtcaggcgattacaaggccaagatggagatgtcactggggaggatgttcctgcaactccaaagaaaatattccagatattgcatcagactattgaagcactttcttgtgttccttccccagagttagctctgagactatatttgcagtgtgcagaggctgccaatgactgtgatttggaaccagttgcttatgagttctttactcaagcgttcattttatatg

SEQ ID NO: 43616 - DNA, 315 bp, Zea mays
  Clone ID: LIB3066-044-Q1-K1-D6
cccacgcgtccgttgtacgccaagaaggactacaagaccccctcatggaagaggtatttgcagatctcgcggcggttcttcttggagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcaccttcgcagcttcctcaacctgccatcagagggtgtgcctaataccctcaagaagtct

SEQ ID NO: 43617 - DNA, 136 bp, Zea mays
  Clone ID: LIB3066-044-Q1-K1-D7
attgtatgcatgttctcctctcacatatgttgttggtgtgctgtatatataattaatttgttaactttttttcaggcacatatgtatgttgagatcaatacactagtagaaaaaggctcaaaacgcgttgtgcgat

SEQ ID NO: 43618 - DNA, 345 bp, Zea mays
  Clone ID: LIB3066-044-Q1-K1-D8
cggacgcgtgggccggcgactacctgctggtggcgtccacccggttcatcaaggagaagagcagcaccacggccgtgatccgctacaagggctccagcgccccgccgccggccaagctgccggagggccccagcgggtgggcgtggtccatcaaccagtgcaggtccttccgctggaacctgacggccagcgcggcgcggcccaacccgcaggggtcgtaccactacggccagatcaacatcacccgcaccatcaagctcgccatgggccgcggcaaggtcgacggcaaggagaggttcgccttcaacggcgtgtcgcacgtggacccggaaacccccgtcaagc

SEQ ID NO: 43619 - DNA, 462 bp, Zea mays
  Clone ID: LIB3066-044-Q1-K1-D9
cccacgcgtccgcaaagaaacaagcgcacaagatcaaatacctcgccgccaacaatggcctccaggtcctccatcctgctcgccatggtgatgctggctgcgctattcgttgttggtttgtgcaccacccccctcaccttccaggtcggcaagggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccgacaccacctataagaccacactcagcatctaatcaatctctggtgatgaattagatttcaaaagagctcatctagcg

SEQ ID NO: 43620 - DNA, 351 bp, Zea mays
  Clone ID: LIB3066-044-Q1-K1-E1
cccacgcgtccggacggcgtctcgccgctcgcttcgtttccgccttccccctcccgcaagtcgccgccggctcgcattcgtggttccgcgtggggggtccgtggaaacgcgacaagagaggcggaagcgatggcgaagtcgtgcaaggggttggccatggagctcgtcaagtgtctcagcgagaccgactgcgtcaaggtgcagaaaaggccgtacaaggagtgcgctggggagaaggtgccaaacattaccagcgagtgcgttggcctgcgggagacctacttcaactgcaagaggggccaggttgacatgcgggcccgaatacgcgggaacaagggatactagtgatgt

SEQ ID NO: 43621 - DNA, 464 bp, Zea mays
  Clone ID: LIB3066-044-Q1-K1-E10
cgaagactggcgggcaccaataaccctgttcctacaggggtactatcatccaactgacgtcagtgaggcaaagcgcctcagacatcgaagccgggacttcgcactgattgagggccaattatacaagaaaggggtcagtcagccaatgctcaaatgcgtcaccgaaaccgaaggcatgcagatcctacgcgaagtccacagtggcacgtgcggctcgcacgcagggccaagggccctggctgccaaggtgatccgacaagggttttactggcccgcaatgatctgcgccgcaaatcgggtcacgaggtcctgcgaagcctgccagaagttctctcctcggtcatgcaacccctcgcaatatacaaagctgatcgcccatacatggcctatccagcgctggggcctggacatcgtcgggcccctgcccaccgctcatgggaaccttaagttggccttcgtagccg

SEQ ID NO: 43622 - DNA, 457 bp, Zea mays
  unsure at all n locations
  Clone ID: LIB3066-044-Q1-K1-E11
cccacgcgtccgcggacgcgtgggcggacgcgtgggcggattctggattcatttgatgttggcgtttcgtttattgtttttctaattgcccattcattcatgccgttcgtgcccacgcatgcagcccatgaggatcgagcatggaggagcctagttcttgatccaatctcccagcatgcttgacgaacgcgaagacgaacgtggggcgaacgctgcatgctaacgcggttgatcttattcctaataatacgtagcgattcgggagattgatttttgatcatgcacaagcgatccaaatcctgcgagccgtacaggaagatggaggagcgcgtcgggtgcagcaatgccgcgacgtccttcgacgactccgncaccggcagggcgccgggcgccgcggcggcgcagtgcttcacggtgtcggtgttcctcgccaagatcaacggcgccgcgcgccacg

SEQ ID NO: 43623 - DNA, 398 bp, Zea mays
  Clone ID: LIB3066-044-Q1-K1-E12
gtcaaggttcgtcaaggtacccagcctggatagaaggtggtcctacggggcaaaggaataagaagcgaggaactcgccagtgtttgggaatcagtatgtacacttcaatatcagggttccgacggaggtgacgcaaaggcagagggagctgatagatgagttcgataaagaggagtgcgcagaccgggaaagacctgcggttgcctccggatgaagtttttggttcaaccattaattagttttagcaccacactagtttgatgccctcaatttctccaacccgtcataaggtgctgtaggcaccaaaagcttattgtaacatttgatccttatatagcatctactcagtctgtaacgtatacattacgcgctaaattattgtaccattttcgatttct

SEQ ID NO: 43624 - DNA, 170 bp, Zea mays
  Clone ID: LIB3066-044-Q1-K1-E2
gccacgcgtgcgggagcgagtgtcggaacagactcctaaacctccagcaggatcttactcggtctattgctatataacaacatgtctgtactgctgatcatagcacttagcattgtaccatgactagagcagtccatataactgcctttagataaaagggcggacgatat

SEQ ID NO: 43625 - DNA, 351 bp, Zea mays
  Clone ID: LIB3066-044-Q1-K1-E3
cccacgcgtccgggccgccgtgccggttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaagtgactaagctggcggac

SEQ ID NO: 43626 - DNA, 380 bp, Zea mays
  unsure at all n locations
  Clone ID: LIB3066-044-Q1-K1-E5
cgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttggccttatcgtgctcgtcgttcggccacatggtgaccccngccaccgacacaccggcgatcacgccca

SEQ ID NO: 43627 - DNA, 182 bp, Zea mays
  Clone ID: LIB3066-044-Q1-K1-D10
actattccttatctctgcacaccaccccatcaccttcatatcataacccatccaatcctaccacctgatcctcaccaccatatttccaccatatcctccatgaatatcatacagtcaccaataattacttatcctttacgctcacacacttccctactaccacatacactctaaacaccaaa

SEQ ID NO: 43628 - DNA, 119 bp, Zea mays
  Clone ID: LIB3066-044-Q1-K1-B2
gcgcggggtgacgtcgcatggcgtcatcggcggcgtaacctatcgtaccatcgacggcacgtcgtccacgcccgaagccgtcagcctgctctgctccgagacgcagacgggcagcgggg

SEQ ID NO: 43629 - DNA, 353 bp, Zea mays
  Clone ID: LIB3066-044-Q1-K1-B3
cccacgcgtccgcccacgcgtccgcccacgcgtccgcccacgcgtccgcttttggaatactaaatttgccagacctgatcacttctgagaaaatttgctactggagataacaaatttcagttttatttcgcatttaaagatgcctattgttatagtatctgaggcagtaggacaggacttataagatacaacttccccaatcattcatgatacaatccatgaacaacttgagttatctattaggcactaagttactgctcaactaaaagaaatggaactaaactaacaaatacaaatgctacttaagtacatatgctatatcctatgtcaacgacgaattgcacagtggaatt

SEQ ID NO: 43630 - DNA, 310 bp, Zea mays
  Clone ID: LIB3066-044-Q1-K1-B4
ggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgtcaccgcggcgaactacgcgtcgttgtggtcgcccaagcgcctcatgcagcgcgct

SEQ ID NO: 43631 - DNA, 392 bp, Zea mays
  unsure at all n locations
  Clone ID: LIB3066-044-Q1-K1-B5
cgctccgcgctgcgcctnccccaaagcttcagtggctgctgcgacccttctgttctccgctcttggtcttgggtgatcgccggcggtacttgtagcgggcctttgtaggtatttatctgagggaagaagaaactatacaattcatcatgtcaggagggtcgtctgaatcttccccgttatctggacaaaatagccttagttctctatcaatttccaaggacaatgaactatcttcagagtctggctgcttgtccattgttgtactaggcgcttctggagaccttgctaagaagaaaactttcccagcgctctttcaccttttccagcaaggatttctgcaatctggagaagtccatatatttgggtacgcaagatcaaatctttctgatgat

SEQ ID NO: 43632 - DNA, 325 bp, Zea mays
  unsure at all n locations
  Clone ID: LIB3066-044-Q1-K1-B6
acaatatctgaggatgttgttcggagtgcgttttctgccaccgaggaaggcttcttgacactcgtgcggagaacacgttttataaagcctttgattgctgcggttggatcctgctgtctagttggtgtcacatggagagggacactatatgtggctaatctaggcgattccagggctgttattggcgttctaggtagatcaaacaagatcgtggctgagccactcacaagagatcataatgcaagtagggaggaggtcaggcaggagcttatatcccgtcatccagatgattctcanattgtcgttctcaagcatggtgtttggc

SEQ ID NO: 43633 - DNA, 389 bp, Zea mays
  Clone ID: LIB3066-044-Q1-K1-B7
cccacgcgtccgggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctccttcacgccataagatatctagcaattggtcactcgccttaattagttcgctttgcttttgaggttgattcgaccattttgct

SEQ ID NO: 43634 - DNA, 348 bp, Zea mays
  Clone ID: LIB3066-044-Q1-K1-B8
gccaccctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcactttcgcaccggcaagctcgagcgcg

SEQ ID NO: 43635 - DNA, 398 bp, Zea mays
  Clone ID: LIB3066-044-Q1-K1-C1
cccacgcgtccgagtatttccatcagacacgctgtctggatgtctataaaggaaccatctgtggcttggaaggaataaactttattactgtagcaacgcctcaccttggttcacgagggaacaagcaggttccactcctgtttggatctgttgcaatggaaaaggttgcttgccacatcgttcattggatatttaggagaaccggtagacatctctttctaactgacgatgatgaagggctgcctccactgctgcagcggatggttgaagatcatgacgatctctactttatatctgctttgcgagcattcagaaagagaatggtgtacgcaaacgcagactgtgatcacattgttggctggagaacatcatctattagaagaaacaatgagctttct

SEQ ID NO: 43636 - DNA, 439 bp, Zea mays
  Clone ID: LIB3066-044-Q1-K1-C10
ccccaattcgattccatcccatgggttggcgttggcacgacgacgacggtgacagcggccggggcctcggcggtgtccctgacctcgctggtggcgggggcgatggggcgcagtgcgccacgcgacgggtggtgcagtcccgctgccacacggaggaagtcgagcccggccgatttgtccgcaagtgcgagaagacggagcagctcctccgcgactgcgtcggcaggccctctgaactggtggaatccaaaactgaaaacactgaagaagatgtcacagaagaaatgaagagcggttcactttctcttgggtttccaagaaacgagcccttcgcattccctggactccgcagtgacatggaagcccttgagaaagacttctttgggagcctagggaacgtcctggatgaaactgagcggatggccaacagcttcgtcag

SEQ ID NO: 43637 - DNA, 465 bp, Zea mays
  Clone ID: LIB3066-044-Q1-K1-C11
cttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaaccaccagaccatggctatatgcacgaacgccaagggcagcaccaagggttgcctcaaggagcttgcatgcttctagaccctccatcgactgacccatctctctagttataatttttctctcgtccttgcattgcccattagatgctatcca

SEQ ID NO: 43638 - DNA, 51 bp, Zea mays
  unsure at all n locations
  Clone ID: LIB3066-044-Q1-K1-C2
cccacgcgtccgcccacgcgtccgcaccatgatgaggcantatgtcttcat

SEQ ID NO: 43639 - DNA, 381 bp, Zea mays
  Clone ID: LIB3066-044-Q1-K1-C3
ggctaatgcaggtcactacaatggatcgctgtgtcaagaaccatgtcaaggagttcgagaagaactttgctgttaagttcccagcttgctcaatcgccgcgaagcaccatattgaccagagcacaacaattcttgacgtgcaaggagtggggatgaagcaattcagtaaagctgcaaggtagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtg

SEQ ID NO: 43640 - DNA, 292 bp, Zea mays
  Clone ID: LIB3066-044-Q1-K1-C4
tcgcccacgcgttcgattcaaaccagcactggtttgtgctgatacatttagggctggtgcttttgatcagttaaagcaaaatgcaacgaaggccaagattcccttttatggaagctacatggaatctgatccagtgaaaattgctgttgaaggtgtggagaggttcaagaaagaaaactgtgatctcatcattgtggacacaagtggaaggctcaaacaggaagcaagactctttgaaaaaatgcggcaagtttcagaagcaccaaaaccagacctggtgatttttgtgatg

SEQ ID NO: 43641 - DNA, 375 bp, Zea mays
  Clone ID: LIB3066-044-Q1-K1-C5
cggacgcgtgggcagcagctcaccgtcgtgcctcctccatcggcatccacccggccgagagcacaacgtgtaccgtctctccccagcgtgcgcgcgcgcgtggtcggaggctgccgtcgctcgcgtcggccgcccccgccggccagcgagagcgagggacaacgaccgaccgaccgaccagctcgaggtgaatgaacagccgcataccgttcctccagaaaatgcaccgctggatcatccctagctgcggcgacacccgccagccgcgcccttccttccgccatcgagatgcgttcccgaggccggcgtcggcgtccgcgtcggcgtcagcggccccgtcccctcagaagctgaagaaagtggggtcggaaggga

SEQ ID NO: 43642 - DNA, 383 bp, Zea mays
  unsure at all n locations
  Clone ID: LIB3066-044-Q1-K1-C6
gcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctggcagatgcangggaatcgctggggcttgggtggggccatctgggcgttcagcgtcgtcacctacttcccgctggacgtgctcaagttcgccatccgctacgcgctcttcggcaagggctggaacaacaatcaacacaagacgggct

SEQ ID NO: 43643 - DNA, 444 bp, Zea mays
  Clone ID: LIB3066-044-Q1-K1-C9
cggacgcgtggggcaagaactcctgcaccaagaagtacgactgcaagatccttcccaactggctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctacggcggtacaaaggccgagaggacgtcacggacatcaacgtcaaggattgcactcttaagaagacgatgttcggcgtccgca

SEQ ID NO: 43644 - DNA, 460 bp, Zea mays
  Clone ID: LIB3066-044-Q1-K1-B12
cccacgcgtccgcccacgcgtccgggacactttagatgaaccagaggctaaggcatccatgatttggataattggagaatatgctgaaagaattgacaatgcagatgaacttcttgagagcttcttggaaacattccctgaagaaccagcattagttcaactgcagctgctaaccgctactgttaaattgtttcttaagaagccaactgaggggccacaacagatgattcaggctgttctcaataatgcaacagttgaaacagataatcctgatttgagggacagagcttacatatattggcgacttctgtctactgatcctgaggctgcgaaagatgttgttttggcggagaaacctgtgatcagtgatgactctaaccagcttgactcatcacttcttgatgagctgctagcaaacatttctactctttcatcagtttatcataagcccccagaatca

SEQ ID NO: 43645 - DNA, 451 bp, Zea mays
  Clone ID: LIB3066-052-Q1-K1-D6
gaaaagaaaaggaacctgtcttgatgtcgtcgtcgtcgctgtctccgacggcggggaggaggtccgggtcggacggcgactcggcggcggacacgcacaggcgcgagaaacgccggctgtcgaaccgcgagtcggcgcggcggtcccggctccggaagcagcagcacctggacgagctggtgcaggaggtggcgcgcctgcaggccgacaacgcgcgcgtggcggcccgcgccgtcgacatcgcgtcccagtacacccgcgtcgagcaggagaacaccgtgctccgggcccgcgccgtcgagctcggcgaccgtcttcgctccgtcaacgaggtgctccgtctcgtcgaggagttcagcggcgtcggcatggacatccaggaggagatgccggcggacgacccgcttgtgcgtccctggcagctgccctacccggctgccgccatgcccat

SEQ ID NO: 43646 - DNA, 284 bp, Zea mays
  Clone ID: LIB3066-052-Q1-K1-D7
acgcgtgcaagtaggattttgatgaacacgacctgcttgtgtggtgctggatcgtactctgtgggtgaaggtgcttgacacgctggaaggcgagtgaaagcatgattctctgatcacgagacatgttgagaatagataaacacggacaacagctctgtacatggcagttggcaagctattgttacttgctaatcggttggtacctgaaatgatctctaagttggtctgttatcaaggcctgtacaccggatagagttgaagacgcaggatctaatagccaatga

SEQ ID NO: 43647 - DNA, 449 bp, Zea mays
  Clone ID: LIB3066-052-Q1-K1-D8
gtaccgaacctgactatcaataggattgttcttcgtgataataactaggttcggataatggatgatggtcgcataggcctgctttatatggccctttactcccgtgttgttatggatctttgctaaaaacatgatcaagatatcagcttttaacaagtcaagggcgatttttacacatttaaagggaaatggcgcttataacaacttggggatcagcacaccctgtcgaagtacatggttgaaactaagatgcatagggacacctttatatctgaatctatccttgaagaggtataaccatatatgtaattcttcatataatgtttcacttgtcatgctaagatggataaagtaggtttttatgtgcacactgtattctgatctggatatactagcgcttttcatgataatgggcatgcttatttaaagaacatgatgatcatatactt

SEQ ID NO: 43648 - DNA, 437 bp, Zea mays
  Clone ID: LIB3066-052-Q1-K1-D9
cggactcgtgggcggactcgtgggcggactcgtgggcggcgtgcacatcagctgggtgcgctcggtcaccatggactcctggaccgaggcgcagctccgcaagatggaggccggtggcaacgaccgactcaacgccttcctcacagctcgcggcgttcctaaggagacgccccacgtcgccaagtacaacttcaacgcctcagccgcctaccgcgaccgcatcgccgcgctcgctgagggaaagccgtggactgacccgcccgtggtcaaggagactcccggatctggcgcccccgcccccgctaggaagccgcccgtgcacacatctgccgactccggctgcggctggtgggacgactgggacgacgattttcggccggacatgatgcggaatcagtcggttggatcgttcgtcgacgcgggtgcgcagtcaggga

SEQ ID NO: 43649 - DNA, 454 bp, Zea mays
  unsure at all n locations
  Clone ID: LIB3066-052-Q1-K1-E1
ggcaggaagtggtcttctgaggaacaagacctgtctgtctctgctggatctttctttgtagttgatgatgctggacaccgtggaaagcgaatgagaaaatcattctctgatcaagaagcatcttcagaagagtcaaacggtcagaacagctctttacagggcagtaggcaagctattgtgacttgttcaccggtaggtacctcaaatgatcttcaagttggtctcttatcaagcaaggcagcaaggaaagagttgaggaagcagaagcgaatagcagctgagaaagtgtgtgatctttgcggcagatcaatgctctctggaaaggatgttgccaccttgctgaactgcaatacaggaaaactagcttgcagcagtagaaattcaagtggggcttaccatctatttcacacttnctgccttttacactggactattctgtgccaatacgagatgc

SEQ ID NO: 43650 - DNA, 448 bp, Zea mays
  Clone ID: LIB3066-052-Q1-K1-E10
ctacgaggtactcaccgagcctctcaaccaccatgttgcactgtccaggggtcatgggctcgtcgtagagcaaggcctgtgattgaatgcatccaaacaacgacaccaacgccaacattaattaattagtagtctccatgccctgggattgtgcgtggccgctccgttaaacaccacccatccttcgttcggcattttttcccccttgtttatataattttattgtatcgttttggcaaataattttgtgattcgaccccaaagcaagtttggttgtcttacgatttgtaaacctggaacaatatataatgtgattgaactgctttgtctaaaaaaatagaatctaaatatgcaaaccccgtggccgtcaataaacgattaaacactaacgtactaaaggccacaaaacagaaagtcgctaacaaagtacaaatagtccgtgcatggc

SEQ ID NO: 43651 - DNA, 294 bp, Zea mays
  Clone ID: LIB3066-052-Q1-K1-E11
acggccactcgtacgctcactcttgcactgaccattggtcatgggctcgtcgtagagggtggcgtgtgattgaatgcatcctaacaacgacactaacgctcactttaatcaagtatgagtctccattcactgagattgagcgtgctcgttgcgataaacaccacccatgcttcgaacagcatttaacacgtcttgcttatataattttattggaccactatgtccaataatgacgtgattatacaccagatcatgattggtattcatactattctctaagccgaaacaatatat

SEQ ID NO: 43652 - DNA, 440 bp, Zea mays
  unsure at all n locations
  Clone ID: LIB3066-052-Q1-K1-E2
gatctctgctcccgatccatctccggctgccgcgcgcggtagatctccgttcggcagcgtgtgatctgcccgatccgtgcggttgggtctggatcgggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccattcncaccatcggtttcaatgttgaaactgttgagtacaagaacattagcttcacggtctgggatgtcgggggtcaggacaagatcagacctctctggaggcattactttcagaacacacagggtcttatctttggtggggatagcaatgaccgtgaccgtgttgttgaagccagagat

SEQ ID NO: 43653 - DNA, 454 bp, Zea mays
  Clone ID: LIB3066-052-Q1-K1-E3
cccacgcgttcgccatttccaaatccacacctggcccggctgccccaaatgcgtcggcatcgcgccgtcgctgctgcacaccgtcgatgactcccgccccttcgaacgccgtcggcgacctcttcgctgccaacctcacgggcgcgctccttgcggttgcctcctccgccttcattggcgttagcttcatcgtcaagaagaagggcctacgccgggccgtcaccgccggcgcccgcgcaggtgttggaggctatgggtacctcttggagccactgtggtggattgggatggttacgatgctgattggggagattgccaattttgtggcctacatgtttgcgccagctattcttgtgacccctgttggtgcgctcagcataattgtcagtgctgctctagcccatttcaccctgaatgagaagctgcagccgatgggtgtgttgggctgtgtgct

SEQ ID NO: 43654 - DNA, 452 bp, Zea mays
  unsure at all n locations
  Clone ID: LIB3066-052-Q1-K1-E4
aatcctcatacccaagggtgacttccttgtcggacaactcaacttaacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggtgaggtgtccggngtcacgctgctcaacttcaagttcttccacatgaacatgtaccggtgcaaggacatgctgatcaaggacgtgaccgtgacggcgcccggtgacagccccaacacggatggcatccacatgggcgactcatccgggatcacgatcacca

SEQ ID NO: 43655 - DNA, 431 bp, Zea mays
  Clone ID: LIB3066-052-Q1-K1-E6
catacggatgcgagtggcgtgaccaaagataagaagggatggcttggttggggcgcgcgaggaaggtgcctagggcgatgactagccatcaaaggtggggagtaaggatgaaacaagtgacccagggaagcaaaaggagaagggcattgggaagaagaaaaagggtggctcatctgctgagtctgtataacatgatagcgagtacaagaaggggttaagaccagtgttgtggttgacacccgattgtcctctgaagacagatgaactcatacctctgcttgatgtactatcaaacaaagtgaaagctatcacgaagcttaaggaactcttgacaaccaaacttcctacaagcacatttccagtcaaaatcgccatccctattgtttcaacgatacgagtcattatcacattcacaaagtttgaagaactac

SEQ ID NO: 43656 - DNA, 450 bp, Zea mays
  Clone ID: LIB3066-052-Q1-K1-E7
cccacgcgtccgcccacacagaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtccttcgttccgccgggttctcatgtccgcggggctgtcgacggagctccgccacaagtacaacgtgcgctccatcccgatccgcaaggacgacgaggtgcaggtcgtgcgcggcacctacaagggccgtgaggggaaggtggtgcaggtgtaccgacgccgctgggtcatccacgtcgagcggatcacccgcgagaaggtgaacggctccaccgtgaacgtgggcatccacccctccaaggtgatcgtcaccaagctgaagctcgacaaggaccgtaaggcgctcctcgaccgcaa

SEQ ID NO: 43657 - DNA, 451 bp, Zea mays
  Clone ID: LIB3066-052-Q1-K1-E8
atttcatcaacgaaattcgtcaggctggcagaaatggagaactttcaggtgagactttcatgttcttcaacaagcagatcataggaatcaagagggagatcatacagcttggtgtaccgttatttcaacctaccacagaggatgctaattgtcacacataaccaatcccccttgtcctgcaggctgtcattgaccaccttgttctttggcgtttaataccagaaagcaggaaaccaaatagtgtcgacatcaacttcttcgatgaggatgaacattcgcatccctacttcaagcctccccatcttgacaaccccatttgcactcttctgctgtctgaaaccacgatggcatttggcatgtcacttgtcactgacagcaacggtaactacaaaggacctgtcacactttcactaaagcaagggtacttactagtgatgcttgggaacagtgc

SEQ ID NO: 43658 - DNA, 304 bp, Zea mays
  Clone ID: LIB3066-052-Q1-K1-E9
cccacgcgtccgcccacgcgtccggtcgttgctgctgctcctccgatcttcttcgctcttggcctttccttcctcccagccgcgcgcgcggagggaaggagaagaagagattagaagggcgccggaaggagaagaacacagctacattgactagccaataactaggaaaaaaacaaaattagggtcggccgggcaggccgcggcgcgcggtgggcgcggaggggagcaggcttccacgcgctcttctctctgccttcatctgatcgatcggttcaagaacacgccggaattgaagtctcgcatt

SEQ ID NO: 43659 - DNA, 435 bp, Zea mays
  Clone ID: LIB3066-052-Q1-K1-D5
cccacgcgtccgcacacacacactcacagaggagagaagataagagaacgaggggcagggcgagccagcgccgatagctgaagcaaggcagggcaagagaatccgtacgtcgaggtgcaagtcgtaggtaggatggacgcggaccagtcaggcgtggttgcggcggcggtgaagccggcgctggccaaggggacgccgtcggcgtcgttccggctgcgcaacgggagcctgaacgcggtgcgcctccgacgcgtgttcgacctgttcgaccgcaacggggacggcgagatcaccgctgacgagctggcgcatgcgctggatgcgctgggcctggacgccgaccgcgccgggctgttcgtcaccgtctgcgcctacgtgcccgacggcgccgtgggcctgcgcttcaaggacttcgacaagctccaccgtgcgctc

SEQ ID NO: 43660 - DNA, 434 bp, Zea mays
  Clone ID: LIB3066-052-Q1-K1-C11
ctggaagactggcgtcaaagtggagacccagaagatgatgctgggaacgttcaggccccagctagagccctatatctacgagggcgaagaagagacgacacctgctggcatttttgctagaggctcctattccgctaaactaaagtttgttgatgacgatggcaagtgcttcttggagatgagctactactttgagattaggaaggagtggccaggaggccaatggatgtggccggaccagcagggcagagctgactcgtcggagtacgctgttgttagagctcatagcaaaaagccaagcagaaaatatgtgctatcgcttcaagaatgtttcactactttcttcgtcattatcgattgtgttttgatttgtttcgagctgtcattaattgtatgttgtttgtcgcataaggctgcttattcgcatatataat

SEQ ID NO: 43661 - DNA, 442 bp, Zea mays
  Clone ID: LIB3066-052-Q1-K1-C12
cccacgcgtccgggccggccgtcatgctggcacagccgcacggctccagcagccgcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggc

SEQ ID NO: 43662 - DNA, 455 bp, Zea mays
  Clone ID: LIB3066-052-Q1-K1-C2
cctgcattgtttggtcgccactactaccatgcgcgatggccgcgtcgctgtcctcggcgctgagctccatggaggtgatgctggacgcgctcatgcagcgagggataggcaagccggaagaagccagcagcaagcccaaagaagaggagccgtcaccggcgctgcccagccgcccgacggtgcgaggcagactcccggcgctgcataggcccggcggcacagcagcggctccgtggatccaccggccattcccggtaccgcagccaacgcaggaagacgatgaagagaaatgtctggtcggtcgggagctggaaagacgggcggccaaggcagaggaggaagtgaagcagaaagacgaggagatgaggcagaaagagcagctcatcgccacgctgcaacggcaggtgcagcactacgaatcccggctctcggaatgcgaggtcaggatgaaatct

SEQ ID NO: 43663 - DNA, 456 bp, Zea mays
  Clone ID: LIB3066-052-Q1-K1-C4
tcgatcggcgctgtccgtcttcgctcttttcgccagggcaaattaaagctccaatgcaggctgcgtactatgcaaaggatctttgggttgaagtccagttgaccggaattggaaaatacttctgatacttacagatttcacagaggtcttgtttattttctactattttccttcaagcacgtggaatagtacgtttgacaaacaatttgctgacgaggttttcgaacacggctgaacacgcgcgcaaggcgtgcacagtacacgcgcgcatggggaggaggagaacaagaggatggtgaaggcaaggcccaagccaacgccggtcaaagcggccccagaagtgatcttcgacccaatggcctctggtgcccggaagccccgccgaccaggggcgccgtcagccagcaaagaatggcacagcttcatgggatcgagtctgtcggatatgtatcggaa

SEQ ID NO: 43664 - DNA, 453 bp, Zea mays
  Clone ID: LIB3066-052-Q1-K1-C5
cccacgcgtccgtccacgcgtccgcccacgcgtccggtccttggcgtggtgtcctcgtcctggtgcccatctctgtcccaatcaaactgatcgatccgtcgcctgcagggccacagcagccgcggcgaggtcgtccgtcggattcggaagctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgacctgcacgctttgatcagccctcctgccaaggggactccgctcccgctgatcctactcgggaagtcc

SEQ ID NO: 43665 - DNA, 444 bp, Zea mays
  Clone ID: LIB3066-052-Q1-K1-C7
cccacgcgtccggagaatccccaagcaatcaaacagggtacagggagaggataggagaggagaggagaggttgggtctgggacaccatggatccgctgaagctgtacggggcggtgatgtcgtgaaacgtgacgaggtgctcaacggcgctggacgaggctggctccgactacgagatcgtgcccatcaacttcgacaccggcgagcacaacatcctggagcacctcgtgctcaacccgttcggtcaggttccagctctgcacgatggcgacttgtacctcttcgaatcacgagcactctgctactacgctgctcgcaaaatcaagccagagctgttgacggaaggaaacctcgacgaggcagccatggtcgatgttttgatcgaggtgcaggctatccagtacaccgttgcactgaatcccatcctcttgcaggtcctcatca

SEQ ID NO: 43666 - DNA, 449 bp, Zea mays
  Clone ID: LIB3066-052-Q1-K1-C8
cccacgcgtccgcacgccacaggcaaggcacagaggcttgtgagggagagcgaggagcggaggaggacatggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagattatggacagtgatacaggcacagcagatgactttgttggtgaagcaacgattccattggaagcagtgtatactgaaaggagcattccaccaacactctataatgttgtgaaaggtgaaaaatactgcggggaaatcaaagttggtctcacattcactcctgaggatact

SEQ ID NO: 43667 - DNA, 271 bp, Zea mays
  Clone ID: LIB3066-052-Q1-K1-D1
gcgtctcctccctcggccggccgctcgtccgctcgctctcccccgcacgaatctccaggtgatggcggcgcgccgctgtcactgacgtctgcagcggtggccgcggcgagcgcgcgatcgctggcgatggccgtcgaggccagcatggagcgcgcgcgcgactgtcggcgccacgagcaccagctgatgcatcagccgcgcatccaccggcggtcggctcttgcgtccgtgacctcgttcacgatgcagtgggcatcagggtcggcgtctg

SEQ ID NO: 43668 - DNA, 446 bp, Zea mays
  Clone ID: LIB3066-052-Q1-K1-D10
cacagccggacgatccgagcagagaaggggaggtacctgctacgactagctagagtccacgcgcgatggcgcccaccaggatccgcgtggccttgctgagcttggcgctggtggggctgctcatctgccacctcgccaccaccgcctccgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgaccagttgaagcgaggaaggtggccaaaactgagggcccggctactatcttttgctataactaaagatagggccaagtttaatttctccgataaattctgtccgagca

SEQ ID NO: 43669 - DNA, 412 bp, Zea mays
  Clone ID: LIB3066-052-Q1-K1-D11
aaggggggcagcgagcgagcgagccacgtacgaagcggtaggtagcagcagtacgtgctggcgccaagctagtgccaatggcgagggcgatgctcgtggccctggcgctggtcgtggtggtggcggtggagatcgcgaccagcgcgttcgccggcaagatcagaatgaggatactagacagcatcgacgactcgatcatttacaacaacaggtccaacgcctcagcctggtacaacatgacctacttcgagtcggaatgccgcgtcttctattccgacatgaagctggctgatgagacgggatctgcaccggctcctgcaacgacgccgtagccgacgaccagttgaagcgaggaaagtggaccaaactgaaggcccggctactatcttttgctataactaaaaatagggcc

SEQ ID NO: 43670 - DNA, 447 bp, Zea mays
  Clone ID: LIB3066-052-Q1-K1-D12
cgcttcccccttccacccgccgatcgccctccgctcgctccaccgcggcgggcgatcgctcatctacccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttagaaatatggtttgtactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatga

SEQ ID NO: 43671 - DNA, 416 bp, Zea mays
  Clone ID: LIB3066-052-Q1-K1-D2
ctcttatccacccgcgcgcccaccgccgcgcgcagcaccgcgccgcccacccgcggtcaccgcagcgccccaaatgccgctccaaccctagcctctcgccatgcctttcgatctcgggcggccatgggaaactgatgccgctcgccggtcgccgtcgcgcgggaggacgtcagctcctcgcactttcccgcatccacctcgtcatggagctctgcgagggcggcgagttcttcgaccgcatcgtcgcgcgggggcactacaccgagcgcgccgtcaccaatgtcactcgcaccatcgtcgaggtcgtccatttctgccatcggcacgacgtcatccaccgtgacctcaagccggagaacttccttttcgccaataagaaggagaactcgccgtcgcgcagcgcccctctcgatatg

SEQ ID NO: 43672 - DNA, 443 bp, Zea mays
  Clone ID: LIB3066-052-Q1-K1-D3
ggaacatccatcgatcttcccccagcggcgaggagagccggcggtcacaggaaggagaaagggcttgcgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccacgactcgtggacgtcagcgtgcgaagcgaccggaagcgccacggtggtgatccccaagggcgactacctggtcggtcctctcaacttcactgggccatgcaaggggagcaacatcgacattcagctggatggcaacctgcttggatcaaacgacctggacaagtacacggtgagctggatc

SEQ ID NO: 43673 - DNA, 304 bp, Zea mays
  Clone ID: LIB3066-052-Q1-K1-D4
tcgctctcatttacccatgcccccaaccgcccgactcatacccgcgccgacaacccgattccacggcagcgccccaaatcccgttccaaccctagcctttcgccatgcgtttagatctcggtcggtcatgggaaactgatgccgctcgacggtcgctcacgcgcattaggacgtcagcttctcgcacttaccaggatccacctcgtcatggagctctggcagggctgctagttcttctaccgcatcatctcacgggagcactacaccgagcgcgccgtcaccaatgtcactctcaccatcgtcg

SEQ ID NO: 43674 - DNA, 447 bp, Zea mays
  unsure at all n locations
  Clone ID: LIB3066-052-Q1-K1-C10
cccacgcgtccgacgacaaccacggcaagttcacggccgggccgtggaaacccggccacgcgaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagccaccgcgggagcacttcgacctcagcatgcccgcgttcctgcagatcgcgcaagagaaggccggcatcgtgcccatcttctaccgcagggtggcgtgcgcgaagcanggcggcatccggtacaccatcaccgggaac

SEQ ID NO: 43675 - DNA, 457 bp, Zea mays
  unsure at all n locations
  Clone ID: LIB3066-052-Q1-K1-A4
tcggtacataggcccaaccctgcttgaggctcttgaccagatcaccgagcccaagaggccttcggacaagcccctgcgtcttgcccctccaggaatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcaggaggctcttccgggtgacaatgttggcttcaacgtgaagaacgttgctgtcaaggatctcaagcgtgggtttgtggcctccaactccaaggatgaccctgccaaggaggctgccagcttcacctcccaggtcatcatcatgaaccaccctgngcagattggcaacggctatgccccagtgctggactgccacaccttccacattgctgtcaagtttg

SEQ ID NO: 43676 - DNA, 455 bp, Zea mays
  Clone ID: LIB3066-052-Q1-K1-A5
cccaaagttcatcactgataccaaggctgctatcgccgaaacttacaacctaacagattcagaatttctgaaagctgatagctgtcaaactcgagatgctggctcaactgcctcaacagctattattgtaggtgaccgtttgcttgttgcaaatgttggagattctagagccgttatttctaaaggaggacaagcgattgcggtttcaagggatcacaaacctgatcagacagatgagagacaaagaattgaggacgcagggggctttgttatgtgggctgggacatggcgagtgggtggtgttcttgctgtctctcgcgcatttggtgataaactcttgaagcagtatgttgtcgctgaccctgaaatcaaggaggaagtggtcgacagctcccttgaattcctcatccttgctagtgatggactctgggatgttgtcactaatgaggaagctg

SEQ ID NO: 43677 - DNA, 453 bp, Zea mays
  Clone ID: LIB3066-052-Q1-K1-A7
caataatggagtttccgcaccaccaccaccaccacgggcatcgccgcgacgacgacgaagacgaccgcagaggcccgcctcccccggtctacggcggctacggccagccaccgccacccgacccgtacggtcgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacggtcacgagggccgaccgcaccacggcggcggcggatcccagtacggccacgagacacgcccgcaccacggcggcggtggcggcg

SEQ ID NO: 43678 - DNA, 445 bp, Zea mays
  Clone ID: LIB3066-052-Q1-K1-A8
cgacggcaacctgctcggcaccggcgaactcatcgcgtaccagaggaactggatcgagatgggggaacgtcgagaacctgtccatcaacggccactgcaccatctacgggcacggagccctggtgtggagcaagaaccagtgccagcattcttacaattgcaagatcctcccgaatagcttggtgctggattttgtgacgaacgtccagatccgcggcatcacgctgctcaacagctagttcttgcacctcaacatcttcgagtgcaagaacgtgctgatcgacaaagtgacggtcaaggcccccggcgacagccgcaacacggacggcatccacatcggcgactccatcaacgtgaccatcagcagcaccaccatcggcgtcggcgaccactgcatctgcatcggccccggtagcaagatgatccgcatccatggcgtcaagtg

SEQ ID NO: 43679 - DNA, 195 bp, Zea mays
  Clone ID: LIB3066-052-Q1-K1-A9
ccggcaacaagaccatggccgtctgcaagaacgccatcggcaagtccatcggcttggcaaaggagctcgcctgcatctgaaccaattgactaacatgcatatattatatactaggtatatgcccgtgcattgcaacggaaaacacttgtgtatacacaggtcattttttagtaatgctatcaagaatcaactcat

SEQ ID NO: 43680 - DNA, 426 bp, Zea mays
  Clone ID: LIB3066-052-Q1-K1-B1
cggacgcgtgggttttggagttcaagcccgcacgaaatggagaacagtgccttgcaatccggacacagtatgtcctcaatcagcactgctgcacaacctaatgatcagcatgcttctggaagtagcagctccccaaatgaatttgtaaatcaagcaggaaataatatattatgacagagagtctctcacgtataggccaactcctgaaattggtcacacacatggccagatgtaaactatttgttcttatggctcccgaattccaaccctatagggtcttctactatggcaccagactagacagcagtggattggaaaacgaagacataattctcagggtcaacaaagtcaaagaccaaaaataagttgtaatgctacatacgagagcctgctcgggagctcgaaaccatttgcacaaccgatccc

SEQ ID NO: 43681 - DNA, 416 bp, Zea mays
  Clone ID: LIB3066-052-Q1-K1-B10
tcgcccacgcgtccggtccttctcctctcctttcctctccccgcgcccaacatcctgggatgttcatctgaaaagttgagatcgacagtttctgagcacagggcgcgatggacgttccggccgttgcggaccctggaacggagcgaggcgaaggcgctctgatccagtgcccgtactgcgactcggaggcgatgcacaagctggcgcatatcctcctccctggcctcgccgccgtctgcgtggacggcaccactgcggacccgttccgaagtccgttcgcagcggccgtggacctgcgcaaggagatggtggactacatgacgcagcgtgacgacagctgtatcgcggacgctctgatcgagtcggatgcgaaccaggacgcgcccggagcctatgtgccagacgaccccttcgag

SEQ ID NO: 43682 - DNA, 445 bp, Zea mays
  Clone ID: LIB3066-052-Q1-K1-B11
ccaccacctttaccaccgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgtaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagt

SEQ ID NO: 43683 - DNA, 432 bp, Zea mays
  Clone ID: LIB3066-052-Q1-K1-B12
cagaccaagacgtcgcgcgccgacgacgcggacgacgccgtgtcgcccgaggcgcgcgaggggcggcggatcgtcgacgagatcctgccctacctcggcgccaccaacctgtgggactacctgccgctcctgcggcggttcgacgtgctcggggtgaggaacaagatcagggacgttgtcggcaggagggacgccttcctgcagcggctcatcgacgcggagcggcggatgctggacggcgacggcgactgcgacgagacgaagagcatgatcgccgtgatgctctcgctgcagaagtcggagccggacgtgtacacggacaccatgatcatggcactgtgcgggaacttgtttacagccggtacggagacgacgtcgaccacgatagaatgggccatgtcgatgctgctgaaccacccggaggccctgaag

SEQ ID NO: 43684 - DNA, 454 bp, Zea mays
  Clone ID: LIB3066-052-Q1-K1-B2
cttgctggtattatgtgtgggcaatttggtgtgcctttctgggagttcttgtttgctactgggattgggaaagccatcatcaagactcatattcagacactatttatcgtgtccctgtgcaacaatcagctcttgtatcttattgaaaaggagttaatctggatatttggtcacgttcctgggttttctgccacccttccgtctgtgattgccagactccatgctgccaacgacaagtatctatcaccaccagccccagtctcaccgtcatcacaaatgggggagaaacagtggaatttctcttttacatctgtctggaactctatagtgtggcttgtgcttttgaacttcttcattaagatagtcacgtcaacagcacaggattatctcaaaaagcagcaggatacggagatggaacttatttcggattccccgatccatgaccattctaaaa

SEQ ID NO: 43685 - DNA, 455 bp, Zea mays
  Clone ID: LIB3066-052-Q1-K1-B5
cactaccataatatgaagacggaggactcatcctaccccatcttcatcgacatgaagtacggtcccaacaagttgtgtactgtcaacggcgccttcatggtcaccgacttggatgtcaccttcaagaacatcaccggcacctgcttcaacccggaggccgatagcctgctctgcactgacaaggttccatgcaccgtcgttaccatggatgacgtcaacgtcaagtatagcggcaccaacatcaagaccatggctatatgcacgaacgccaagggcagcaccaagggctgcctcaaggagcttgcatgcttctagacccttcatcgactgacccatctctctagttataatgtatatctcgtacttgcattgcccattcgatgctatccattggtaactcacaacagttaaacgacagacatccgacagctatattatgttcgacgatgtcacac

SEQ ID NO: 43686 - DNA, 444 bp, Zea mays
  Clone ID: LIB3066-052-Q1-K1-B8
caagggaccaatgaaaagacttggcacgatttccacctttttgagccttcaaaacagaacgggttccaaacttaccaccaaagaaatctgcaaagtggtcaaatggatgaacaagagccagcaaattctatctggtctagctgttaccatgtgtgatttggtaacttttaccacgatgattgctggagtttctggggacagactattggattaagcggcacgacctgatctattgagcttagcccatacctgcagcacttagtgttaaatttcttttgagaatggtagtctttcaagcatgacaatggctgctgttaagtttgggagtgccgccatcttttgggccaaagatggggtagaggatgattgatctgtcggaagtctgatggcgatgaattaatacgaggtcttcaatgctgacagaaagggttaatgaaacaaact

SEQ ID NO: 43687 - DNA, 416 bp, Zea mays
  Clone ID: LIB3066-052-Q1-K1-B9
cagaccaagacgtcgcgcgccgacgacgcggtcgacgccgtgtcgcccgaggcgggcgaggggctgcggatcgtcgacgagatcctgccctacctcggcgccaccaacctgtgggactacctgccgttcctgcggcggttcgacgtgctctgtgtgaggaacaagatcatggacgttgtccgcaggagggactccttcctgcagcggctcatcgacgctgagcggcggatgctggacggcgacggcgacggcgaccagaagaagagcatgatcgccgtgatgctctcgctgcagaagtcggagccggacgtgtacactgacaccatgatcatggcactgtgcgggaacttgtttacagccggaacggagacgacgtcgtccacgatagaatgggccatgtcgctgctgctgaacca

SEQ ID NO: 43688 - DNA, 405 bp, Zea mays
  Clone ID: LIB3066-052-Q1-K1-C1
cggacgcgtggggaggaaggtgggagagaggaaggagcagaggagagagggaaaagagggagcaggcggcggctgagaggatggcaggggcggcggccacagggaaaatggcggctagggttaggatgttgggcctaatggcgtcattaaacttgtggacatacccgtttcatcattgttgtccttaaacaactccaaaagtgctgctgccttttcctccccctcctcgcgtcgagtggctccacgcttccacttggttccgaagcactttctgcaatctcctcccatttctggtgtgcttcagctatgcagttcagcagcgtgcttaccctagacggaaaagcgtgtatgagcccagtgaagaaaagcagtggaggttatgggaatgagaggatgaggatcaac

SEQ ID NO: 43689 - DNA, 183 bp, Zea mays
  unsure at all n locations
  Clone ID: LIB3066-052-Q1-K1-A3
ggaagnnctgctggtattccacgaagaccatcctacaagctccatcantgaagtgcgacagtggatattaggaaaggatctgtatggcaacatcgtcctctccggtggtaccactatgttccctggcattgctgacaagatgagcaaggaaatcaccgccctggctcctagcaacatgaaaat

SEQ ID NO: 43690 - DNA, 404 bp, Zea mays
  Clone ID: LIB3066-049-Q1-K1-C2
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatg

SEQ ID NO: 43691 - DNA, 405 bp, Zea mays
  Clone ID: LIB3066-049-Q1-K1-C3
cggacgcgtgggttcactggagatgactgttgtgagtatcatgtggtcgctagtgcaggtgcatgtgctggtggtggtggcactagcatttctggtaggcggtgcctggtgtggtcctcccaaggttcccccgggtaagaacatcacgggcaaatatggaagtgattggctagatgccaaggcgacatggtatggcaagccgacaggtgctggccccgacgacaatggtggcgggtgccggtacaaggacgtgaataaggcccctttcaacagcatgggcgcgtgtggcaacgtctccatcttcaaagacggtctatgatgtggatcctgattggagatcaagtgcgacaagccatcatagtgctctggcaagcacgtggtggtgtacattacggacatgaacta

SEQ ID NO: 43692 - DNA, 257 bp, Zea mays
  Clone ID: LIB3066-049-Q1-K1-C4
ccgacgcattcgttcattccaaatgattgacaatagatgcatcgggaatctactgagggggcttgtacagattgctgccgcgattaacgtcatgcacccgtggcccatgatcctgtgcggccaccatgccgtgctcccgatcactccttgccacggacactgatggctcaaattacgctcagtcaccataaggatgataccttactccttttactgtccctgtcatttcctccactgttgagacccggcaagggcaa

SEQ ID NO: 43693 - DNA, 400 bp, Zea mays
  Clone ID: LIB3066-049-Q1-K1-C5
cttacgcagcaaatggtatgtctggtgtgctcgagctttcagaggcatcgattgaggcatctggtgcaaaagctgctgcatgtggaactctttcggttctttcctcaatgtcaaataaagtttacaatgaccaaggaactccaccagcattcacagttcctgcaggtgctgagattccttctggatccattgaggacgccttgaagaaaagtggatcaatcacatcctacactaatcttgtagagaggatcgaaacagctcatattgaaaatggtgaacttgatagcctatcctcgaagctacaagcaactgtttcactactttctccatcggaagaaatcattgaatctttgaagaaaacatttgatcagaatgttcgactaattgtgagatctactgc

SEQ ID NO: 43694 - DNA, 400 bp, Zea mays
  Clone ID: LIB3066-049-Q1-K1-C6
agcgagtggtagagcccgcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacacggctggcgcagattccgggcagtcacgggaaggatgatgctggactcctctgactgtgcctctgctgccgtcgacgcggagacggggcaggtgcagccgcagcgccgcgcggtgggggccgtgcccctggcgcacgacggcggctacgccagcggcggatgggagagagaagatggcgaactgagttgtggatactcaagttttagaggcaagagagctacgatggaagatttctatgatgta

SEQ ID NO: 43695 - DNA, 401 bp, Zea mays
  Clone ID: LIB3066-049-Q1-K1-C7
gactagttctagatcggcgttcagacgcctttgccaaaaagacgctacgtatcgggtgtattcgcgcagggtcaactgcatcaacaggaagatcacgaagctccagcagactgcggctagggttggcccgagggggctgttcgccgtgaagcagaagatggaaatgtacaagcgcgagaaggcggagctttacgacgtgatcaacaaaggaatgcaggagaacgagaggggcggcaacagcggtgctgggccttcgaatagggctgctgccggtccttcttcccatgaagctgctgccagcagtccttccaacactgccatcccttccgacggtgctgatacatcaaaggacgatgatgccagtccttacagcgttccctcttccaactgtgctggtcctt

SEQ ID NO: 43696 - DNA, 399 bp, Zea mays
  Clone ID: LIB3066-049-Q1-K1-C8
cccacgcgtccgacctcatgtaccccttgtgttgtatataaatggaaatggaggggtacttgagcgcatgaaggacacaagagttgatgttattgggcttgactggacagtggacatggctgatggaaggaagcgccttggtaatggaattagtgtacaagggaatgtggatccagcatttctgttctcaccattaccagtactgactgatgaaattcgtagggttgtgaaagcagctggtacaaaaggtcacatacttaacttgggccacggtgtacttcagaaaacacccgaagaagctgtagcacatttctttgatgtcacaaggagcttgagatatgacacccatttccaaggttctgttgctgaaggattgcagcctgtagcttgattcgtagt

SEQ ID NO: 43697 - DNA, 326 bp, Zea mays
  Clone ID: LIB3066-049-Q1-K1-D1
ccgacgcgtgggcagacgcgcgggcggacgcgtgggcggacgcgtgctccgacgcgggggagcgaggcgcgagaaccgagtagccaccggctgatcaccgtctatcagtatccctcggggcgcgcgcgcgctcgagacatgccaaccgatcgccaggccggcagccatggccaagcacggaaagcgcagccacgacgcgcaggcgacgctaccactccaggacaacgagcggcggcaagtacccggccatgacggataacccgcagctgctgagggccctcattcccaaggagtacgtgaccgcagtgcctgcagctgctgctgac

SEQ ID NO: 43698 - DNA, 404 bp, Zea mays
  Clone ID: LIB3066-049-Q1-K1-D2
cccacgcgtccgctcgttcgttcgttcggcggctgggttttttcaatttcaggtggtgtttgcaacttcggatcggatggatcatttatttgaacatgtttttggtttggtcagagttggatcatcatgaaaacatggaggtgacatatcagtcagacagtcaccaccaagatttgcaacgctttattcgtggatgggtcgtcgtggatgtttgcaaacaaaattccagcatatttctatcttttagtatatccgaatagagtagatggattggatagagcatggcacttgctttctgaatctgaacaccgacttttggaagtgctcttctgctcgatcaggtgggaggagtgaagttggttggactccagaccaagtcgctcgaaattattgatatatcaatt

SEQ ID NO: 43699 - DNA, 400 bp, Zea mays
  Clone ID: LIB3066-049-Q1-K1-D3
cccacgcgtccggaccagcagcagggaacatcgtccatccgagctaagtaattaggtggaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtacgagacgcacgccggcgtggcctacgaccactgcatggcgtcgctgggcgccgacccgcgcagcaaggaggccggcaacaagaacatgcacgggctggcggtgctggccaccaggat

SEQ ID NO: 43700 - DNA, 257 bp, Zea mays
  Clone ID: LIB3066-049-Q1-K1-D4
cccacgcgtccggaccagcaatagggaacatcgtgcgtaccatctaagtcattaggggggaaatgacccgtgccagcggcagtatcaacctacagagtatgacgctggtactactagctgcttcatctgctgataatgggtgctgtcgcgtaagtgggagcgtaattgctgcctgctgctgatattattgccgtcgtcgatgctgacacatcagctgatgatcgataaccgcctcagctgtgatagaccatagtgag

SEQ ID NO: 43701 - DNA, 352 bp, Zea mays
  Clone ID: LIB3066-049-Q1-K1-D5
acctatactgagcatacgcggtcatcaactgacaggacaactgaatagtaccagcggtgagtcaccgtccgcacactgaccgacatccacgagtcagcatgcgactactagtacaggacatcctctcgatgatgctcatgctacgggattagcacaagaccatgacggtggtgcatattgacagtaatcagaagaacgtccatacatgaccctatctgcgccagcactactaccgacgacagagatgacgctaattgagaacacacatgtcggatacacaccaaggctactacagaagacgtagaaagtgctgacatactggtatacattcagtaattgccagctgacgaac

SEQ ID NO: 43702 - DNA, 404 bp, Zea mays
  Clone ID: LIB3066-049-Q1-K1-D6
cccacgcgtccgcgcttcgtcgtcgattcgcatggatccataaaaggcttggctctggcatccgccgtcgcccccatcgcgttgtccctagagaggaagcaaggcacatgaccaccgtctccgggtgggacgacgagtccgtcctcctcaatgtgatggtcattgaggccaccctcgtctatgagtcccatcgcaagaggcgagcctccacctgctccaacgatgacgacaccagatccaacaccaaatacggagatacagttgacagggctcctctcttccacgctgcgaaggtgacttgtgtacttagcaatggtgcaaatcatgcccatccacgagatcttggcctcaacgctgattgagaagatgacgttgcaaatatttcagacttgtagagccctcga

SEQ ID NO: 43703 - DNA, 395 bp, Zea mays
  Clone ID: LIB3066-049-Q1-K1-D7
cccacgcgtccgcggacgcgtgggattgctttctgagctagataggctacggaaagagcatcataatttacgatctcagtttgaatttgagaaaaatacaaacgtcaagcaagttgagcagatgcggacaatggaaatgaacttgataaccatgaccaaacaagctgagaagttacgtgttgatgtggcaaatgctgaaagacgggcacaagcagctgcggctcaagcagcagcacatgcagctggtgcacaggtgacagcttcgcagcctgggacagctcaagctaccacggtttcagcagcagcagccacagactcatatgcaggtgcatataccagctacccccctgcatatcagcagggagcccaggctggggcatatcagcagggtgctc

SEQ ID NO: 43704 - DNA, 402 bp, Zea mays
  Clone ID: LIB3066-049-Q1-K1-D8
ggtagacgctgtgccactttcaagtgctatggacctgggttagagaaaatatggcgcgtcaaacttagatacgctgaagccatatactttcttgggacagattttatcaacagagattcatggatcctgtccataccacctactgatgctgaaacattgctatcagtttgaatatatagaatcctcagagatcatcaaagatcatcatctaccactaattaataatgagccaaattaaataagttttgcgtatatattttatccctatctataaattatgcatgtgttgtaaacaagtcgtggatgggcttcatttgttctcgcgattgaaaaataacaaataaacaaagtagaaaagaggatgaaccagaagtcttgttcagcaagaaggaaggaggaatg

SEQ ID NO: 43705 - DNA, 401 bp, Zea mays
  Clone ID: LIB3066-049-Q1-K1-B7
gcgggatcagcgttgctcaacgctctcgtcctccgcgcgccatccccgtcgctctgggcctcgtctaaggtccgcagcgccggcgcctttgtgttctcgaacccaccgcgcttcccatccctgcgttctgagcgccgcgtcgcccttccgcgggcggcggcgggcggtgaccccgaggacgagtgggtgccggagcctgacggtgggtccgctgtcactgggaccgcggtggctgaggcgccggaggcgggagaggtcgcagagctcaaggcgcagctaaaggatgcgctgtacggcacagagcggggcctgcgggcgtccagcgagtcgcgggccaaggtgttggagctcatcacgcagctcgagacgcgcaaccccacgccggcgcctaccgaagcgct

SEQ ID NO: 43706 - DNA, 81 bp, Zea mays
  Clone ID: LIB3066-048-Q1-K1-H5
cccacgcgtccggatcgtaacaatgcaaggttgtgttgtatataactcttgtgtttggaatgccgcccgtaattaatggtc

SEQ ID NO: 43707 - DNA, 386 bp, Zea mays
  Clone ID: LIB3066-048-Q1-K1-H6
gttagatccgtagcgccgccctttttttttttttttattttttttttttttttttgggttgggttttttgttttttgtgttttttttaaataccatcagaagcgccaacaaaatacttgcatttcaagcatttgaggcacatacgtaagtattgcagagaccaagttcttactctgatcttagtttttttgcaagtgcgcaatccctcaccatacaggcaggaaactgggaacgagatgcaactttctcatacaaattgggttgcgatacagaatgcatgacaacacacattatctttgacagcaaactgtagcatccaccagttggtcagatcagatttgtgactgacggagatcactcgggcggaaacaaccacaccgggaaac

SEQ ID NO: 43708 - DNA, 425 bp, Zea mays
  Clone ID: LIB3066-048-Q1-K1-H7
ctcgccctcgttgcggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcgaagaggagcttccgcttcatcgtgttcaagatcaacgagaacgtgcagcaggtggtggtggacaggctaggggagccaggcgagagctacgacgccttcacggcctgcttccccgccaacgagtgccgctacgccgtgttcgattttgacttcgtcactgacgagaactgccagaagagcaagatcttctttatctctggggccccggatacatcgagggtgagaagcaagatgctgtacgcgagc

SEQ ID NO: 43709 - DNA, 423 bp, Zea mays
  unsure at all n locations
  Clone ID: LIB3066-048-Q1-K1-H8
tccggttcctgaccttgaaaataacagcgacggctacaaagataacagcagtaacgacgctacgggctttgaggatgattcgtcaaagaagaccaactgattcgacctttctttaaagatttcgaaagaccaactgattcgacctttatttgaagatttcgatgagagccgcaggttgtctagttcattttttctccttttaacctctgtgctgtgcacgtatcttcgcgggcttgcaccagattgcagtctggtacatctcctttggcgccttcaattgagtccagaatttcacatgatctcctgtatccttctccattacagtccgctcttgccttatccatgtacatgctgctaccagacttggtgtaaataggactatgtgatgaacacgttcanaaaaaaaaaaaagggccggacgtt

SEQ ID NO: 43710 - DNA, 450 bp, Zea mays
  Clone ID: LIB3066-048-Q1-K1-H9
atcgagaggagaaccagcagcctccaataagagccagacagagatactaatatagctgtcggcgtcatcatccgagcgaacaagccaaccgaccccgttcccaaggcaatccgccgtcgacgtaccaccaccaccgcaggagcgagatggagatgaagaggatcctcttcgccgtcctcgtcgtcatcgccgtctcggtcaccgcagtgctggcctccaccgaggccgccgacgctggcgccccaactgtctccgagtcgtaccgcgaggctcccgatggcgctggcgctggcgctgccgatggagccgtcgcctcagagccatccggcagcagcggagcgcccacccttatcgccgtgcccgacgagctccttttctcactgctggcctactaccttcactaagcgtgtgcgtgcgtacgttctcgcgcatggacgaccattgatacgt

SEQ ID NO: 43711 - DNA, 275 bp, Zea mays
  Clone ID: LIB3066-049-Q1-K1-A1
cggacgcgtgggcgggttcgtcacccacggcaaggccatccccacgcacgccgtcggcgggggcatcagcgagctggagggcgtcgtgttcgaggtcgtcatcaccttcgtgctcgtctacaccgagtacgccaccgacgccgacccctagaagggctcgctcggcaccatcgcgcacatcgccatcggcttcatcgtcggcgccaacatactagccgcggggcccttcagcggccgctgcatgaaccccgcccgcttcttctggcccggcgtca

SEQ ID NO: 43712 - DNA, 402 bp, Zea mays
  Clone ID: LIB3066-049-Q1-K1-A2
gccttgcccggtgtgcaccgacgaaaccagcgacagcagcacagagacgaacggcgtgggatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgatatactgcaagactggccttcttgtcgctgagcagggcgttgtcgggcagagcgggcaggctatctccatcatcggtggacctctcgccgcggtggtctcgaccccattccgcttggctaccacgaa

SEQ ID NO: 43713 - DNA, 408 bp, Zea mays
  Clone ID: LIB3066-049-Q1-K1-A3
cgctctctaccgtccgagaccccaagcaccagcgcggcggcgggggcggaggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaagaatgtgctcacaaacttttggggcatgaattttaccactgataaactcagatccctagtgaag

SEQ ID NO: 43714 - DNA, 257 bp, Zea mays
  Clone ID: LIB3066-049-Q1-K1-A4
ccgtcgctacctgtggacagacaaaactatcgagcgggggtcatagaccaacgacgaggtggccttcatggtgaactggatgctagattttcgagctctatgctggctctagtacttaatcaagacgatgctcttcgtcgcaaaagcgcgacgagactacgtgcacggtcaatgcctctgaccctcagtactcggtatactgtcacgtctgatacctgctgaacaactgttgcggctgctgcaagctgaccgagagc

SEQ ID NO: 43715 - DNA, 402 bp, Zea mays
  Clone ID: LIB3066-049-Q1-K1-A5
gacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgatcacggtggcagctgcggttacaaggacgtgaacaagcccctcttcaatagcatgggcgcatgcggtaacatccccatcttcaaggatggtctgggttgtgggtcctgcttcgagatcaagtgcgataagcctgtggagtgctccggcaagcccgtggtggtgcacatcacggacatgaactatgagccta

SEQ ID NO: 43716 - DNA, 322 bp, Zea mays
  Clone ID: LIB3066-049-Q1-K1-A6
cccacgcgtccgcccacgcgtccgctgtcgcgtgggcggacgcgcggtatcattggggggattgctattgaggtgatatctatatcatggtggtatgtaccgttgttcgttgtcatggatcttggctcaattactctgcaaagagcgtagagggacgtcttcactcgcttgctatgaccatgtccacaccgtgagttgccgatccagatactatgctgaacaacatgctcatgtgctacaatcatgtcgagatcatctgctaggactacgacatatactgtaatacttgtctttatggcgctgatcaagtctttgttctgca

SEQ ID NO: 43717 - DNA, 361 bp, Zea mays
  Clone ID: LIB3066-049-Q1-K1-A7
cccacgcgtccgctccaacgcctcctctcgcccgtccccatttgagacaaatccgcgtgcgtccatctagagagagagagagagagagaggaagcttctctgattccgcgggtcggctcgcccggacatgacagagataaagcaatgattcgctccggctagcatcgcatctgatcgatcactctcaatcccctgcagctcccagccacggcaccacgggcgtcgatctctcccgagcatcagcgccgacgcgggcctgggggcagcgtagatctcccaccctgctgacaccattgacgcctagccggccgacccattcaggatcggacacgtacaagaacgaccagaaggcgcgcacctc

SEQ ID NO: 43718 - DNA, 403 bp, Zea mays
  Clone ID: LIB3066-049-Q1-K1-A8
cccacgcgtccgcccacgcgtccgcgaataacacagttgagcgcgacgatgggatccgtcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgtggcaacgtccccatcttcaaggacggcaagggttgcggctcatgctatgaggtgagatgcaaggaaaaacctgagtgctcgggcaatccagtcacggtgtacatcactg

SEQ ID NO: 43719 - DNA, 402 bp, Zea mays
  Clone ID: LIB3066-049-Q1-K1-B2
cggacgcgtgggtggacaccttgttcaacccttatgcgcttagctgtgggcatctggtctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttgaaagctacaatgttcttaccaggtcaattgttgtggctaattacatctgaaggttctctggctaattacatattttagttcctggc

SEQ ID NO: 43720 - DNA, 277 bp, Zea mays
  Clone ID: LIB3066-049-Q1-K1-B3
cccacgcgtacgaaggaaagttacagatgattattaaacgttgcatcatgctggttgtggtcatgaggaaatgctggacaaccttggctctttacttgaacccaactgtacacataacccacacgtccaagctactgaagatatcaccttcctggagaccattgatactgctgaacccctcgcaaggatttcacctagtgactacgcttataagcatggtgaactacacctatgacaggagtttgcaataaccccgttggcgatgaactaccagggc

SEQ ID NO: 43721 - DNA, 302 bp, Zea mays
  Clone ID: LIB3066-049-Q1-K1-B4
ccgacgcgtcctacgacacccggaagttgatttatgagcttggctttatgcataagcgtgggattaccaaatcatgtggtacctctggtttctacatgttgcagactgtaaactgattcccttaagacgtgacactgcacatattgcctagcgtgcgaccagtgataccgggctatccgtatcactgatctacactgcttgctcaacatataggacacggattgctttcctatgacactgctctaggagcgaaatgtcatggataagcaggccatacaatactgagacttacagtcaatgct

SEQ ID NO: 43722 - DNA, 240 bp, Zea mays
  Clone ID: LIB3066-049-Q1-K1-B6
cccacgcgtccgcgacccggaagtcacatagcggctcaggacttgtccatcatgcgggcatatcatctcctgttggaggtgaatctcgtgatcgctgatagtgtatctatagagtaatcttgtctagctaatgcgcctctcagccaaaattgtgctatctatcatgtctatgtgcgtataactgtctatgtatcatgcctcgataacatggacagagagtcctctcctgacagactggac

SEQ ID NO: 43723 - DNA, 266 bp, Zea mays
  Clone ID: LIB3066-048-Q1-K1-H4
aaccctgaaggtggattcgtttgacaccattgacaacgttaaggccaagatccaggacaaggagggcatcccccaaaaccaggacgggctcattttcgctgccaaacagcttgaggacggttgcacgcttgctgactacaacatccagaacgagagcacactccaccttgtgctccgtctcacgggaggcatgcagatatctgtgaaaaccctgaccggcaagactatcaccctagtggtgtagtcctctgacaccattgacaacg

SEQ ID NO: 43724 - DNA, 377 bp, Zea mays
  unsure at all n locations
  Clone ID: LIB3066-048-Q1-K1-G12
gcccagcgtcggagatctccgccgccatggagacgctggccagcgccatgcggcgcgagaaccgccggtccaaggccccgccctcctcctctgcttcctccgccctcgcctcggtcagggtccctctcgtcatggccttcctctcctgcctcgcctggctctacgtctccggccgtttgtggcaggacgcgcagacccgggcgatcctgtccggcctactcgagaagagctctaccagcgtcccgaaggtgctctcggtggaggacangcttaggaacctagggtgcaaggcgattggaaggaaaattgctgaggcggagatggacctgaccaatgccaagagcgaggtgtacctgtgggggacaggactgcagctg

SEQ ID NO: 43725 - DNA, 434 bp, Zea mays
  Clone ID: LIB3066-048-Q1-K1-G2
cccacgcgtccgcccacgcgtccggcagttcctcgtcgtggcggtggaagccgccaagagcgccggcgagattattcgcaagggattctaccagaccaagaacgtcgagcacaagggccaggtggatttggtgacggagacggacaaggcctgcgaggacctcatcttcaaccacctccggaagcacttcccggaccacaagttcatcggggaggaggagtccgcggcgctcggggccaccgctgacctcaccgacgaccccacctggatcgtcgatcccctcgacgggaccactaatttcgtccatggtttcccatttgtatgtgtctccgttggcctcaccattgggaaaattcccactgtcggagtcgtcttcaacctcatcatgaacgagcttttcacggcggttcgtggaaaaagggctttcctgaatg

SEQ ID NO: 43726 - DNA, 400 bp, Zea mays
  Clone ID: LIB3066-048-Q1-K1-G3
acgtgatggagatggtaaactggctaaggctctgtatgcaagacctcttactaatattgtcaaggacgtcgaagccaagatgaaaggtggacaatcaagttaaaagggctgggtctttcatgcaaacaaacttcacaggatggataatgacattgtttagttgaaaatatggtcccgcgcgcagcatacatacagagaagaatatgagttttgttttattcttatcttctttacgattttgctccctgtctgtcacaatcaaaccaattgtcagtcagtatgcatagtcgtacgctatagttctgtatcttcagcttatgtatgaagaatataatatcaattggatttggtatataaatcaaaggaccggccattatttcaacaaggttggtcctatacc

SEQ ID NO: 43727 - DNA, 344 bp, Zea mays
  Clone ID: LIB3066-048-Q1-K1-G4
ttcgacccacgcgtacgcccacgcgttcgcccacgcgtccggtcagtgccggccctaccgatgggtcacacgaacagcgtctgcgataccatcatgatgacaatgtaagcgaccgagaagggcttacactccgctcctaccgatctcgccaaggacactgacgacttccataacgacttcatcttgcagacctcgcacctggactacattaacctgtatgacgactttcaagaagttatcgtccatatatacgcggtccatgtcagtaacgctcaccccatctgtaactaccattgcgtgcaccgcagatgtgatactatctatcgagaacgcagctgacgaag

SEQ ID NO: 43728 - DNA, 449 bp, Zea mays
  Clone ID: LIB3066-048-Q1-K1-G6
ttccacgacgccaacctggtggagatgtaccgcaagatcagcagagccgacgtcaagtacgcgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcaccaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagct

SEQ ID NO: 43729 - DNA, 360 bp, Zea mays
  Clone ID: LIB3066-048-Q1-K1-G7
cccacgcgtccgggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatgtaatcaaacacccaaagttcatcactgataccaaggctgctatcgccg

SEQ ID NO: 43730 - DNA, 451 bp, Zea mays
  Clone ID: LIB3066-048-Q1-K1-G8
gtcgggcgccacgtccgtgttcggcgcggcgcccgtggaggtctccgtgaaggtggccgggatccactggcactacggcagccggtcccacgcccccgagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgtcggggtgggcctcgcgggcgagaacgcgctgccgcggtacgacggcacggcgcacgaccaggtggtcaccacggccgccgagcgcgccgacgaggaccggatggtggccttcacgtacctgcgcatggtgcccgacctcttccactcggacaactggcggcgcttc

SEQ ID NO: 43731 - DNA, 366 bp, Zea mays
  Clone ID: LIB3066-048-Q1-K1-G9
cacgaggacaaccacggccgactggctatgaacgtgcttctgatccagatcgtcagcggcggcatagacaacgcggtcatccacgtgcctgaacaagggcaccgccgacttcacgaacctgacggacgcgaccgaggctctgcaagactgcgcgatgcacctgcatgacagcctcaagctggacttactactgcccatctgcatggccttcttactgaagtcttaacgcgcttgtaccacaactgccagcgctacaccagacaactactactgctctgccaggcggtgtccgactccgccgagaaaatgcgtaggctgccttacactgccatgaacagcactgctgcagtcaacaataactcccac

SEQ ID NO: 43732 - DNA, 332 bp, Zea mays
  Clone ID: LIB3066-048-Q1-K1-H1
ctttgcgccatggatgccaacgaggaaaccccgttgtgtgccctgcccttcttgggcctcttattggcctcttcaacgccggcggggtcacctgccaagaacaaaacctcttgaaaggccaacaacaacaacctaatctgctggcccgagaactgcgtggcaacctgccggaatcaacggccacgcggacggccgctgcagctgggcatggtcgtggaggccgtattgccagtgcttgctggcggactgccaatagacgcgaaaggctgcgttgctttggcgtctggcttgctcgccgtcgccggcagacgaaggataaacgtacggtttgc

SEQ ID NO: 43733 - DNA, 428 bp, Zea mays
  Clone ID: LIB3066-048-Q1-K1-H10
acgcctggcctgggctggccgcctccgaccaccgtacgtactccaccgcgtcgccggcgggcggtctctgcccagcccgggctgcctgcgagggcttctgatggccctcgacgccgtcctttactactagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgtcgtcaccgttcagctccaacacggtgcaccaccccgtctacgtgcccaccacacctaggttgtgcttatcgtgctcgtcgttcggccacatggtgaccccgcccaccgacacaccgccgatcacgctcaccaagaagcaggacgacaagccg

SEQ ID NO: 43734 - DNA, 97 bp, Zea mays
  Clone ID: LIB3066-048-Q1-K1-H11
gtgactatgattctctgtctgtcacgtactgttcgatgtagattatcgctggcattgacctgtatatatgacaagtgcaagcgaacgccgaacgtat

SEQ ID NO: 43735 - DNA, 458 bp, Zea mays
  unsure at all n locations
  Clone ID: LIB3066-048-Q1-K1-H12
cccacgcgtccgcccacgcgtccgcccacgcgtccgcaaggagatgcagctgatgaagctggaggaggagcgtcggctggaggaggccaggcacgccgaggagactgctctggcactggccgagatggagaaggccaagtgccgcgcggccatggaggcagccgaggcggcgcagaggctggccgacctggaggcgcagcggcgccgcaacgccgaggtgcgcgcgcgccgggaggccgacgagaaggtgcgcgcgctggatgccatctncaaccacgacttccggtaccgcaagtaccacatcgacgagatcgagatggncacggagcgcttctccgacgagctcaagaatcgcgagggcggctacggccccgtctaccgcgcctccctggaccacacncccgtcgccatcaaggtgctccggcccgacgcgcaccaggggaggaaagcagtccagc

SEQ ID NO: 43736 - DNA, 444 bp, Zea mays
  Clone ID: LIB3066-048-Q1-K1-H2
gtacgcttacgcatgatgtcatcgcagccattggtgatcttatggatgagattgactcatgctatgacccgatttctgagcaagctgtggaacttattcaccaaaatgaggtaatcctaactctaggtcgttctagaaccgtcaaggagttcctgtatgccgcgaaagaaaagaaacgatcttttcgtgtatttgttgctgaaggtgctccaagatatcagggccatgttctcgcaaaagagctggttgagaaaggtgtacaaactacagttataacagattcagcagtttttgctatgatatctcgagttaacatggtcatcgttggagcgcatgctatcatggcaaatggtggagtcattgcaccagtagggatgaacatggttgcacttgctgctcaaggcatgctgtgccttttggtgtggttgcttgtagtcacaagct

SEQ ID NO: 43737 - DNA, 371 bp, Zea mays
  unsure at all n locations
  Clone ID: LIB3066-048-Q1-K1-H3
cccacgcgtnccgcgtctaactcacccggccttcacgcctccctcaccaaataaggtcccggccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacccgatcgagc

SEQ ID NO: 43738 - DNA, 294 bp, Zea mays
  Clone ID: LIB3066-048-Q1-K1-G1
cgaatctgccatcctgtccaacacgaagatggcgttcatcagcaatgtcgcagtgaaggcggcgggcgaggccgcgctgctgctggtcgcatcggtggtcgcctgccgcgcgcggaggcggtggcggtggccgtaggggcgccgtcggtgccggcggatccgctggacatcgcgcagctgggcgccaagggcgacggcaagtcggacagcaccacgatgatcctcaaggcgtggaagaacgcgtgcgatgcgacggagcgacagaagatcgtcattgcgacgggcaactacctg

SEQ ID NO: 43739 - DNA, 202 bp, Zea mays
  Clone ID: LIB3066-048-Q1-K1-E3
cggacgcgtggggcatatctatctggctgtgtcctgcaagcaggcctagtacgccgcctgcggcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 43740 - DNA, 450 bp, Zea mays
  Clone ID: LIB3066-048-Q1-K1-E5
cccacgcgtccgctccgtcccccaagcaaataaaagaagctagctagctaggcgtagaacgagatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgctggcccggagccccgacccggggtgcgcggagatcgaggagttccgcgaccgc

SEQ ID NO: 43741 - DNA, 438 bp, Zea mays
  Clone ID: LIB3066-048-Q1-K1-E6
acgggagcagcatcaggacgccgccgaggaggtgtaccacgtggacgatgtcgacgagggcaggggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgccttctcggaggaggaggaggagcggctcctggcggcgcaccgcgcgtacggcaacaagtgggctctcatcgcgcgcctcttcccgggccgcaccgacaacgccgtcaagaaccactggcacgttctcatggcgcgcaggcagcgggagcactcgggcgcgct

SEQ ID NO: 43742 - DNA, 426 bp, Zea mays
  Clone ID: LIB3066-048-Q1-K1-E7
cggacgcgtggggtcgaggacccgacgcttaagcggtcggcgggggcactcttcagcagggtgtggggtcctcacggccgagagatggtccgagagaggtccgaccgggcaatagatcagatggcgcatgacgaagaggttgaggaccttggcgatctagacggcacgctgcccgacagcatgctgcccgaggcctcgggggtggagttggcgccgccgtccgatgcgggcaagggccccttagcgacccccgcaccgactggagctagcgaggaccccgcgccagcccctgcgccgacgggtgaggacgcctcataggcggtgggcgaaccagctgccgaagaccccgcggcgacggctcgggccttcgcaggttccgacgtttgggcctgcccaagcaaccgctggtgacaatactgattttgt

SEQ ID NO: 43743 - DNA, 383 bp, Zea mays
  unsure at all n locations
  Clone ID: LIB3066-048-Q1-K1-E9
gtcgaggacctcaagcacgcgctcgctctctctcctgctgcaagcacacaatcgaggcccaggttatcactagtaagagctgcgggtgccgtagcccaagccgtgccatactgtactgagtcaccactgcagagcgcgcgaagccaacgagcgtaccggtgacggtatcaagtatcgccagacctgattcattctgcaagacttcgtcaccgactacaactactgaaatatgatacaacgcataacggtacgtactgcagatggacaatggatgttatctaattactcacttattcgttcaacggcgnccttgactatgccgatgatatatggatgtgatgcgaacgtgaacctaccgatatgagcggctggattacatatgc

SEQ ID NO: 43744 - DNA, 337 bp, Zea mays
  Clone ID: LIB3066-048-Q1-K1-F1
cgctcgggcaccagtttgaaccgcttcccttcccttcgattccggggttcctccttacccgattgcccccgaaggaccgggccggcggcggcaaaggcaaaggcaaaggcaaaatgttcggccccccgccgaaaaaaagcgacaccaccaagtactatgagatcctcggggtgcccaagtcggcgtcccaagacgacctcaggaaggcctaccgcaaggccgctatcaagaaccaccccgacaagggcggtgaccccgagaagttcaaggagctcgcacaagcctatgaggttttgagtgatccagagaaacgtgagatttatgatcagtatggtga

SEQ ID NO: 43745 - DNA, 455 bp, Zea mays
  Clone ID: LIB3066-048-Q1-K1-F10
gcctttgaaagaagctagcatcaggttcgacgtacaaggggcacaaataatctaccagtgcgtgtgctcatccgtgcacgccggcaatggtgtcctccgcccgtgcgctcatcggcctcctcgtcgccgcggcctccctcgccgtcgcgctctcggatggcggcgggatggcggcgcctgtgtacgggtacgcggcggggagccccaacgggccggagaactgggggaagctgagccccgcgtacaagctgtgcggtgaggggaagcagcagtccccgatcgacatcgtcaccaagcatgccgttcgcgtcgccagcctcgacaccctcaatcgcacctacggcgccaccaacgccacgctcatcaacgatggccacgacatcacactggcgctggagggcaaggttgggacggtgacggtgaacggcaaggcgtacagcttcgagaagctgcac

SEQ ID NO: 43746 - DNA, 443 bp, Zea mays
  Clone ID: LIB3066-048-Q1-K1-F11
cccactcaaacaagctcgcatcaacttcgacgtacactgagcacaaataatctacgggtgcgtgtgctcatccgtgcacgccggcaatggtgtcctccgcccgtgcgctcatcgatctcctcgtcgccgctgcctccctcgccgtcgcgctctcagatagcctcggcatggacgcgattgagtacagctactcgtcggacacccccaacgtaccggagaactcaatgaagctgagccccgcgtacaagctgaacgtagaggtgaagcagcagccctcgatcgacatcatcaccaagcactccatcaccgtcgccagcctagacaccctcaatcgcacctacgacgccaccaacaccaccctcatcgacgattgccacgacatcacgctggcgctggagggcaaggtctggacccagacgctgaacggcaaggcgtacagcttc

SEQ ID NO: 43747 - DNA, 446 bp, Zea mays
  Clone ID: LIB3066-048-Q1-K1-F12
cgatgccatggtcaaatcggagatgggcttgattgagcagagtaaacttgtgctgacggagcaagagccagagctgggagacgttccggtgaagagacccgttgggaggcccaggaaggctaggaacggacctagctcagatgacccgggcacccctgcttcgtatgcttgagctccgtttggcttggattccggcgccttttccagtttcctgtgacttctgtacagtgcaagccatcttaacgccgccaaggttaacttatcgaaacatttggagaacctggaagcaaacggcgaagtttttccgtgtgcgttaatgtttcacagaaggggagtccgaggaaaaaaaagttgccactacgcagcttatggactggttttttttgtaggatgtattgacatcattgtaccaaattaggttcatataatcctggttgatagatttt

SEQ ID NO: 43748 - DNA, 402 bp, Zea mays
  Clone ID: LIB3066-048-Q1-K1-F2
aaccggaccaagcttctaatggaggtaatcctaacttgcatgggaaggacctgtgaaaatcgatggccaggtccaaggaccaggaccatgccctttttgtggactgagaactggacagcacagtccagagtattcggtgacccaccatcccagcgttctgctgaggacattgcatttgccgtggcgcgcttcttctccgtgggcggtactatgacaaactactacatgtaccatggtggaacaaactttggaaggacatctgctgcctttgtgatgccaaaatactacgacgaggcacctctcgatgaattcggtctgtacaaggagcctaagtggggccatctgagggacctgcacctggcgctgaagctgtgcaagaaagccctgctcttggggaagaca

SEQ ID NO: 43749 - DNA, 340 bp, Zea mays
  unsure at all n locations
  Clone ID: LIB3066-048-Q1-K1-F3
accacgccgtccgggtaggtgcatggcttcggtgggtccaccatggcgcaccgagcggtggcgacgatgacgactaataagccccttctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacggaggcaaggagcccctggacaagaagctgtcggaggcggataagatgaatgtcacgtacgtggtggaccccagcggcaagggcgactacgccaacatnaccgcagcgctggaggata

SEQ ID NO: 43750 - DNA, 360 bp, Zea mays
  Clone ID: LIB3066-048-Q1-K1-F4
taataatttcgcctttttggaaggatacattggccgatccagcaccaaggttaccactttgaaagtaaccctaaaatcggattcacagccaatggtataaaatgaaactgtctcagatcctatatctagggtcagagaacctgagaccgaaatttctcaagatgggaggatacccaagattgccatggacagtgccgattcagacctgaataacagaaatgatgaagcaagtgaacagcttgtagcagatcttaaagctcagaaagaggaactagaagcaacaattaacagggaacagctgcaaactgtgcaacttatagaagacattgctcaagcagagaccagaaatgcagagctgac

SEQ ID NO: 43751 - DNA, 304 bp, Zea mays
  Clone ID: LIB3066-048-Q1-K1-F5
gcgcatgggcgtctccaagtccacctccaagtgcgccaccgcgcatccagggcatcggctgtccttcggcggcatgatcttcgccctcgtctactgcaccgacggcatctccggcgggcacatcaacccggcggtgaccttcgggctgttcctggcgaggaagttgtccctcaccagggcggagttttacatcatcatgcagtgcctgggcgccatctgcagcgcgggcgtcgtcaaggggttccagcaggggctgtacatggtcaacggcggcggcaccaacgtcgtcacgcacggctacacc

SEQ ID NO: 43752 - DNA, 397 bp, Zea mays
  Clone ID: LIB3066-048-Q1-K1-F6
agtgcttgcaccacttattcctggactttacataccaactcggttctttaggatgcttctgaacaaattagcaagggatttccacaattatccagctttgggtggacttgtccagacccttatgggctatgtcgttggcggtgacagttcaaattgggtaggagtgctcggtttgccccactacaacatggatgacatgcctggtgtgtcatttcatgttgcgcttcaccttgtccagataaagatggcaaagaagttccaaatgtatgactacagtagctctgcagcaaatattgaagcgtacggaacaccggaaccattggacttgggagctcattatggtctcatcgacatttctgacgacttagtcgctgggcacaacttcagtattatctta

SEQ ID NO: 43753 - DNA, 439 bp, Zea mays
  Clone ID: LIB3066-048-Q1-K1-F8
ggcgatgtcaatactggtttgacagaaagctatatccaggaaaacttgaggtccagtttggatgttccaggagcagctagcatgtctgatcagttttctgagctttctttggagaatgatgcttgcataatatgccaggaggagtataaagctaaagaacttataggaacccttgaatgcggtcacaagtaccatgtgaactgcatacagcaatggttgatgatgaaaaacctgtgccccatatgcaagacgacagctttgtcatcagatagaaggaacggatgaccgtcgccaataatgttgctggctgtttaccgcgtggcatattaccgtggattttgtatatagacatggttgcctctatttgcccgtcccctttgctgtggacataaactgagcttcgaaacactgtacagatattctgtaggatgctttagac

SEQ ID NO: 43754 - DNA, 350 bp, Zea mays
  Clone ID: LIB3066-048-Q1-K1-F9
cagagacaatgtggctgctccagactgtcttctcttgatcagcttgcatttgcagagagccgcgtcagcatgacatcatccacatccgatcaccatatgcaatcttccccctctattgcttgccaatacgtgtagaaccagacgatttctcactcgtaccgtctgatcgatgacttaatctactgtaacgacgacttcgcacaacatgtagatccgtggctgtctaaatgcgtctgaggcctctctactactagtgttgttgctaattgcaaactcatccagtgctcttggttctacgcttgaacttgcgtagtgtccggatcgacaggcacgtcctcgatctaactaca

SEQ ID NO: 43755 - DNA, 447 bp, Zea mays
  unsure at all n locations
  Clone ID: LIB3066-048-Q1-K1-E2
gcagcgccggccatgatcgagacaggatgacgtccccgccgacgccgttgccggcgctggcgcgccaggccatgcagtcgccgacgccgccgacaaaggtgggaccaccgtcgctgccaccgccgccgctgccggccgtggacgcggccgtcatcatgggcgtgctcacggccgtgctgctggcgctcttcctcttcctcatctacgccaagcactgcaagcagcgcggccccggcgagcggcccggcggcctgagactcggcttcgcgccctcctcgtgcgaccgctgccgctcggggctcagcagctccgcggtgggcgcgcttccggcggtccggttcggcgacggtgacgtcgacgtgggccgagccaccgagtgcgcggtgtgcctgggcgccttcgacgccgncgagctgctccgcgtcctgcccgcctgtcgccacgcct

SEQ ID NO: 43756 - DNA, 416 bp, Zea mays
  Clone ID: LIB3066-048-Q1-K1-D1
cttacgctatcctcctcgatcttaattacaggtcatagctaagcaggtctgacaggatgtggcggcagacatacgtggatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttactcggccccaccaagtacatggtcatccaaggcgagcccggcgctgtcatccgcgggaagaagggatctggaggcataactgtgaagaagacacggcatgcgatggtggtcggcatctacgacgagcccatgacccacggccagtgcaacatggtggtcgag

SEQ ID NO: 43757 - DNA, 458 bp, Zea mays
  Clone ID: LIB3066-048-Q1-K1-D10
gccaacggcactgtcggaggagacgccacgactgttcctcaggatgcttcgccgcagcctgggtgccaggtggtcgagcctgcacttaatccaaaggaggaagttctgaacggggaggtttgtaactcgctaagtgatgtggagaagcctgttgctgaggaaacgccggatcctgatgtcataaatgaactgccaaataatgttgcagtggctccaccaatttcatcccctcctgtaccattgaaggaggcaccaaagaagtcatatgcttcaattgtaaaagtcatgaaagaacatcggccattagcacctgcagttccttccagacctgcacccccaataacagagaagcaagcctctcctgccctcactccagttactgaggctccagctttctcctctaatcctcagagcggctgctttcaagatccagacgttgatgcacatgccatatatgt

SEQ ID NO: 43758 - DNA, 446 bp, Zea mays
  Clone ID: LIB3066-048-Q1-K1-D11
cggacgcgtgggctgcatcccggttatgggcggcgtgcttgagcttggcacaactgacacggtgccggaggccccggacttggtcagccgagcaaccgcggctttctgggagccgcagtgcccgacgtactcggaagagccgagctccagcccgtcagaagcaaacgagaccggcgaggccgcagcagacgacggcacgtttgcgttcgaggaactcgaccacaataatggcatggacatagaggcgatgaccgccgccgggggacacgggcaggaggaggagctaagagaagccgaggccctgccagacgatgcaagcctggagcacatcaccaacgagatcgaggagttctacagcctctgcgaggaattggacctgcaggcgctaccgctaccactagaggacggctggaccgtggacgcgtccaatttcgaggtcccctgtt

SEQ ID NO: 43759 - DNA, 437 bp, Zea mays
  Clone ID: LIB3066-048-Q1-K1-D12
cccacgcgtccgccgaccaggagatcgccagctgcgtcgagtccgtcctccgagggtccgggggcgggcccggggaggtctcgctcaccgccgtgctgcagcaggcggaggccacgctcggcgtcgacctctcccacaaggcgggctttatccgcgaccagatggacctcttcttcggcccgcgcctccagccgcagccgctgaccacgccacagctggcgcctcccccgcctcaggccgtcgttgcccccgcggacgccgtgcctcagcctcagcctcagcatcaggttctgccgcaggcaccgccttcggctcagcagatgcagccgcagcagctcgcgccgcttcagccgcagctcatgttccagaccattcaccagctccccgccatctctcccgtccctgtggtctccgcgccgccggccatggcgttctac

SEQ ID NO: 43760 - DNA, 320 bp, Zea mays
  unsure at all n locations
  Clone ID: LIB3066-048-Q1-K1-D2
nccacgcgtncgctcacgcgttcgncgccctggctagcaccacacaccgcaggtatggagaaggggcnaggctggccttggcagcggcggtggttctgtgcctgctgatggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcaagcccgctgacccggtgccgcagcggctgatcatatctncggtgggtctggtcgatgtg

SEQ ID NO: 43761 - DNA, 329 bp, Zea mays
  Clone ID: LIB3066-048-Q1-K1-D4
accgtcacgccgtccgccaagccttccgccaacccttctgccaatccttccggaaaaaggtggttgctgttttaaccgaacaatcagtagatccatctgaagggtcctaaaggaattgcttccgaagaagatccggataagcctggcacactctctgatccgtttcaagccaatttaggcattataggtaaatcaatggatggagactcattgcattcatttgatatctctagtgaggcacatgaagacgaggcatgtggcacctcatggtggcgacaagtagttttggatgggttagagggtaaggataaaatccctctaaaagatta

SEQ ID NO: 43762 - DNA, 271 bp, Zea mays
  Clone ID: LIB3066-048-Q1-K1-D5
ctcacacatccgaactcacctacttttactttttcagctggtcacaaaactacggggcatgttaaatacgaactgcatcaactacatcctcatatacttcctctcacgctacctaccgtctcattttctacctagacaaccttcttccatctcatataacctcatatccaaagctaataatacatcatataaccaacatgattaacgaccttcaccaaccccatcacctttcactcacccaacctttactccaacataacccatacatatc

SEQ ID NO: 43763 - DNA, 418 bp, Zea mays
  Clone ID: LIB3066-048-Q1-K1-D6
cggacgcgtgggcgggattgagcaggagtacacccttctccagaaggacaccaagtggcgtctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggcagtgggagttccaggtcggccctgccgtcggcgtctcggccggcgaccagctctgggtggctcgctacattcttgagaggatcaccgagatcgccggcgtggttgtctccttcgaccccaagccaattccgggggactggaatggcgctggtgcacacaccaactacagcaccaagtcgatgaggagtgacggc

SEQ ID NO: 43764 - DNA, 450 bp, Zea mays
  unsure at all n locations
  Clone ID: LIB3066-048-Q1-K1-D7
cccacgcgtccgcatttttctcttctgctcagcgccccggcatccaatcccccctgccgtgggccgtgctctctccggtatcccaccatggatatgccaaatgacacttgcccttcaccaaaactccacacaagactgaggctgtgggaatttgcggactgttatgtttttgaaccagttggtcttaatgatcttttactgtcagtcaaccggatcaatggatcaatgaatctagtggaggaattgccacagcatggcccctctataaatccaaaagttcaaatagtgtttggtgtaataggagtgctaaaacttgcagttgggacatatattctggtgatcactgaccgtgattgtgctggatcctacttgggacatgcagttntcaaagtgagaggtctgagagctctgccgtgtaataattccctttctgcttctgctgaacagaaa

SEQ ID NO: 43765 - DNA, 329 bp, Zea mays
  unsure at all n locations
  Clone ID: LIB3066-048-Q1-K1-D8
cccacgcgtccggcgcccgacaagcccaaccccaacgagctcaccggcgccatcgtcggcgggcccgacaagaacgacggcttcgtggacaagcgcggcaactcctcctacaccgagccctgcacctacatcaactccctcgccatcggcccgctcgccgcgctcgccgtccgaggcgtgcagctcgtcgccacgcagtgatctatccccatggccatgcgtgtgtgtcccgctgtttcgtttcttccctgacatgacatgatttctactccgttactgatgattcattgattccggccgnccccgcattggtcattatattaggtcga

SEQ ID NO: 43766 - DNA, 460 bp, Zea mays
  Clone ID: LIB3066-048-Q1-K1-D9
gcctactcgcttcaagcaacacccgaagcggtaacagcaaccaccaccaccaccggacctggcgtacgaccccttggcttgccactccactgaagcagggcgagagggagagagaggaaggaggaggagaagccatggcgaacgacggcgacgggaagggccgcgtctcgacggcgccaggggcagggtacgggtacgcggcgtacggaggctaccagggggcggaggagcggaagtggtggccgcggctcgtgcccaccgtcatcgtcgtctgcatcgccgtgttcgtcgtcgagatgtacgataacaactgccccaagcacgggagcccgctcggcggctgcgtcgccggcttcctccgccgcttctccttccagccgctccgcgagaacccgctgctcggcccgtcctcctccactttggagaaaatgggagctcttgactggaataaaattgtcca

SEQ ID NO: 43767 - DNA, 412 bp, Zea mays
  Clone ID: LIB3066-048-Q1-K1-E1
cgtccttcggtaggtgcattgcttcggtggtccaccatggcgcatcgagcggtggccacgatgacgactaataagccccttctactcctcgccctggcgtccgcgctccttggtgcggcgccggccgccgcgaacgcgcccggcggtgcgttcagcaactgggtggcgatgaaccagcagagctacgcgctgtacgcgcagaagtccgtcggggaccgtggcaaggagcccctgtacaagaagctgtctgaggcggagaagaagaaggtcacgtacgtggtggaccctagcggcaagggcgactacaccaacatcaccggagcgctggaggatatcccggtgagcaacaccaagcgcgtgatcctggacctcaagcccggcgctcagttccgcgagaaagctgtcctgaaca

SEQ ID NO: 43768 - DNA, 371 bp, Zea mays
  Clone ID: LIB3066-048-Q1-K1-E10
cccgatcatcctcatcctctgctcctggacagtacagcacagcacaacacatcgaggtagagctagcatccatcaccggatctcagaaccatcatccgcaccagcagcacaccacggtcaaccttccacacacgcgcgcacacacacatggcgtcgcaccataagcaacttcatgctggagcctctgcatctgcgctctccgacgtgggcttcgacgactacctgtcacagatcgtgtagcggctaaccgaatacacgctgatgctcgagctgtctagcgtgttccggctgctgatggacccggcgctctgactcatcaccttcgacagcctccgacgcatcgcaccgctgctcggcctgtgcggcatgtc

SEQ ID NO: 43769 - DNA, 433 bp, Zea mays
  Clone ID: LIB3066-048-Q1-K1-E11
cccacgcgtccggcaggaaaaggagcgaagagagagagagagagagagacgcaggcccgccggcgacgatcgaggagggaggaaccagagacccggcggcggcgacgatggctccgcgcagctcatcggcggcgacgtgcctgtgcctcgctctcgccgcggccacgctggcgctggcccacggtgcgcaaggaggaggaccatcggcatcggcggcggacctggacaaggtcacggccgagaccttcttcgacatcgagatcgacggcaagcctgcaggccggatcgtgctgggactgtttggggacaccgttcctaaaactgcagagaacttccgagcactttgcacaggggagaaaggaattgccaagtccggcaggcctctggggtacaaggggtcgacgttccacaggatcatcccggggttcatgat

SEQ ID NO: 43770 - DNA, 443 bp, Zea mays
  Clone ID: LIB3066-048-Q1-K1-E12
cccacgcgtccgcacaacctcttctcccctgtttcctctcgtgcgttctccgcaggagcgaggagggctcgcggcagcggcagggtctccggtgtttttgttccagaatctgtagcaaatggttgacggcgaggacatccatccccttgtttgtgacaatggaactgtcatggtcaaggctggttctgctggtgacgatgcgccaagggctgttttcccaagcatcgttggacgcccacgtcacactggcgtgatggttgtcatggggcagacggatgcgtatgtcgtcgatgaggctcagtccaacaggggtatcctgactgcgaagtacccgatcgaacatggcattgtcaacaactgagatgatatggccaagatctggcaccacaccatctattacgaactccgcagtgtgcctgaagagcacactgtgctgctgaccg

SEQ ID NO: 43771 - DNA, 456 bp, Zea mays
  Clone ID: LIB3066-048-Q1-K1-C9
caaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctc

SEQ ID NO: 43772 - DNA, 300 bp, Zea mays
  Clone ID: LIB3066-048-Q1-K1-B4
gaccccgtacggtttctcggaaggcaagctttttcttggcggcggccaccttaaccggccgcggttgccgggatgtgccgtaagggtggtcgataccgccacgccttcttggaagccttcccaagggcaggaagcaaatactggacacccatctcctcctagatgttcactcttaagtgctggaagatcttttgctggaactcagaatgtttcaagtctgcagaaggatgaagcatggaaagtgaatgtccgcatccatggttgcaatcttgaccagggttatctatgtggaacgatgga

SEQ ID NO: 43773 - DNA, 446 bp, Zea mays
  Clone ID: LIB3066-048-Q1-K1-B5
caagcattgaagccgtagccgccgtcgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggagctctcgttcggccacaccccggcgtccgtcatggcgacgct

SEQ ID NO: 43774 - DNA, 226 bp, Zea mays
  Clone ID: LIB3066-048-Q1-K1-B6
cccacgcgtccgaaaaaaaaaaaaataaaataaaaaaaaaaaaaaaaaaaaaacaaaaaaaagaaaaaaaaaaccttaaaaaacataaacaaactcaacaccaaaaaaacaacaaaaaaaccacttaaccaacatactaaaacatcctcatgaagtacttcaccgacacctacgacctcttctgcatctccctcatgactaaactcctcagacgcatctactacac

SEQ ID NO: 43775 - DNA, 441 bp, Zea mays
  Clone ID: LIB3066-048-Q1-K1-B7
cccacgcgtccgacccatcgtccgctcgcgtgtcctttgcgctcgcgaactccgtcgccggacacgagccagggacaccgagtgtggtgaggttgccccttcccttcccccacccccatcgtcgtcttggaccagctctgtacgtaccgtccgtcgatcgtcctttcccgtcccctctagcatcgatcgcagcctcctctgctactgccacgtctctgtgcctgccgagacaagcaagggggtcgtcggtcggggctaggttgttcccttaattcattctaggggcagatcagatcgaaagaaatcaaactaacgtagccatggaagaagctccacgtcattccatgtagttacttcttcagagcgcgcggtggcggccggctagaagctttgttcgttgcatttgaattcaccaccaaaggagaaggcgcctgttggcgt

SEQ ID NO: 43776 - DNA, 398 bp, Zea mays
  Clone ID: LIB3066-048-Q1-K1-B8
cccacgcgtccgaggtccttcaaaggccatgatagctcctgcagtagctatcagagttcggtcactatctctgagaggtccttcaatgtctctgacagcatcttctatgtctgtaaaggaagaccaaactttctcacacaggtcacatgatgcaacagaatctgtgccgatgaatctgagcgcacgtcaaatcacactctctgtgtaatccatatgtgctgaatcaacatgctctgaaaatacttctgtgaactatgaaggcatcgctcatacttacagtgtgcttgtgttagtctctggatctaacgtctcatcgtttgacgctcttactcagagttatcacgtttcactttcttttcagatccattactgtcatgtaggaggcttcattacaacct

SEQ ID NO: 43777 - DNA, 387 bp, Zea mays
  Clone ID: LIB3066-048-Q1-K1-B9
gactgcgtgcgtggatcagaaaatggggatccaaacgaaaagcgtgtagtacatggtgctgctcctgtcactgactgtatctgcggaacggaatatgatggaccgactacgcgctcatgcgcttccacctatacatcaccataacaaacgggctgcacgtgctgatcgagctgcctcaactggtactgtacgccatctactacaagaacacccataagatagtgcacgcacgcatgctcaaggcaggccaggtcgtcaagactcaagcggatgcccacggtagcagggactccaacaaccaccgctgtggcagaagcacatactgaggatcataactactacgacgtaatctggatgtgagcacactacacacaacaccaagcaaca

SEQ ID NO: 43778 - DNA, 263 bp, Zea mays
  Clone ID: LIB3066-048-Q1-K1-C1
cctacgcgtacgccaacgcttccgctagcttaactgtgctgtccggaccaacaactcggggcccggttaactgatggccgcgcagagtgtcgtcaggtcgctcatctccatgctcgtcatttactgctgtttcgaccgcttctgcccgtacccgacctacaccgacattacgctgtgcttctatcacatagtgactccaactatgcatctgacacactaccactgtctacgctcaccaacagcgtgcatatgcacattgacct

SEQ ID NO: 43779 - DNA, 460 bp, Zea mays
  Clone ID: LIB3066-048-Q1-K1-C10
acaagggcgagcagcaccgaccgagccgatccgctcctcttattggttcttcttcaatagagcagcatagcaggaaagatctgtgagcgttcttgcagccggcaggggtccaggattacgaaggaaaccaagaacgcaagaaacgtctaagaagaggggaggaaagatttgggtgtagattggtagatatattacacaggttttgttttgctgtaggttattagcaaataaatagctggagaagaagcctggctaaaaaaaggtgaaatttgtggagaacatgtttgggatccaaaccagggatgtggcagaagattgcaactcctggaggaggacattaatgaacacacccaccgtctcaatgcccatgaacaaccacaacattatgtacaacacaggcaagagtttgttcaatgtacacctcatgtctgtcaagtttgaagacctgtatggattcatg

SEQ ID NO: 43780 - DNA, 459 bp, Zea mays
  Clone ID: LIB3066-048-Q1-K1-C11
cggacgcgtgggctcgaaagagccttccgccagcgaggctggtgccgcagaggagccgtcgacggccgaggccggcggcgcatcggccgacagcccgcctgagccgacccacacttcttcggactcgccagcggagtctcctggcccggccgctgaccacgagagcggcagcccgagcatgttgggtggcactggccttgccctggtcatgctggtcgcgaccgtcacgtcctccgccatgctttgtttctaaacgaccacgatcgctctgagtttaatatggtcatgcatgcatggctgtgggagccgatgactacgccttattacgagtctctgaatctctccttagggttttttaggctgttcgagtcatccttttcggtgttacctagcatctatgtatgttgttcgcgtatcgcctcgtaattgttaactacgatgaatgaattgttgcatagc

SEQ ID NO: 43781 - DNA, 452 bp, Zea mays
  Clone ID: LIB3066-048-Q1-K1-C12
cccacgcgtccgggtgccaggccttgccttctcgcggcggtgctccctccctctgcgtccggcagcgacgcacgcaggcgcgcgcgcggacatgaaggggggcggtgccatgaggccgtcggctatgttctacgtccacgaggcggacgtcgtccagatccaccacttcctcgaggagtgctccctctgcgccaaatcgctcttcggcgacatcttcatgtacaggggtgacacgccgttctgcagcgaggagtgcagggagcagcagatcgaggtggacagggcgaagcaccggcggaagaagcgcgcggtggcgcacgcgctgtccgaacgcagcagggagcaccggcaccagcagcagctgcagcagcaccaccaccagcagcagcaaccgcagtcgcggaatgccggcatggacacccgccacccgtgggtcgacgccgggttcgcca

SEQ ID NO: 43782 - DNA, 116 bp, Zea mays
  unsure at all n locations
  Clone ID: LIB3066-048-Q1-K1-C2
ntccggggctccgacgaaagggttggcattcaagttaaggtggtcgaccgaaaccccccggttcaggacgttctggaacaaattcttggctggaatttggaaggacaactggttcc

SEQ ID NO: 43783 - DNA, 446 bp, Zea mays
  unsure at all n locations
  Clone ID: LIB3066-048-Q1-K1-C3
gatgggtcagtgtgtggagacaaaagaaaaacagaaagcatttgacattggccagaaatacgtacgacatgccgtggcctttgaaggtatttctcctgatgtgcctctctataaagtcaatgaagggaatgaaccttgcttcttcaggacatacttctcctgggatagcgcacgatccgtgattcatggaaactcttttgagaagaaactttcagttcttttcggaatgcgttcagagggtggcaataagggctcaggtgatggtgggccaactcaaagggcatcagccttggccgctctttcatctgcattgaatccatcgtcgcaaggaaaacagtcagatgagaagcccacaagctcagatgacagcgagcatactcaacgagcttcagcaatggctgccttgtcctctgnccttaatccatcgacaaaacctagcagcacac

SEQ ID NO: 43784 - DNA, 438 bp, Zea mays
  Clone ID: LIB3066-048-Q1-K1-C5
cggacgcgtgggcgcgatccgacaacgcctccatccctagccgactgctgcaagcttcagggctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattg

SEQ ID NO: 43785 - DNA, 300 bp, Zea mays
  Clone ID: LIB3066-048-Q1-K1-C6
cggacgcgtgggtcaaaaaaaaaaaaaaaatatataaaaaaaaaaaaaaataaaaaataaagagaaaaaaaaaaaaaaaaaaaataaaaaaaaaaaaaaaaaaaataaaaataaaataaataaaaataaaaaaaataaatataataaattttataaaaataaatattacagcaactctattttatattcaccagcttattttctccttttattatacttaatacttttttatatgtttacacactttctaatttgatcaaacttctttaacactcctagctattgacaaaccttgtattt

SEQ ID NO: 43786 - DNA, 450 bp, Zea mays
  unsure at all n locations
  Clone ID: LIB3066-048-Q1-K1-C7
agcgcctcacagaagtttaggcattccatgaagagggggaggaagagcagcaaggtgatggccatctcgattctggatgagcgtgaacctgaggaggtgcaggctgtggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagtggagaaaggagttcggtgcagataccattctcgaggaattcgaattcgaagaagctgataaggtggcagaatgctaccctcaaggttaccatggggttgataaggaaggcaggcctgtctactttgaacggcttggacagatcgatgtgaataggctaatgcangtcactacaatggatcgctttgtcaagaaccatgtcaag

SEQ ID NO: 43787 - DNA, 413 bp, Zea mays
  Clone ID: LIB3066-048-Q1-K1-C8
gatcggacgggcacgggaagaccgcgtcaaaatccaccaccaactcgtcccggcccctgggacggcagaaacggacgcatcgtcgtgctcaccgcagggaatccgcgcgagcttcccccttccctacatccggaggcgcaaaaggcagggcctagtgcttccccatccccagttattttttcttcttcttctttaatttacagcaggaagccaggaactcaacccaagagggggaaaaaaaatcaatccccggagaccggagccctgagcaggtgaagaaatcctagaatctccagcacgtctgccccggtctccattgaccataaccatatgaggaagaaaaaaattgcttttccaggcatggcctgggatttgccgagatctccccttcccggcgtgcccaggcacagcca

SEQ ID NO: 43788 - DNA, 264 bp, Zea mays
  Clone ID: LIB3066-048-Q1-K1-B12
acgaacctgcctgtcacattgttcattttgactttctatgtcactgttacagctccacggaccggtttgtttgtcaagtgcttattgaacacaactaccacatagatacactaagcatccaaagaacagacggattcatcctgccaagacaccagctgctccaatcaccgatgtccctactgccttagcgcccatgacatgttctaatatctatccttaattcttaaagatggtcattaataaccccttctttaaaagctcacc

SEQ ID NO: 43789 - DNA, 385 bp, Zea mays
  Clone ID: LIB3066-042-Q1-K1-B1
tgctcggcgtgctgcaacggcttccgatttgcccggctagatgaaagacggctggggagcgtcttctctggggaacaccgcgcgtcatgggtgccttgccgaagttcagggacggcgtgattgctcatcgtcgttcatgctccaccgtggcgccacccatctccgtgggcagtgggctgcatcgtccaatcgaccgcgcgaggacacgtgtcatctgaaaagcaagttggtacctgaaatctcaagtgccaggtcaagatcaggtactgcaggatgaggcgcatggtggatgctgtgatgagttcgtgagtggtctaggccgtcgtctcccagtcaactttggtttgctggaccgttgtctccttataatgtaattatttatttt

SEQ ID NO: 43790 - DNA, 440 bp, Zea mays
  Clone ID: LIB3066-042-Q1-K1-B10
cccacgcgtccggcaatcttcttttgaatgcaaggcttcaagtcacggtgaagaacatttgctgaatgtatatacttcaagccacgaagaatttgataaagaaaatactgacagtgctcctctgacaaagcttgatttgaacgaataatttgatgcagatcagtatccatcaattcatatgcaatatacacatcattgaatgcagccctctgcgcaggaggtatgatatcccttattgcatatgaattgatggatactgacagtgctcctctgacaaagcttgatttgaacgaataatttgatgcagatcagtatccatcaattcatatgcaatatacacatcattgaatgcaagcctctgcgcaggaggtatgatatcccttattgcaacaatattctcgtggtccatgtggcggagcaacttgatctcgccgaacgtg

SEQ ID NO: 43791 - DNA, 337 bp, Zea mays
  Clone ID: LIB3066-042-Q1-K1-B11
tgcaagggagctcattggcatgctttagattatcgatggtgacaattatccagaggccctgggccgcatgtacatcatcaatgcaggccacggataccggcttctatgggacagcgtctagagcaaccttgacccaaagaccactgcaaagattcatgttctgggtaacaagtatcatagcaagcttctcgaggtgattgatgctagtgagttgccagaaattttaggtggaacctgccaatgtgaatgtgggtgcatgaaggttttcaaaggcctttgcaatgaccccgaaatcatgacgatggagcacagtggagatgggaggtgttgatcactc

SEQ ID NO: 43792 - DNA, 365 bp, Zea mays
  Clone ID: LIB3066-042-Q1-K1-B2
cggacgcgtgggcggacgcgtgggcggacgcgtgggcggacgcgtgggcggacgcgtgggcggacgcggggcggaagaggggatttcgagccgcggcgatcggggctagagtggccctcgacgcgtccgcgggtggaattgccgagaagccgagagagaggggttggagcggagttgcgggaggtgggagagaaggcggcgatggggcgcctgttcctgatgcacctggacggcaacgtctacagctgcaagcactgtaagacccacctcggcgttggcagcgacatcatctccaaggccttccagtgcatgcacggcaagggcgtacctctttcataaaggtgtcaacgtgacttctggagtaa

SEQ ID NO: 43793 - DNA, 392 bp, Zea mays
  unsure at all n locations
  Clone ID: LIB3066-042-Q1-K1-B3
cccacgcgtccgcaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctnctctatcgacagcatcgtgaacggcagcgacgccgtcatggagccggttgttgctggcagcaacacggtagtagctgttgcccaagtcgaggttgcaacaatgaacgtgcaacaacccgc

SEQ ID NO: 43794 - DNA, 338 bp, Zea mays
  Clone ID: LIB3066-042-Q1-K1-B4
ggaattgatgcggagcttcgactggacacggggaagctatcccgaccgccaatttgatgaacggccagtcggaactcgggcaatggctcaccggaggagtggcgtccgtcgcgggccgcgttccatcgtgggcgttcgtctccgtgcccgaatccgtggtcaagaacatgtaccacatgatgagacgcatggaagatgttgcgatgtgttcgtgagaggtctaggccgtcgtctcccagtcaacttcgggttgctggatcgttgtctcctttcaatgtaattatttatttatcttgttcaaaactcctattgcataataaagttgtgacattcgtttt

SEQ ID NO: 43795 - DNA, 478 bp, Zea mays
  Clone ID: LIB3066-042-Q1-K1-B5
gcgcgttccagtgccgaagtcatcaccctcaccgaagagaccttctccgacaagataaaggagaaggacacggtgtggtttgtgcagttctgcgtcccctggtgtaaacactgcaagaaccttggaacactatgggaggacctgggaaaggttatggaaggtgcggatgaaattgagattgggcaagttgactgtggtgtcagcaaaccagtatgctcaaaggtcgatatacactcctacccaacattcaaggtgttttatgaaggcgaagaagtagtaaaatataaaggacctaggaatgtggaatcgctgaagaacttcgtgttgaatgaagctgaaaaagcaagtgaagcaaagcttcaagctgattgaagcatgggagtttcagcaagcatgtggcgtaaacaaggaacaatgctgtgcaacattgtcttctatcctgtcattacaaagccaatttacaggaaagaaatgatct

SEQ ID NO: 43796 - DNA, 359 bp, Zea mays
  Clone ID: LIB3066-042-Q1-K1-B7
agcctgccctgccctgccttgttaagcaaagcaacccagctgcgagacacgagagctagctagagagagatggcggccacggtttcgtccttcccggtggtgaacatggagaagctggagaccgaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgtgagagcaccttcttcgt

SEQ ID NO: 43797 - DNA, 434 bp, Zea mays
  Clone ID: LIB3066-042-Q1-K1-B8
cgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatctgcggagggtcagtaagatggattcagtctcacgacctgctgctgctgatgttgaggagtgaccagaaccagaaccgtcgtcctcgattctgatagattatcttctagtataccttgtgttgtcgttgtcgtcggcgcgacgatcgtcgtcgtcgtcgcgccggtgtatgcgatgaacctgccattgctgctgtttaattaagcattctagatggtataccgcatgctttgtttcggtttctatgt

SEQ ID NO: 43798 - DNA, 458 bp, Zea mays
  Clone ID: LIB3066-042-Q1-K1-B9
acttgctcctcctcgcgagctcagctcgcgcaccgccgcagacagcgccgccgcgctctcctgctccccttccgctttgccgccacccactgctgccggccgccgcaggcaccccatggccccgaccgggcggctcctcgcggtagccgccctctccttcctatgtctgcaggggccgtggggagattcaggcagcgcatttgctcagagccagccgccgcttcaccggaccgttcgcgcagaggcaaatgacggcggcggcctcatgccggagctcccgcccagcggcctcatgcccatgccggagctctcacccagcggctctcccacgccatttgtccccttcctggcgcccgctccgctcgcgccattctttaacaacagcacgccaaagctctcaggaaaatgcacgctgaactttaccgctgtcgacaaactcatgaccaccacagctgtcg

SEQ ID NO: 43799 - DNA, 291 bp, Zea mays
  Clone ID: LIB3066-042-Q1-K1-C1
ccaacgcttacgacatatgggacactggattgaagacatcgatcggctcctgtgaacgtgcgtgagatcagctggcaagagatcctacgcgagctcatacgcaatggcagccgctcagcaggatcctcaacacgacgataaacccaacctgtatcccaacgagtctggccaacgtgcaatgcctcgtgcaacgtctgtgcatacctcatcggatcgatgatcgtccccattctcagacaaagtctgacacaacgcctgatgactgacctcatgaatgaacacttgcacgac

SEQ ID NO: 43800 - DNA, 465 bp, Zea mays
  Clone ID: LIB3066-042-Q1-K1-C10
gcgccgccgccgccaggcgaccattctacatccagcacgggcgtgcggccctcggtcggcgtgggcgcgcggcggccatgacggctcgaacgcggtagccacggccccgacgtctcccgtcccggcgcgtcaccccgtggtgcggcggcccccggcctcaacggctcggaggcgcgactccctgcgacgcgcggcctcttggccccggcggctcgggcgtgggtgcccacggcgcgcggccccccggccccggcggcacgggcgcgactgcctgcgacgcgcggcccccccggccccggcggctcgggcgaaggccctcgacgcgcactggtgaggcgcggcagccttccgcgcttgggcacggtggccggccaggcgggccacagccagcgcgggcgcgcagtcccgcgggcttagagcccgccccggttttacacgggcacgacggcgtttgcccccgggccc

SEQ ID NO: 43801 - DNA, 331 bp, Zea mays
  Clone ID: LIB3066-042-Q1-K1-C11
caaacccctcatccccatgagaccttacgagttggagcaaggctcagtgcccgcctgcccgggcgtgccgagcgatgccatggaggcgcgcgtccctgggcgtcgtcacgtcctcactccttgtccgactgcctgtcgccttgtctcgcattgcaggtcgtagacaacagacgagcagtagcagcatcacgaggcggccgggcccgggccacgccatgccggagaaggaggcgcaagccgccgcgttctgcggctaggcagtgatcgccgagttcgagtccctcacgcgggacgccgccttcgtgcagcgctacacgctgcgccggatcct

SEQ ID NO: 43802 - DNA, 417 bp, Zea mays
  Clone ID: LIB3066-042-Q1-K1-C12
gctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaagctggagtgcaagcacttcggcaccggcaagctcgagcgctccatcgacggggtgaccgacgcgaacggcacgtacacgatcgagctcaaagacagccacgaggaagacatctgcgaggtggtcttggtgg

SEQ ID NO: 43803 - DNA, 319 bp, Zea mays
  unsure at all n locations
  Clone ID: LIB3066-042-Q1-K1-C2
cggacgcgtgggccgacgacgactcgccgcactcctcatcagactccccgacggcggactggtcttcacctgccgaggcagcggcggctcacgctcacgtctatcaccagcagcagcaagaggagcagcagaatgggggcaagcacaaaggcagctgggctcgaggacgagctggcacggcgaccaagctgcacatcacggcgccgcagagcccccagtcggctcccgcgggcatggccggcggccacttcgacccgaccagcccccgcccgtcgtcgtcgtcccagaagcagtgcccctncagcccccgcagcaggca

SEQ ID NO: 43804 - DNA, 450 bp, Zea mays
  unsure at all n locations
  Clone ID: LIB3066-042-Q1-K1-A9
cccacgcgtccgccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgattaagtctggtaggctatcagagccgtacaagggtattgttgactgcttcaaacgtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctcttntgtttttgtgtactccctggactacgcgagaa

SEQ ID NO: 43805 - DNA, 309 bp, Zea mays
  Clone ID: LIB3066-040-Q1-K1-G4
cccacgcgtccgcccacgcgtccgccctactccgcctcaaggctctcctctcggagcgctgatttgcaacccaataatggcagaagtcctatcaggatctcatgaacaccgtctaagctctgccttagatggacactaccacgagaagaggaaatccaatgtggaatacacagaggacgagaagaaagccgtgatcgcggctctgaaaaagaaggctctgagcgcctcacagaagtttaggcattccatgaagagggggacgaagagcagcaaggtgatgtccatctcgattctggatgagcgtgaacc

SEQ ID NO: 43806 - DNA, 371 bp, Zea mays
  Clone ID: LIB3066-040-Q1-K1-G5
ggagaacagggtattcctgcattggatcctcaacagtatatggaaacaatgcaacaggtcatgctaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaatgaccctgaggttcttcaaaagattggccaggcaatgggtgttaaccttcccggagattctagtgtgtccactgtgctctctggacccgaagagac

SEQ ID NO: 43807 - DNA, 403 bp, Zea mays
  Clone ID: LIB3066-040-Q1-K1-G6
cggtagcctcctgagggcgctggtgctgcgtgcggcgtcgtctgcgggcaggcgccgggggcccaggattctgtgtggccgcgcgacggatgtgcgcgtgacgccacggcacggacacggctggcgcgggttccgggcggtcacgggaaggatgatgctggactcctctgagtctgcctcttccgccgccgccgccgccgcggaggcgggagctggggcggtggcaggccaggcgcagccgcagcgccgcgcggtgggggccgtgccccaggcgcacgatggtggctacgccagcggcggatgggagagagaagatggtaaactgagttgtggatactcaagttttagagggaagagagctacaatggaggatttctatgatgtaaaactaactgaaattgat

SEQ ID NO: 43808 - DNA, 375 bp, Zea mays
  Clone ID: LIB3066-040-Q1-K1-G7
acgcttataccttcctacatacccttggcaatttcatggttccaccaaccacctttgttgggggggtcttttatttcatatccgcctaaataaaatggatttttgcttgtcttaggcatggactggaattatgtcctaatggaacaattgcatcgcttagatctaacggcttctaacattccatcatttcgtatgtagctacattttgtctccaatacccatgatttgctagctacataatatttctaatttttctaatcattagataataagttcatagtacatgaatactgcaatcagtccccgatccttgtggcatctatgtcaaacacttaactactcaaaacatacattggacaaatgcgagctcatata

SEQ ID NO: 43809 - DNA, 175 bp, Zea mays
  unsure at all n locations
  Clone ID: LIB3066-040-Q1-K1-H10
cccacgcgtccgcccacgcgtccgccctcgcgtccgcggacacgtggacggacgcgggaggcctatcaaacaccctggccccnccccacncggangtncnccaccaaccctctcctggccgccgactaccgctagcacaccctgcaccacaggcagcgaccacccccgcagcagg

SEQ ID NO: 43810 - DNA, 167 bp, Zea mays
  Clone ID: LIB3066-040-Q1-K1-H12
gagacacacgtgcgggatgatttgctatatcgtggggccacgtaacggcagatcctagctttctttgtaaacaggaggatgtggaaagttggctgcgtatgctttgcggccatgtgcatggataatcttgctgctcgcctgaaagaaaaaaaggccgatcttaagac

SEQ ID NO: 43811 - DNA, 392 bp, Zea mays
  Clone ID: LIB3066-040-Q1-K1-H5
ggaccttcggcgcccgttcaggatccatatcttcccgagcgagttcttggttgacctgttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccaaaacttggacaggtcattcagctccagggtgatc

SEQ ID NO: 43812 - DNA, 247 bp, Zea mays
  Clone ID: LIB3066-040-Q1-K1-H7
cttggggaaaagaaatcaacttcttaaccaacttcttaagaagcggatggacaagcttgacactgtctttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacac

SEQ ID NO: 43813 - DNA, 335 bp, Zea mays
  Clone ID: LIB3066-042-Q1-K1-A1
cgccgagttcttctgccccgaccacttcccgcagttcatggagttcgtgcgaagcgtcgtgtgcggcgagtgggacgaggacgacggccccgccgacgaggagcgtggcatgactgtgtcaggcaataccagatccagggaggccaaggcggtttgaagcttcaactcatcgccgcccccgccatatctcagtcagctgtctcgttttatttttgaagtgccaaaatacttgcaaatttccgctgctactagatttagctgagaagaacgagatgatccatgtattagtggatcaggagttgcaaatgtgggatcccacatgcattttttctttt

SEQ ID NO: 43814 - DNA, 418 bp, Zea mays
  Clone ID: LIB3066-042-Q1-K1-A11
cccacgcgtccggcaatttgaacatctgaaagtgtagtgctgagatgctttgacacaaaaggttttgatggcattaaaccactctcctgggtacctagaagacaatcccactcggtgtctagttcatccatattggttgcagcaagagcaatgacatttctacatttgatcaatggcaatggtagcgttttgtgatgcagtaattctgtaataccttctggcaacagtgccatctcatttcggtcaccagtgtaattgtttcccatgagttgactaaggtaatcttcaaattcttcatcaggagccagacgaactccaaatgctttcgcgacaccagccaaagaaacgtctgaatgtaacggcccgcgttggccttcttggtgagcggcgcatggtgcggtccttccaaaagcccccc

SEQ ID NO: 43815 - DNA, 389 bp, Zea mays
  unsure at all n locations
  Clone ID: LIB3066-042-Q1-K1-A12
cccacgcgtccgcccacgcgtccgtccacgcgtccgcggacgcgtggggtgccgggcccatggcgagaggtacagcccggcatcaaggccgcgcgcgcgggcagcgcccacgaactccctcaccacgtcgacgcggcccccgcgccaggggctggcgcgcacggagtgggccgcgtagtcggacggacagaggcagaacccgtcgtggtgcttggcgacgaggatgacgagcgaggcccccgccgtccgcgccgcgtgcatccactgggtggcgttgagccccgcggggcggaacagggacgggtcctncgaccccgtgccccactcggagtccgtgaacgtgttcatgccgaaatggaagaacatgatcacctcgcggcgctgtcatc

SEQ ID NO: 43816 - DNA, 370 bp, Zea mays
  Clone ID: LIB3066-042-Q1-K1-A2
cacacgcgtccgctaactagaagcaatactgatggcccaaaacatgatgattgtgatggtgctcctgctttccacctttctcgtggtggcaagatccttgtgggttccagacgaacccttaaatgcggatgacataataggtgcttgcattgatgagtgcaccaactaaaataaggcttctggcgactagaagacattcgaagtgttgtgcaccaagctcacaaaaaagcctagcgaagaaggcaatcatgattgacgaagtacaactccgatgatatatacactattggatcactggtcatctttgtagccatgtctactacactatgggcctgattatatcgtcttattgtgtggttttgggtttcca

SEQ ID NO: 43817 - DNA, 245 bp, Zea mays
  Clone ID: LIB3066-042-Q1-K1-A3
accaaggcagctgccaaaaagaaatgatgcaacctgtcgttaatcctgtatctgcttttggaatacctgacttgtcactccatcccgaagttttgtatgcggttgttactgttattgtgtactgttaagctctgctgcggcgtgccctgttgtttgggtagcgtcaacgtcgagcgccacttgcgggtgtgcctttgtctgctatcagtagcggcaaaaattgaaagctctcgagacttatgtcc

SEQ ID NO: 43818 - DNA, 194 bp, Zea mays
  Clone ID: LIB3066-042-Q1-K1-A4
gaagcaaaccgagaggtgaaccagcagcctccaatataagccagcacatccaaataaaagggagaggcctcagccctcaggctagccgaccgtcgacgtaccaccgcgccaacccgagagaaagatggagatgatcaagaggatcctcatcgacgcgctcctcgtagtcgccgactgggacaccgcagtgctgg

SEQ ID NO: 43819 - DNA, 414 bp, Zea mays
  Clone ID: LIB3066-042-Q1-K1-A5
atcctgagtggttctggttctcatatgcgcacgcatatttttgttcttattcctatgtctgcatttcggtcagtggaagcaattgagcgcggttcctaaactcggatcctgcattttgtttcggcgatatgtgttggtgttaccagttgctgcagcgatacttccaatttctgcgccgatgggtttcctcgttttcttcttattttgtttcctcgtcgtcgcagcctgcaaattggtagtttcttggttcttatcagtggagctggctttggaatttgcaggcaccgatctgagctgcgctggtgctcctggaaaggtgttggtgcctggaagtggcagtgatgactagctttccttcgtagagcctgtcggggacactcaacctgaagaactacaggctttgcactttcatat

SEQ ID NO: 43820 - DNA, 476 bp, Zea mays
  unsure at all n locations
  Clone ID: LIB3066-042-Q1-K1-A6
ggagagccaggtccccaggatgtgcctggacctgtacagggagtatgggaccacaatggccggcctcaaggttttggggtacggtttcgactacgacgacttccacgcctgcgtgcacgcgacgctgccgtacgagaaggtgaagcctgacccggtgctcaggcagctgctgctttccctgccgcagaggaagatcatcttcaccaactccgacaaggcccacgcggccagagtcctggagaagctcggcctccaggactgcttccaagggatcgtctgcttcgagacactgaacccgccaccaaccgagaagaacagtggcggcagtgctgggacgatcctgtgcaagncctcgctggcgtncatggaagccgtcatcgagatcggcaagctcgacgccgaaagaacggtgttcttgacgacagcgcgcgcaacatcgcgcagggaaggccgccggtttcgcacctcatcgtggg

SEQ ID NO: 43821 - DNA, 291 bp, Zea mays
  unsure at all n locations
  Clone ID: LIB3066-040-Q1-K1-G2
gaaaaagtcaaaggccatcgatccgaaaccttccggccctggtgggtcctccgacatcaaccaattgggcgcctccggcaatggcaagacagacagcacgaaggctgtgcangaggcatgggcatcggcgtgcggcggcactgggaagcagacaatcctcatacccaanggcgacttccttgtcggacaactcaacttcacaagcccttgcaagggcgacgtgaccatccaggtggatggcaatctgctggcgaccacggacctaagccagtacaaggaccatggtaattg

SEQ ID NO: 43822 - DNA, 237 bp, Zea mays
  Clone ID: LIB3066-042-Q1-K1-A7
actgcctacaccacttgatagacagtgttgggcttccattcggcggggatgacgtgcgtcgtagacagtcttagtgcctccctcggtggtgagtcggacggtgatggaagcccaacactgcctacaccacttgatagaccttttttatttttttattcaataaaaggatataaggtgtgtgacaacaacacaaatattgtattatctatgtatctcctatgcaatcccaattttatc

SEQ ID NO: 43823 - DNA, 407 bp, Zea mays
  Clone ID: LIB3066-042-Q1-K1-A8
cggacgcgtgggcggacgcgtgggcggacgcgtgggcgggatggaagctgccggcatccacgagaccacctacaactccatcatgaagtgcgacgtggatattaggaaggatctgtacggcaacatcgtcctctccggtggcaccaccatgttccctgggatcgctgacaggatgagcaaggagatcactgccctggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccaatcgccacaggaaatgcttctaatttcttgggcccgagaaatgcaagccgtgggggagccgttacc

SEQ ID NO: 43824 - DNA, 363 bp, Zea mays
  Clone ID: LIB3066-040-Q1-K1-E12
cccacgcgtccgcccacgcgtccggcttcccggaccggctgcggttactggtgtagggggcctaccaccgcccgcgccgcttcacgccggggttcgtgctccgcgacctcatccagtatctgtacagcgacaaagtagaagagaagaaggagctgatcaaggggataacgctcggtaacaaagacaaattccagcttacgcctctgccccagcaagttcttgtgttatggggagagcacgatcagatattccctgtcgagaaggcatttgaagtggcaagggaacttggcgcaaatgctaagttggaggtgctcgaggacaccggccacatgccccaggaagaggatccgaagcggttcaacg

SEQ ID NO: 43825 - DNA, 140 bp, Zea mays
  unsure at all n locations
  Clone ID: LIB3066-040-Q1-K1-E3
tagttcatcggtcttgctaattgttgatgggtgcttcattaatttgatttgatgggtctcatggctactagaaacaaaactacttttgataaaatgcanggcatgaaaagcgtttctgcagtccttaaattgctcgtttt

SEQ ID NO: 43826 - DNA, 379 bp, Zea mays
  Clone ID: LIB3066-040-Q1-K1-E4
ccctccctccctcacacaaataataatgtaaaggtcccgcccttttcctccgacatcggcaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggagtcaccgacgcgaccggcacctacacgatcgagc

SEQ ID NO: 43827 - DNA, 277 bp, Zea mays
  Clone ID: LIB3066-040-Q1-K1-E5
cccacgcgtccggcttgctagttgagctcttattatgttcttgttcttgttcctggggggatcgctctcgtgtggcggtgttgatgtacatgtcagggtcgtgttggatgcgctgggatgggagattacataagatgctacagagatcgattcatacgtagaaagaggaccggactccgccgagtatccgagtgttctggactcagatctgctcgtggcagaaactagatgcaaatgaatcatgttcactaagaccaaaatgaccgaatacatcccg

SEQ ID NO: 43828 - DNA, 382 bp, Zea mays
  Clone ID: LIB3066-040-Q1-K1-E6
cccacgcgtccgactagatctgatatctcatgttgaatcttcccatggggatatgtggacagattaacaaaatgaacttattgaatcacctgctgagatgctctatggatcgattcatgttcggtctactactacaagtgaagggctgtccgcattgctggataagtacaggaacgttgagttcggcagatgccctctagtgtattgcagcggccaaccatgcctttctgtcgggcaatcggatgtttctcgtacaagtacggcgaagatttactgccctacatgtgaagacatctacactgcaagatccaaatatgtaagcaacatcgacggcacttactgtgtgacaacattcccccacttgttcctgatgacatacccg

SEQ ID NO: 43829 - DNA, 353 bp, Zea mays
  unsure at all n locations
  Clone ID: LIB3066-040-Q1-K1-E7
cggacgcgtgggccgacgccttggcgctttgagccgangccgccaacaaaaaccaggtgggcgttacccctcggcctgccaatgccttcatcggcctcatgtacgggctgttccgggtcatgggctacgtcccgttcggggacgccacgcgggacatcatcaccaccaacctcggagcccggtggctgtcggccgccgtgcagctggggctctgcatcaacctcttcttcacgatgccggtgatgatgaaccccgtgtacgaggtcgccgagcgcctgctccacggcaagcggtactgctggtggcttaagtggctgctggtcgtcgtcgtcggactcgccgccatgtacgtg

SEQ ID NO: 43830 - DNA, 311 bp, Zea mays
  unsure at all n locations
  Clone ID: LIB3066-040-Q1-K1-E9
tcgnccacgcgttcggccacgcgttcgagcttaccaagagagccaggtgttggccaagaggggccaatcaggccaacggtccaggaaaaatccaaccttaccaacacagcagcagcaagccccacccgttcgacgacatggcccgctcggcgcccgcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcg

SEQ ID NO: 43831 - DNA, 389 bp, Zea mays
  unsure at all n locations
  Clone ID: LIB3066-040-Q1-K1-F10
ctgtatcgcattgcttgcgcgagcgctgataggcacacacgtacagccatggcgaacgcgtcgttcggcctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaggttcangagggagct

SEQ ID NO: 43832 - DNA, 389 bp, Zea mays
  Clone ID: LIB3066-040-Q1-K1-F11
cggacgcgtacgcggacgcgtgggctgtcgagacctgattcgacatcgagatcgacggcaagtttgcaggccggatcgtgctggcactgtttggggacaccgttcctaaaactgcagagaacttccgagcactttgcacaggggagaaaggaattgccaactccggcaagcctgtgtggtacaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtgcgctgtccatggctaactacgggcccgactccaatggctcccagttcttcatcaccacc

SEQ ID NO: 43833 - DNA, 388 bp, Zea mays
  Clone ID: LIB3066-040-Q1-K1-F12
cggacgcgtccggtgaccccgcccacctacacaccggcgatcacgcccaccaagaaggaggactacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcagcaaggtctctgatgaggcggcggcggcggctaccgcggtgccgcctgcaggtgccaagacctgcagcagcaacgatgcccgcgacggcgccatgggcagcgtgcaggacgagccggcggagcagcgccacgatgactattaccccgaga

SEQ ID NO: 43834 - DNA, 367 bp, Zea mays
  Clone ID: LIB3066-040-Q1-K1-F2
tcggccacgcgttcgattccaggaagccagtttgatggtgctgggacttaattgggcaccgagtctttatggtattttactggctgacccccccaccaactctggcggaaacacaaagttttgatttgcaggcattccgttttagtgcacacatagagtttctgaggcaatcaagagttgttcgaccggcgcttctggtgtcaatattatgtgcttacaagaagcctggacaatgccttttgccttctgcacacgcgagaaaagatggtgtgaatttgctgaaccagttgatggagaatctactcaattccttcaggaacttgcacagaagtataacatggtaatagtgagcccaatccttgaaagg

SEQ ID NO: 43835 - DNA, 62 bp, Zea mays
  Clone ID: LIB3066-040-Q1-K1-F4
cccacgcgtccggcgaggcggtatagtctatatgagaggcatgtatccagtagcgcgcttat

SEQ ID NO: 43836 - DNA, 322 bp, Zea mays
  Clone ID: LIB3066-040-Q1-K1-F5
cccacgcgtccgctccgatccatcaactatcgccgagagcgatcgagagataaatgagtatgtataaagtggcatcatcgtcagccgctctcttcgtgctagccctgacgctagtttgtgccccgctgatcgcagaggcaaagaagaagagagtcgccgccgacgccgccgaggagaagaaggtgcatgacaacttctgctcgacgctgtgcgagggcaggaaggggatggacctggtggtgtgcaacgagtgctacgacctctcacagcgcttcaacctggtgctgtacggcctgatccagtgcaagggcaagtgcaccga

SEQ ID NO: 43837 - DNA, 385 bp, Zea mays
  Clone ID: LIB3066-040-Q1-K1-F6
cggacgcgtgggcggacgcgtgggcggtcgcgtgggcggacgcgtgggctccgacggggactttaagcacacccacgctgaagccggtacgctgtccatggctaactacgggcccgactccaatggctcccagttcttcatcaccaccgtagacgaaaaccggttgcccaagaagctggacgggcgccacgtggtgttcggcaaggtggtgaaagggatggacgtcgtgcgcaagatcgaagccgagggccagctcaccggtgtgctcaaggccaaagtcgtcatagccaacagcggccagctgccagcgcccgccgacggcggccatcgtgacctctgatcgatgacgaggagaacgactcacgatccatcaatccgatcgatc

SEQ ID NO: 43838 - DNA, 397 bp, Zea mays
  unsure at all n locations
  Clone ID: LIB3066-040-Q1-K1-F7
nccgcgcgttcgcaaaactggttttggttttaattgggtcacaaatgcctttggctggagtaattggttggttggtggtcatgtgaatgtccgagcttcccattttcaaaatgttaatatttcatatctgataaagtttataagtttattgtcgtcattaagatgggttaagaaggatgcctgctgtgttttaggatgaggctccatttggaagtcaatagtgcaacactgctcattccaatgatatacccccactacaaacagacacttggtcataattggctttcgcacattcatattcaatgtctcaaacttgttattacgattctgcggatggtctgacaaaaccctgggcatagtgtgattattgacactaatattagttccaaagcatttc

SEQ ID NO: 43839 - DNA, 301 bp, Zea mays
  Clone ID: LIB3066-040-Q1-K1-G1
tgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcaaacaatcctcatacccaagggcgacttccttgtcggacaactcaacttcacaggcccttgcaagggcgacgtgaccatccaggtggatggcaatctgcttgcgaccacggacctaagccagtacaaggaccatggtaattggatc

SEQ ID NO: 43840 - DNA, 351 bp, Zea mays
  Clone ID: LIB3066-040-Q1-K1-E11
cggacgcgtgggaaaaaaaaaaaaaaataaaaaaaaaaaaaaaaaaaaaaaaaaagagaaaaattaaaaaaaaaaaaaaaaaaaaaaaaacaaaaaaaaaaaaaaaaaaaaaaaaaaaaaaacaaaaaaaaaaaaaaaaaagagggggggccccatcaaaaggaccaaagctaaccgcccggggcagcaaagaaaaaacttttcttaaagggcacccaaaactaaattcacggggcgcagatcaaaaacggtgcaatgggaaaaacccgcggtttcccaacctaaatggaaaagggcaaaagccccgttgcaaaacgtgaataaaaaccaaaaggggcgtaacgattaccc

SEQ ID NO: 43841 - DNA, 305 bp, Zea mays
  Clone ID: LIB3066-040-Q1-K1-G11
gaatacccgccgggacccacgcgtccgcggacgcctcctcccaccccttcggcttcgcgtgcgttttttttttggagcttaacagcagtttttaacacattggcatggcgcgcgagtgcatgatgcgtgactacacagcatgatacatgcttgtacaactagaggctacacatgttacgactggataccctatttactagctctgacgtacattactagtgctggaagataagtggtaacctgcaggaaaaatatagaccaaactcatcgcagggaaataagaaaattggacagatcgaaatcgc

SEQ ID NO: 43842 - DNA, 383 bp, Zea mays
  unsure at all n locations
  Clone ID: LIB3066-040-Q1-K1-G12
cgcacgcgtccgcccacgcgtccgcatatctcgaacccagtaaatcaccagcgtacgaagcacattgagatcgatctacacttcgtccgtgagcgtgttgcggtcggtgctgttcgagtattgcatgttcctactgcctctcagtatgctgatatcttcaccaagggattgccttcatcggtgttcacaaaattcaggtctagtctgaacattcttccaggtggctgaccacgttcagactgcgggggggggggtgttggattactatatttagattgatcatcttccttgttttagtattgcatgtcaccattattgtatacgtgcatggcacggngatcaccttccatctctagtgcatggctatacttaaggtctgtttg

SEQ ID NO: 43843 - DNA, 362 bp, Zea mays
  Clone ID: LIB3066-047-Q1-K1-H8
ctgggcctgtccacggtggtgaccatgatcttcgcccgcgaggtgccgctggaccgggcggcggcggcgaagcatgacgaggccggggagtcgtcgggcccgttcgccgttttcaagggcatgaagaacatgccccccggcatgcctcaggtgctcatcgtcacgggcctcacctggctctcctggttccccttcatcctcttcgacaccgactggatgggccgcgagatgtaccacggcaggcccgacggcagccccgaggaggtggccaggttccaggagggcgttcggcaaggcgccttcggactgctcctcaactccgtcgtcctcggagccagctacttcctcatcgagcccatgtg

SEQ ID NO: 43844 - DNA, 412 bp, Zea mays
  Clone ID: LIB3066-047-Q1-K1-H9
gccatcgactgcggcgcgagctgctcgtaccgttgcagcaagtcgggacggcccaggatgggcctgagggcgtgcggcacctgctgccagcgctgcggctgcgtcccgccgggcacctccggcaacgaggacgtctgcccctgctacgccaacatgaagacccacgacggccagcacaagtgcccgtgatccatccaccgtggttcccagcatcagcagctttgccaaaaagacatgatacctacatatatataagagtacctagctgctgctgctctactaccttgctggttcattatattgtgcgcgtgcatgcatgaataaataaatgaacatattacggcatgtacaatccagatacggctgcacggtactccaagttcaagatacaactgaaacacaacacaataca

SEQ ID NO: 43845 - DNA, 330 bp, Zea mays
  Clone ID: LIB3066-048-Q1-K1-A1
cgcgacgcgtgggcgagtaccttcgcaaagatgaacgaatggtgtgacggatcatcaacgttgggcatggggtggagtgactcgacgaatacgcatctggtacagggcgcgtgactcgcggcaaagtctgctcaggcgtgctcttgatgtcttcaccgtggagcccccgcccaaggacagcaagctggagttgcatgagaatgtcactgtaacaccccaccttggagctagtactgtcgaggctcatgaaggcgtcgctatcgagattgcggaagccgggggtggtgcactgacaggggagctcgcagcaaccgctgtgaatgcgcccat

SEQ ID NO: 43846 - DNA, 454 bp, Zea mays
  unsure at all n locations
  Clone ID: LIB3066-048-Q1-K1-A10
ctcacgcgtccggatcgatcgatcgctgccgtgtcgtttgccagacaccatcatcacccaggaccatggtctgcaacctggctcagtgcgccaccgccgtcgtggcgaccgtcgcgccccgcaccccttgccctgctgcgtccgcgtccgtctccttctccgagaggaagccggcgggcggcagcctgcggctgcagcggcatgcgtgctgcgagccgtcggtggcgccgtcgcgggcggtgttcgactgccgtgccgcggcgtcggagagcgcggacgacctggccttcgggggcaggatgtcgtccggcgatgccgtgctcgtcatgatgccgatggacaccgtcaaggagtgcagcaccgcgctgcaccgccgaaaggcagtgcatgccagcctctccgngctcaagagcgcgggcgtcgagggcgtcatggtggacgtgaggtggggcat

SEQ ID NO: 43847 - DNA, 427 bp, Zea mays
  Clone ID: LIB3066-048-Q1-K1-A11
gggatcgtcatccgtcccacccacaactgctccagatccaggcacggcacggcacggcaggggggccaacccaagcccggcttctcttctctctcgtccgtcccgcactcgccgcgacgtgacaagacaacgcgacgcgcgcgcatacgtcgtccaaggcacgcaggggccagccaagccaaccaatcgcgtccgtccgggtctggtggtggccggaatgggcctcctcgatcagctctgggacgagactgtggccggcccgcgaccggactccggcctcggcaagctccgcaagtactcctgcttctccccctactcctcctcctcctcgtcgtccatcctggcccccgcgccggcgccggcgccgtcggtgacgcgcagcatcaccatcgcccgcccgccgtcgctctccgtcgagtcctacagc

SEQ ID NO: 43848 - DNA, 451 bp, Zea mays
  unsure at all n locations
  Clone ID: LIB3066-048-Q1-K1-A12
ccggtgcggaggtctgtcattggagggaggctcctctccgctgcgcgcgcgcgtcgcggcctgggcgagtttcctgctggttcctcgtccctcgggagagattttgcgatccttggcgttactgttcgattgcaaacagtattgctgcttctctgaggaggcattagggctatgggcagttgaactgaaccgccgcggcagaaatccattcgtgggagagagaaatcaaagaggagagtgagtgatcatggagcgcgtgattggagggaagtataagcttgggaggaagattgggagcggatcttttggggagctatatctcggtgttaatatacagaatggtgaggaagtgggaataaaattggagcctgtgaaaacaaaacatccacagctgcactatgaatctaaagtttatatgctactgcanggtggaaatggtatcccacacctc

SEQ ID NO: 43849 - DNA, 379 bp, Zea mays
  unsure at all n locations
  Clone ID: LIB3066-048-Q1-K1-A2
ncgcccacgccgttccgcccaacgcgttccgcccacgccgtccgggacatgacccgcaagcatgctctgcgttggtttcaacgcttggagtgaagccagagatttgcttgttgcaacaagattggatgccaccacacccaagtactccaaggcccgttatgatgagattgtgaaggaagtctcttcctacctgaagaaggttggatacaaccctgacaagatccactttgttcccatctctggtttcgaaggtgacaacatgattgagaggtccaccaaccttgactggtacaagggcccaaccctacttgaggctttggacttgatcaatgagccgaagaggccttcagacaagcccctgcgtctccccctacaggat

SEQ ID NO: 43850 - DNA, 246 bp, Zea mays
  Clone ID: LIB3066-048-Q1-K1-A4
ctcacgcgttcggccaagccttccgggggccgaaaaaacccaggcaggtcatcggttcaggaaaaggcccacttagcaaccaccagcagcagcaggccaaccggttcgacgacatggccggcttcggggccggcgccgtgttggcgctcctagtggcggtcgcggcggtggccgcgttcctggcggtgccggcctcggcgaagtccggggagctgatcgcgatggggttgctggcggcaaagggcg

SEQ ID NO: 43851 - DNA, 396 bp, Zea mays
  unsure at all n locations
  Clone ID: LIB3066-048-Q1-K1-A5
cctcggcatgttcagcaaggactcgcgccgccgactgctgtcgtcggagcaggatgagaagggctggcccgtgtggatgcggtcgccggagaggaagctgctggcgtcgggcaaccagcccaagccgaacgcgatcgtggccaaggacggtagcgggcagttcaagagcatccagcaggccgtggacgccgtgcccaagggccatcaggggaggtacgtcatctacgtgaaggccggcctctacgacgagatcgtcatggtccccaaggacaaggtcaacatcttcatgtacggcgacgggcctaagcaaagccgcgtgaccggccgcaagagcttcgccgacggcatcaccaccatgaagacccgcacctctncgtcgaggcgtccgggtcatct

SEQ ID NO: 43852 - DNA, 337 bp, Zea mays
  Clone ID: LIB3066-048-Q1-K1-A6
gatccctcgagtcttgtggggtgcgatccgcgatgctggcgcgggggcaaggggggtctcggtttgaattagttgatttcgcagttcagggtgcgcatctggtgagtagggatccagagaacgggcgttttgagccggatctaggggtagtggccactgggctagcttagccttccgctaatgacagtatagtgacgccccgtgcttttctggttctagaagggtgcgccaggtgctcttgctgtgtgatctttgtcgccttgtgacgctggggaccgggttattggcgggagtttgtcagaataatacataaagaactggtgccacgaaatcgggg

SEQ ID NO: 43853 - DNA, 448 bp, Zea mays
  Clone ID: LIB3066-048-Q1-K1-A7
aaccttacctgtgggagaatgagaagcaatcttacaagcgtcatgttgttctttttggttgtttggtccaactgaatcacatgtacactggtactatgcaaaaattaccaacaaaatcaaatacagattcaaatatcatgagatgctctcaggttccaagattcaagtacctaccaatcagtgctccagctatatcatcaagatcacacaaaccatcactacagtctctgtctagcgagtccacatctaaaaatccttggaaatcctattcaaatggagatagatctactacaccagagtttgatgataatgcaagtcttgttggtgctgctccattgcttaagtcatttgttactcaggtggggaccaaatttggggagaacacatcgagatggggttccatgctctctgatggacaggttggtaagctaagtgacatccttcctgg

SEQ ID NO: 43854 - DNA, 168 bp, Zea mays
  Clone ID: LIB3066-048-Q1-K1-A8
gtaactacgggcccgactccaatggttcggagtacttaatgaccaccgtagacgataaccggttgcccaagacgctggacggacgccacgtggtgttcggtacggtcgtgaaagggatggacgtcgtgcccaagatccaatcctagggtcaggttaaccgcgttccca

SEQ ID NO: 43855 - DNA, 449 bp, Zea mays
  unsure at all n locations
  Clone ID: LIB3066-048-Q1-K1-A9
gtctggatggcggatggcggttccacaaactctcctgctagttatgctggtcgtcgtgctagcgatgtgtcgtcgatgtcgccaactccagtcactccaatgctctaacgcttgacgtgcgcgttgtactcgacagccacagtaggttcacgcgtcggacccgagacaaatcctgacctacgacaatcgttgtacgagtaggcgtgacggatgcgtcaccaacgctggcgcgtgccgctacaatgacactcgcacgcatgggtacggcttgcacacagtgtacgtgagcactgtgctgttcggagaccgtacggnctgctgacggtgctacgaggtgctgcgcgtgtacagctctagcaggtgcaagcctgaagcggcagagctgatggtgacggtgaccgaactgtgcccgtgctaagaccaatgatgcaagccaccgcggtaacact

SEQ ID NO: 43856 - DNA, 436 bp, Zea mays
  unsure at all n locations
  Clone ID: LIB3066-048-Q1-K1-B1
gctcctacacaaatgcaatccgccgtcgtctacgtctcgaccaacgaacgccatagcgcagctgatcgagagagagaacagaagggaggagagagggcctcgccggcgaccttcgctccggccttgatgtgggtgcccagttcctcgctgggcagtgccgagcgtacaccgagaaggtcgcgctctcgccgatcaagtctggaggacgagctgctcagaacgcgtcgtcggcattgaaagaagtcatgggctcctacacaaatgcaatccgccgtcgtctacgtctcgaccaacgcgtgaggttacgagccacctgaagaacaagttggtagctggaatctcaagtgccaggtcaagagcaggtaccgcaggatgaggcgcatggaggatgctgtgacgagttcgtgagaggtctangccgtcgtctcccagtcaa

SEQ ID NO: 43857 - DNA, 432 bp, Zea mays
  Clone ID: LIB3066-048-Q1-K1-B10
cggacgcttgggcggaaatgtggcatcaaagagtataaaactattggagttcgctgggccgggaggttaaaccagacactattagaaacatcatggacatgaaggcaaacttcgggtcatttgctgctgcactcaaggagaaagacgtatggttgacgaatgttgagccacatgatgaaccatgcaccctcaagataatctatgatagagggctgatcggcagcaatcacgactggtgtgaagccttctcaacctatcctataacatacgatcttctacacgcatgggcagtcttttctgaccttgataaaagaggctgcagtgccgatgacctgctccatgaaatggatcgtatcctcaagccgactgagtatgccatcgtgaggtacatgggcaacctcattgagtacatcaagaagtaccttcacgcac

SEQ ID NO: 43858 - DNA, 456 bp, Zea mays
  Clone ID: LIB3066-048-Q1-K1-B11
aacctgtctgtcacattgttcattctgacggtctatgtcgccgcgacggcggcacggaccggctgtgcggtcaaatcttcggcgagcacaacgaccacaaggaaacacgaagcagccaaagaagagacggatgcgcctgccaaggcaccagctgctgcagtcaccgaggggcctgctgaggtagcgcccatgacatggccgaatggcgggcctgagttcgtcaagatggtcatcaagaaccccttctttaaaagcgcacctccatatggtagcgaagacggcctacccattgaccccactacagaaggcagcatgaactaaattaaataccaattacgagaccgaccagatatgcatggagcatgcaagaatgttgtcgaacgaatatatgctatgaatggttacatgtactggctacatttagttcaacttaatttctctagtgcgctgaaagct

SEQ ID NO: 43859 - DNA, 425 bp, Zea mays
  unsure at all n locations
  Clone ID: LIB3066-047-Q1-K1-H7
gcgccaccacctgcatccgtgcgcctgtcgctctcgctggtggtgctcctcctactccggctgctcccggggcgggcggcctccttttccacctgctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtacgagcagctgagtatgttaagcagcaccttttcagcattttaatcaaacacccaaagttcatcactgatgccaaagctgctatcgncgaaactta

SEQ ID NO: 43860 - DNA, 370 bp, Zea mays
  Clone ID: LIB3066-047-Q1-K1-G10
acccaaaaaaaaacacaaaagctctataatgcctgcactaaacaaacaagacggggctagggcacgcttaacaatgggcacgcgatccctatgaggatattctgcgcgcttggtcactctagacatcctgaacatgtcaaccatagcattagaatgctgcaatcaatatctaacaatgcttgcaaaccagatgaaacaatggataagcactactacgtagatattactctttacaaaacatgggattatacaaaaagcctacagcttttggaaagatgcttatagatccaacatgactggagacaagccataactttgcaaaggctccctgaataaaaaaccaaaagagatggtctcattggcatggcta

SEQ ID NO: 43861 - DNA, 354 bp, Zea mays
  Clone ID: LIB3066-047-Q1-K1-G11
ggacaggcgctggtgatcggcatctacgacgagcccatgacccctggacagtgcagcatgggggttgagaggctcggggactacctcgtagagcaaggcctgtgattgaatgcataccaacaacgacaccaacgccaacattaattaattagtagtctccatgccctgggattgcgcgtaggctctacgttcaacaccacccatccttcgttcggcattttttcccccttggttatataattacattgtatcgttttggcaaatcattttgtgattcgaccccaaagcaagtttggttgtcttacgatttgtaaacctggaacaatatataatgtgattgaactgctttgtctc

SEQ ID NO: 43862 - DNA, 374 bp, Zea mays
  Clone ID: LIB3066-047-Q1-K1-G12
cggacgcgtgggcggacgcgtgggatacgaacgtcgtacgagaacctttctcccggctccagctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacct

SEQ ID NO: 43863 - DNA, 350 bp, Zea mays
  Clone ID: LIB3066-047-Q1-K1-G2
ggagcccgacgcacctgtggttctgcacctgggcgttcctcctggggtcgctggcgagctacgtggcgctctggctggccctggacgtggcgctggccctggccgcgcagcgcctgcgccggcgcctggcggttccgctgggccccatgcccgcggcgcacgcgctgctgatggccggcgcgtcgtccgccatcttcgcggggacgctgctgtcggcggtggccgagatacgggacacgcggtggtcgtggcgacgccgaagccgcagcaccccgttgcggagactcctgtgcttcccggccgggacacgctcctcaggccgcagtctttttctgggcctacgcctacta

SEQ ID NO: 43864 - DNA, 341 bp, Zea mays
  Clone ID: LIB3066-047-Q1-K1-G3
aattcctggagcgacccactcctcgcacgcgtttctatactgatcaagttttatcttttattccatcaacatctacaacggtggtttatactgatcctatgacgactctgataaacatttagttacaatacattatcaacacttctctttctccttcaacaactctgagaattacatcatgaaaggtataataaacctccaagaaaagcaaatgaagaactttacgatacactatgcggacggtaatcttctatgactaattatatcctccactttcacttaccactctcttcgactaacttttgaacatagatatccattgcaaatccaaacctaaaatc

SEQ ID NO: 43865 - DNA, 230 bp, Zea mays
  Clone ID: LIB3066-047-Q1-K1-G5
aggacgcgtgggcggacacatgggtcagacgctgccaatggaggcccatatggcactggggagacagacagtactaatgctgctcatgctgcatgtgcatctaggaacgacaatacttgaactgagactgctctcatacccgacggcgacttactgcgtagggatcttaacttgacaggcgattgcaaggaccacgtgaccatacaactgtactgtgacttggtcttaaa

SEQ ID NO: 43866 - DNA, 373 bp, Zea mays
  Clone ID: LIB3066-047-Q1-K1-G6
acgcatgcgtccaagagcccgactcacctgtggttatgcacctgggcgttcctcctgtggtcatgggcgacctacttggcgctatggctggccctacacctagcgctggccctggccgcgcagcgcctgcgcctgcgcctgacggttccgctgagcaccatgcccgcggcgcacgcgctgctgatggccagcgcgtcaaccgccatctttaccgggacgatgctgtcggcggtggccgatatacgggacacgccgtggacatggcgacgccgaagccgcagcagcccgctgcggacactgctgtgcttccctgcccggacacgctcctcaggccgcagctttttctgggcctacgcctactacctggcccgct

SEQ ID NO: 43867 - DNA, 436 bp, Zea mays
  Clone ID: LIB3066-047-Q1-K1-G7
cccacgcgtccgagacggagcaagaaccacctccggctccggcgccaccgccaccggcacagcagcggcggcaccatacgaggcggagaagcaggaggtgatcaagcagtgggcacaggtcgctgacgccttcagcgcctctgaagcttacaacagcaggttgaggcagacgcttgacgccaagcagctcaagactggaatgatgcacaaggggaaggtgaacagggtggacttctcagggccgctgctgtcgcagccccggcgcatcgacgagctcctgcacatccacgagcagcagatccggcaagctggtcgccggccatggttcatgaaaggcaccgaggaggaggagcactgatggcagagacacggcatggacacaactaaacgcccatcagatttgcacgtacttaccacagagcaggagaagatgctg

SEQ ID NO: 43868 - DNA, 97 bp, Zea mays
  Clone ID: LIB3066-047-Q1-K1-G8
cccacgcgtccgatccattcattgtatttgctttgccatttctcccctttctgttagtggcgatatgtaaagaggggagaatgggagacactattcg

SEQ ID NO: 43869 - DNA, 171 bp, Zea mays
  Clone ID: LIB3066-047-Q1-K1-G9
gttgaaagcagatgtgacagccgttttaacgttcgtcttcactccagatccaattgcaaacgcgaactatcatgggggtgctcctctgcatgatattgcaaagcaaattgctacatacaatgctaccagcccatcatcactgcaacacaaggcacggacgacaactactac

SEQ ID NO: 43870 - DNA, 413 bp, Zea mays
  Clone ID: LIB3066-047-Q1-K1-H1
gccgacaaagaagcaaacattcgccgcctcctgctgccgcaacctctcaaccgtgagcagtcagcgctgtacgggatcctcagcttgtaaaaaacacgcacacacacgcatggctcatccatccatccatccatgctacatttgcagtcatttgctgttattttccaatcctggttagttcttgtaagctaaccccgcatccgataagctaatcctgtaaatggcgcaaggagcatcagctctggactgctcctgttgtagagaaaaaaaaatactacagcttagagttggggaaggagggcaatctggaaattcatccaaagctttgtggcgtaacttgattatatatgtacttttgtaaaacctaccagttgtggttcaaatccaccggctactaactaactagcctatgc

SEQ ID NO: 43871 - DNA, 318 bp, Zea mays
  Clone ID: LIB3066-047-Q1-K1-H10
cccacgcgtccgctcagaggtgctgtgtcaacgatttgcgctgatgatcgggaagggggtcttatcatcagcgggaagtggacaaactaccatgaaatactcatcaggaactcgtatacggtctattcggtatagccgcaggactagctggtggactacttgctcttggaggtggcttcattatggggccactgctcttggaacttggcatccctacacacatttcaagtgctacagctacctttgcaatgatgttctcatctaccatgtccgctgtcgaatactacctatggaaccagtttccagtgccttatgctg

SEQ ID NO: 43872 - DNA, 375 bp, Zea mays
  unsure at all n locations
  Clone ID: LIB3066-047-Q1-K1-H11
ggccatggccgccgccgagccgccgtcgccctccgggatgggcttcttcggcatgctcaggttccgccgcagcgccaccgccgtcgcctccttcgacccggcgcaggacgatgagctcctcgcgctcgacgccctccagtcccacgttgccgcccgcctccaggcgctctccgcgcacgccacccctggccctggctccccgtcgctcctcaccctccctttcctctcggagctcctcgacgccgtcgtctcctctgacgacgccttccgcggagtgctcgcgctggccccagtcgccgncgcgatcgccaggccccccgccgaccgcctcgccggcgacctcctcgaccgcgccgtcaagacgctcgacgttct

SEQ ID NO: 43873 - DNA, 370 bp, Zea mays
  Clone ID: LIB3066-047-Q1-K1-H12
cgtacgagtcacgccacgcgtacgactggactccctggtggtaaaaatgctgagccactgaaagttggtataagggggcatgacctacagatgtgcactcttttccaggcacaaataaatggaaactggtatttcacagtaatagagactctaccatcagctacttcatactcaccaaatggagaactgcaacccacattacagaaaatgcggattcttgttggacaaccactaaagcagcctgcaaattacattagtggggatttcatgattcctgtgatggcaggtgctgattcaacacccgactatggatttgagtcattttttgaagatcaagattgctgcaaaggtttgagtggatttctaatat

SEQ ID NO: 43874 - DNA, 397 bp, Zea mays
  Clone ID: LIB3066-047-Q1-K1-H2
cccacgcgtccgtagagatgccgtctgcgtccgcggcggcatcggcgccggcgtcagcgcccccgctataaatccgtcgcacccgcccacccacctgccgtgccagtgctctcatctgcgtacacggtctccctcttcctgtcagtagtagagtgagagtgaggcagcgagtgggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctaagggagatgcgcatcgcgcac

SEQ ID NO: 43875 - DNA, 455 bp, Zea mays
  unsure at all n locations
  Clone ID: LIB3066-047-Q1-K1-H4
tcgtcgtcaatggtgaccggcgcctcgggtgacagtccccaacatcggacggcgatccatcatgggcgacnntcgtctcggggtcaccgatcatccagacaccgtcatcnnggcgtcgtgcgacgacctgcatcgtccatcaggcccccgggactctccaaggntgaacatcactcggcgtgacccctgcggccccggccacggcgatcagcatncgtgcagcctagggccggtacaatggatgagaaggacgtcacttgatatcaaccgtcaagggactgcacgcttaagaagacgtgccaatgggcgtccgcatcaaggcattatgaggacgctgcctccgtgcctcaaccgcctgcaagaatccactttatgagaatatcaagaatggagggaactcgggcctaccccatcatcatncgacatgnaagtacttgccccaacaaggttatgca

SEQ ID NO: 43876 - DNA, 293 bp, Zea mays
  Clone ID: LIB3066-047-Q1-K1-G1
atcattctgtcttcgcacatttttttttttttatgcaataaagatatacaagggtggtgtcttctgctcctgggtctgctcattctgacatttgcatttcaatatgtcatcaatactgctcgatctagtgtgagaaccaagggaaatttatattgaaaggtttatgaaacataccgacactgggaaatgacgaactatcatagacgtttacggtcgggagtcttccatgctgaactctatcatgcacttggactttggacttaatgcggatgatctacgactagagttatcta

SEQ ID NO: 43877 - DNA, 392 bp, Zea mays
  unsure at all n locations
  Clone ID: LIB3066-047-Q1-K1-H5
cccacgcgtccgctcacgcgatcgcccacgcgtccagatccaattcgcgagttctggctgctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaggtccgctggtgctcctgcaacatcttctccacgcaggaccacgccgncgncgncatcgcgcgcgactcggccgtcgtgttcg

SEQ ID NO: 43878 - DNA, 331 bp, Zea mays
  Clone ID: LIB3066-047-Q1-K1-H6
atcaacttgcgcaccatacacagcttgtgttatcgcataccagccgtttacacaggagggcctttctgtaaacttgtaactgggttgaacttttaaggaaaagataattttggtgctgtgattgatttcactgtgaagagtgaaatgaggctaagtattgggcaagtccatcggaatgtccttgtactggcatcttctttgtcatgttttgttctgagagatcgtgtttccttcaggatgctgtaccaaccattggtagctggattttatcaaactgcttgccgggaaaacccatatttggaccaaatcaagggaataccattgactcttg

SEQ ID NO: 43879 - DNA, 383 bp, Zea mays
  Clone ID: LIB3066-047-Q1-K1-E2
cccacgcgtccgatcaaattcttgttgggatatattcctccaattcccctcctccgcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcggg

SEQ ID NO: 43880 - DNA, 384 bp, Zea mays
  Clone ID: LIB3066-047-Q1-K1-E4
catgcatgaagaacgaccaaccaatttaattaattaaggagtgtgtgcagtggatgggcatgccacgacacgacgtaccacgacgactgagtccctggcggagagcgcgaggacgtcggagcaggacacgactgcgccaccgcactccttctggaggcggtcgtggatgtcgctgatggacttgaacgcggtggggcgcaacgtgaggttgggcggcgcctgctgctcgcccgggccggtggctgagccgtacaggagcacggacgcgttgcagccctggacgaagcagtcgtggaagtggatgcggatgacgccggcggcgaagacggcgtacatgcgcacggtgtactgcacgaacctacgcacgacggacttcgacctggg

SEQ ID NO: 43881 - DNA, 436 bp, Zea mays
  Clone ID: LIB3066-047-Q1-K1-E5
cgaggagatgcatgacgccgagttaggttgcagtttgaagaccaatgggccaggagtagcctacttctactgggttacaagagagcaaggctccttcgagtggttcaaaggtgttatgaactacgttgccgatagtgatcgcgacgatgtaatcgagatgcgcaattacctgaccagcgtgtacgaggaaggcgacaccaggtcagccctgattgccatggtccaatcacttcagcatgctaagaatggcgtggatatcgactcatgcagcaagattcgaacgcattttgcaaggccaaactggagaaaagtgttctctgattcggccaatgcccacaagaactcacgcatcggcgttttctactgtggatcttcaacactgaccaagaccctgagagatctttcgatagagttcagcagtaccacgacgactcgg

SEQ ID NO: 43882 - DNA, 376 bp, Zea mays
  unsure at all n locations
  Clone ID: LIB3066-047-Q1-K1-E6
tgaccatccaggtggatggcaatctgctggcgaccacggacctaagccagtacaaggaagatggtaattggatcgagattctacgcgtggataacctggtcatcaccggcaagggaaaccttgacgggcagggcccagccgtgtggagcaagaactcctgcaccaagaagtacgactgcaagatccttaccaactcgctggtgatggacttcgtgaacaacggggaggtgtccgggatcacgctgctcaactccaagttctttcacatgaacatgtaccagtgcaagaacatgctgatcaaggacgtgaccgtgacggcgcccggggacagtcccaacacggatggcatncacatgggcgacttattcgggatcac

SEQ ID NO: 43883 - DNA, 398 bp, Zea mays
  Clone ID: LIB3066-047-Q1-K1-E7
cccacgcgttcgctcacacgtccgcacacgcgtccgcccactcgttcgcccacacggccgatctttccatttccctatctgccactatacaattcgcgagttcttccttctctgccgccatggcgctctatgtggacaacacctcgtatggacgggagtacaacgtccaggatctctagcaagcgcacttagctcgccttgagattgatctggcccaggtcgaaatgcccgaactcatggcctgccccgcccagtttggcccgtccaagccctttgccggcgctaggatctccgcgtctcttcacatgaccattcacaccggcgaactgatcgagacccttaccgcgctcgatgccgaggtccgttggtgctcctgcaacatcttcttcacacaggac

SEQ ID NO: 43884 - DNA, 383 bp, Zea mays
  Clone ID: LIB3066-047-Q1-K1-E8
cacaaaccacgcagcggaggcgacccacaaaaaacacgcgcggcaggaggaaggcgaggaagcatccccttgttcaattgaccccaccaccgcccgctgctgcttcgtttctagctcgagagagtttagtgggttgcttgattccgaagctccgagctcgtgggattgaattgagcccccccaagatcagaattggagcagcgggttttggtttcctgcttggtgccgctgattggagtacgcttcttttgtggtggttgagaggctgctcggcttccgccgaccatgtccgtgccggcgatagccgtgtacaccagcccgcccggcgccgtctacgcgccgtcggagctcgagtccagctcgcgcggctcggcgccgtgcgc

SEQ ID NO: 43885 - DNA, 64 bp, Zea mays
  Clone ID: LIB3066-047-Q1-K1-E9
gttgtaatagtgattcaatcaatgtatctcgctttcaggtgcccatcaaggatgcgacagggtc

SEQ ID NO: 43886 - DNA, 301 bp, Zea mays
  Clone ID: LIB3066-047-Q1-K1-F1
ttaattcctggaggacccactcgtccgattcaaagtctagtagaattcccttctattcatcccgctgtgcctcatcaaggtagatcaattcaaaagtatttgctgcccatactcctatttcatctccgtctaacaataccacaactatctcttctattactaaaccccctaatttatatcatatatctactcatcagttccactaatcaacttatcttttaattacaacaatctattccgactcattcttaacacttacacatctttcctcacttatcaaatctactccgtccaatttttt

SEQ ID NO: 43887 - DNA, 345 bp, Zea mays
  Clone ID: LIB3066-047-Q1-K1-F10
gctctcgctctctgagtgacaagctcagaaattaaaatcgcttattagtcatatagggaatggtcacgtaggaatcttgcatgctagacaagaactcacaccatcaatacacacgaccaactggtaatggtagcggcctccttaattaccggcatgatgtgcttaaagaatgattattatttcaatcatactgtgcaccactacctggacaaattgctacctgagcacaagacatacattctcaagactgttgcatgatgctatcttgaactagcaagacatcactatggctcctgcgtcctgacgataatggttggtcattcaactgatgaacacagaaacaac

SEQ ID NO: 43888 - DNA, 406 bp, Zea mays
  Clone ID: LIB3066-047-Q1-K1-F12
ggcgtttcttggattagtcctggaaggtcaaacggttgttggaagcctcgctgggggctggaacgaacgcgaaggtgttgctgtcatttagagcgtcttgattggatttgacctgttggcctggtggcgtgccgtcgttgattgagctcgaggatgatcaagtgggggctcagcagcggcacgcccgctgattcctactacgaggtccggtcagattgcacggaccgtgtgcccaagagcaagttcaagattaacgctggcaaaacattaagtgctcggaaatggcaagctgcatttagtcctgatggctgtcttgatattgcctcagtcctaagcaagatacagagaggaggtgtccattcaacagtcagatgagaggtttcgggactcttacttggctgttttg

SEQ ID NO: 43889 - DNA, 402 bp, Zea mays
  Clone ID: LIB3066-047-Q1-K1-F2
cccacgcgtccggatgctattcaaataggtacgatcttgatatatcttattggaaggtactacatactacatcatattatacatttaatcttattttctttagcctagtaggcctcatgttttagtttcgtacagggtctcgaattttctcgggacggccctggtaccaggcggtggtggcgcggggttggtgcagcgacgacctctttctcttctccaaggcacgcaacagtgatggtaagtcactcgggctcgggccacaaatgggaggaagcgaggagtcaaggagggaacatggtggagaatggaagtcgatgagaagggaagggacgccgcctcggcagtaggggcaggcgcctaccttggcatgacgacggaagccacaatggatggtgtcgcttg

SEQ ID NO: 43890 - DNA, 266 bp, Zea mays
  Clone ID: LIB3066-047-Q1-K1-F3
catgcaattactttacctgctaatactataactccagctactatacacactacttcttctgcatttactattaaaaaaaccccaaatttaaagcattatacatatccgattaccgacaatggataatagcttttaaacacaatgaatctactttgactacccttactattgtacattttggataactcatagaaccacatactcttgattatttacaaaaacttaattctatccaaaacatgtactctaaatctgcaaaacttttc

SEQ ID NO: 43891 - DNA, 398 bp, Zea mays
  Clone ID: LIB3066-047-Q1-K1-F4
catccatcaaataaacaagcgcacacgaacaaatacctcgccgccaataatggccgccagatcctccattgtgctcgccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccccctttgcatccgctttgctgtcaagtctggtggctaccgcatcgccgacgacgtcatccccgccgatttcaaagctggcaccacttattagacga

SEQ ID NO: 43892 - DNA, 426 bp, Zea mays
  Clone ID: LIB3066-047-Q1-K1-F5
aattgactccacaatcaagacaatacaatgctgaaaatggacggcgacatggcactgcggaacaagcaattcctagtcctgctgatactgttagtccagctaggaaggacaatacttcaactgcgtatgctctcaaagaagcccgtgatttaaagcataaggctaatcgtttgaaggaagaaggaaaagagcttgaaagtacaagactctactttgactccgccttaaaatttttgcatgttgcatcacttttggaacctcctagttttgatggtttgaaacaaggcgatgcagcccagagcatgtattcagatactgcaaaactttgcaactttgctggtcacgcgtatgaaaaatgcaagaagatggctgctgctgctttagcatacaagtgtgttgaagttgcttatctgaaggctgcatact

SEQ ID NO: 43893 - DNA, 384 bp, Zea mays
  Clone ID: LIB3066-047-Q1-K1-F7
taattccgggagccacccattcgtgcttacattcgttctaatcatctatttttttttgatacacgatccccaatattacacggatcgttcattcaagttcctggtctgccaaatctataactccagttactatacacactacttcttcttcatctactattataacaacctcaactttaaagcaaaatgcttatcatattacctacaatggaaacgtactttcaatcacaagactctactttgactatttattaatattgtaccatttcgtacaattcatataaccacatactcctgattatttacaactacttatatctatccaaaacatgtactcaaaatcttcaaaactttgcaactttgttcgtcatacatcatccaaac

SEQ ID NO: 43894 - DNA, 350 bp, Zea mays
  Clone ID: LIB3066-047-Q1-K1-F8
gcgggcaaatggcaggctccgccgtcctgaggagccccctgtccgtcctcctctacatggtgggcgtcgtgcccgccacggccgcggctacgccgaccgacgccgccatcgacgaggcgtacgcgcatgtggtcaacctcaccgctaaccaggagtactgggcggagcgcgctgaggctgcgcacgcgtacaaccgcgcggtgtaccagaccgaccccgtggccgtcgtgcaacgcttcaacgacggcgtgcacagggcgacggcgacgcggtcgcggtccctggcgcacagggcgcggcgcccctgcacggacaccaacctcatcgaccagtgctggcggtgccgacgc

SEQ ID NO: 43895 - DNA, 375 bp, Zea mays
  Clone ID: LIB3066-047-Q1-K1-E12
cccacgcgtccgcccacgcgtccgcccacgcgtccgaaactcttgaagcagtatggtgtcggtgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaagcgcagacaaagagaccaccaatgaccaaaactcctaattacctcctgtagggatccctcatgcgtgtgttttcttc

SEQ ID NO: 43896 - DNA, 352 bp, Zea mays
  Clone ID: LIB3066-047-Q1-K1-F9
gtcatgttgcaggtgtgatttgccaggaagacggggcgaattcgtggtgctacctgaaagggaccccatctggtgcggttctggggttcgaggagcggcgaggcaggtgggaaatgagggatgtggtcgtggttgacgaagattgcgtccgcgtgcttgggcccggtccggaggtgcgcgcgtacgaggaaggatgaggacgacagcgataatggccgcggcgtcaccgacgacctgctgtggtcgcgggacctcgggcgccacgcggcgggtcagttctcgtttgccgacatgcatgccaacgaggcgtttgaggaccacagccacattgagacaggctcttccgcaactt

SEQ ID NO: 43897 - DNA, 293 bp, Zea mays
  Clone ID: LIB3066-043-Q1-K1-H5
cccacgcgtccgcccacgcgtccgcgcgtccctcgctcctgcgccgcccgtccgatccggtcaccggccggggagggctcagaaacctttcatccaatacatacatctatctgagccctttcccgcggtgaggcccgaccggagtccacacacacacacacacggtgtcgatggcggccgtaataaggagccgccgcgtgtccgttgtcttctacgtcgtcctcgccgcagctgcagccgcggcgcaggcatccaataacgtcaccttcgacgaggattactgggcggagcgc

SEQ ID NO: 43898 - DNA, 285 bp, Zea mays
  Clone ID: LIB3066-043-Q1-K1-H6
cccacgcgtccgcccacgcgtccggtacgccggcgtccctgctagtgcctgccgttgaactgtccgggcaccattgatccgacctcccctaagccatcgatgagtagagaaaaacagtgaacgccacctctgtactcgccccaccttatggcgcgtcgctcctgcagtaccggcccacgctctgcgcggcgctcaggtgttacggctgccctcaaatccgtcgtcggaccattggcactggggcaagcaaaagcacggacaggtgctcggcgtgctgcaacggct

SEQ ID NO: 43899 - DNA, 133 bp, Zea mays
  Clone ID: LIB3066-043-Q1-K1-H7
cggacgcgtgggtttctggcgggcaatcgcttcacgccggcacggaggccctggcggctcaggccgttgactctacacgctggagcaagctcggcactgttggcgtaagcctcgacgctttcacgtggccttg

SEQ ID NO: 43900 - DNA, 252 bp, Zea mays
  Clone ID: LIB3066-043-Q1-K1-H8
gtcacgcgtccgagcgggtcttgtccgcgccacaggataccaattgttgcgctgggaatattcagttacgatgacccgctttagttcagttttttttttgggggggttggttcgatcatttggctgtagcgtgaatcgcatggacaacagacttcaattactaagcaaatatttttcttctgcatatatttgaagaaccttgttcaggcctccctttcgaaatgaaatgccggaaatttttttcttgttaaa

SEQ ID NO: 43901 - DNA, 281 bp, Zea mays
  Clone ID: LIB3066-043-Q1-K1-H9
tcatctgacagcaagttggtacgtgtcctcgcgcgttcgattggacgatccagcccacggcacacggacatacgtgctgcctctgaggagcatgaacgacgatcatccatccacctgacgaagacaccatcaatacgacgaacatggcgatgaggtcgctagcactactggtcctactaatcctgatggtagtaggacgtggctcagacgatgctgtcataaatagagcagagagcctgctgatgcgattgccattactatggatcatgatccgccgaagg

SEQ ID NO: 43902 - DNA, 152 bp, Zea mays
  Clone ID: LIB3066-044-Q1-K1-A10
gtctagttcggtgttgtgtatggaacggtcgtcactgagtcatgcacgatttggtatccgtgtgtttatgttcgccggtttgaggaactctctgatccgtcgtgacacaaagttgatgctgagagaacgaccgagtattttttttttctgcc

SEQ ID NO: 43903 - DNA, 463 bp, Zea mays
  Clone ID: LIB3066-044-Q1-K1-A11
cccacgcgtccgcccacgcgtccgcccacgcgtccgcccacgcgtccgctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgctt

SEQ ID NO: 43904 - DNA, 462 bp, Zea mays
  Clone ID: LIB3066-044-Q1-K1-A12
gcaaaagccatcgtttgaattgtctggaaagcttgctgaggagaccaacagagttgcaggtgtaaatctattatattcagaacccccagaggctcgaaagtcagagattagatggaggctctatgtatttaaagatggtgaaccactgaatgaaccactgtatgttcatcggatgacctgctacctttttggaagagaaaggaaagttgcagatgtccccacagatcatccctcctgcagcaagcaacatgcagttcttcaatacagacttgtggagaaggagcaactagatggcatgatgacaaagaaaataaggccttatctgatggatcttgatagtacaaatggaactttcatcaatggaaatcgcattgagcctcggcgatattatgagttatttgaaaaggacacaatcaagtttggcaatagtagccgggagtatgttttgctccacgaaaattc

SEQ ID NO: 43905 - DNA, 88 bp, Zea mays
  Clone ID: LIB3066-044-Q1-K1-A2
gacgtccatagttgctgtataaggcatgatttgccatcattctgttgcttcggtgatgcttgcaatgcaatgagaatgtgttggaacg

SEQ ID NO: 43906 - DNA, 417 bp, Zea mays
  Clone ID: LIB3066-044-Q1-K1-A3
gcaactagcacgccagatgcaaacctatcaaatgagaatgtcattagtggcataactcctgatatcatggaaaaccatcttgctgaaatgcagtatcagaagttacctcggaattttgtgcagtgggttaatcacggtgataccttttggtactaagatcgcaattactggaattcaatatgtcgccagcttcacagggtgggcattaacacggatctgagtagtagattatagagtgatatggatgctgcggcaaggcatttctcccgtgatatactccgcaccatccccaaagtcctttattggtccacgtgtttttacaatgggtgagtagatagatatctttctgttgaaagaaaatagagatgataattaggcttattattgttgacctgaaattgtcattattcatgggga

SEQ ID NO: 43907 - DNA, 207 bp, Zea mays
  unsure at all n locations
  Clone ID: LIB3066-044-Q1-K1-A4
cacaatagtaccctgttgaggaactttgtggtcacttcttttctgatttggacttcggttgctcgcgatcgatgganggctggtactaatctttggagggatattaattccaactgggcttcaggtggcctgaaaaccagggttaccaaaccgccaggtaaatttggaccattaggaaggggtggaatggattaaaccgggccaagt

SEQ ID NO: 43908 - DNA, 372 bp, Zea mays
  Clone ID: LIB3066-044-Q1-K1-A5
gcggaccgggccgggagaaacaaaactgacaaggacgatatggtgcgtagcctcgtcgcgctgatcctcgtcgccacggccgtagccgacgtggccacagccgcaccctcgccggggtttgtcgtcaccggccgcgtctactgcgacaactgccgcgccgggttcgagaccaacgtctcccacgccatcgaaggcgcgacggtggagatggagtgccgtcacttcgagtcgcaggaggtccacgacaaggcggaggcgacgacggacgccggcgggtggtacaggatggagatcagcggtgaccaccaggacgagatctgccaagtgctgctgctcaagagccccgaagcggactgcgccgagatcgagcgc

SEQ ID NO: 43909 - DNA, 191 bp, Zea mays
  Clone ID: LIB3066-044-Q1-K1-A6
cccacgcgttcgctgcgaagaagaccgacgacgtgccctaccggcgtgcccccgtcgtcctgccgtccgttgatcgatctggccatggcacaacactgagatcctcgtcgtcgtgagccgaacgttaatccggcggacgcgggggcggggccattgctgcggcggcagctatgaggacaatcacgtacgcc

SEQ ID NO: 43910 - DNA, 346 bp, Zea mays
  Clone ID: LIB3066-043-Q1-K1-H3
cacaaggttgcttatggattatttgaatgattatgcttatgacgcgcaagttgctggcctctattatgttgttaagccaaatgacactggttttcaggtaactatggttggcttcaatgacaaaatgagaacccttttggagactgttattggaaaaattgcagaatttgaagttaaggctgaccgtttttctgtgataaaggaagctatgacaaaggagtatgagaatttcaagtttcggcagccataccaacaagtcctatattattgttcgctaatactggaggaccaaacatggccatgggatgaggaattttctgcactttctcaccttgaagctagtgat

SEQ ID NO: 43911 - DNA, 439 bp, Zea mays
  Clone ID: LIB3066-044-Q1-K1-A8
cccacgcgtccggatacatctccccttctcacccaaccctccaagcaacattgaccgcaaagggccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgg

SEQ ID NO: 43912 - DNA, 463 bp, Zea mays
  Clone ID: LIB3066-044-Q1-K1-A9
cccacgcgtccgcccacgcgtccgatctccagactccaaccagcgctcctccctccccgtgctttcctcctcccttcagccatcgcagtcgcaggttcttggctggttgctggtgtcgacagcaaagtccgcaactccatcctgcctgcgctcctcccgtcctccgtcctcactcagcacccgcgcacgccgcctgcctgtcgattgagatctctttcacgcccctttctgccatcgcacaactgagccgcagctagtaacatccattttgctggtcagtaagtcgtgggaggaagaagatggattatttgaaggtgcaggtggtagagtcatcatttgtagtgccgagcgagccgacgccaacgaaggcgctctggctctcttgcttggacatggttcagtccaacaaagcccacaccccaactatccacttgtacagctccaacgatgctgcggcggctga

SEQ ID NO: 43913 - DNA, 408 bp, Zea mays
  Clone ID: LIB3066-044-Q1-K1-B11
gataatggcataaaaaaaaaaaataaaaaattaaaaaaacaagacaaccatataaagaaagcgcaaacttacaaacacatacatgcaaccccgtcgctctactatacccacactctaaaacccattcattcgacgtcttaacacaactttggtactgccaaaacccagtcgactccccacttatttacaccgcagcaaatgcgaaaaccttcagcttacccaatttaaaacattccctgccaaaccccctttcccaacatttactcatcctgaatagcccatgacacaccccctttaccaacacattaaccccctcaatgtgcaaatggtacgcgccctgtaaccgctacattagcccgcggcctatcgcgctttccctcagctttaccgctacccttgctagccact

SEQ ID NO: 43914 - DNA, 446 bp, Zea mays
  unsure at all n locations
  Clone ID: LIB3066-043-Q1-K1-G1
gagccatccccaggctcttgcgcaatgtgaacacacattaacaggactaggaattgaacatagagaggctgttgacgacactgctggtgcagcaaagattgttgcagaacatatggtccaggatactggtgctattgctagttcattggctgctaaactctatggattggatgttcttgctgagaatattcaggatggcaaaaataatgtcacccgtttatgatgctagctcgaaaacccaacattcttcgcaatgatagaccatttaagacaagcatagtcttttcactagaagaaggacatggacaactctntagggcgcttggtgtattcgcacagaggaaaatcaacctcacaaagatcgaaagtcgtccacacaaggagaggcctcttcgagtatctgatgactgttccttactcttaaaagattttgattacctctttta

SEQ ID NO: 43915 - DNA, 240 bp, Zea mays
  Clone ID: LIB3066-043-Q1-K1-G10
cccacgcgtccgacaagctcttttaaaaccatccgctttgtaatttggcgccaattgagggtgtcattaacggtgttcgattattaatcgatccagtttggccccacaactagaaaaggaaaaaatgcacacatcttatccttgctacttctaggatcttttcatatgtcttaatttcaatcgagggcgaggccagaagaagccaaattattgcaaatactcgttaagccttgtttagtt

SEQ ID NO: 43916 - DNA, 415 bp, Zea mays
  unsure at all n locations
  Clone ID: LIB3066-043-Q1-K1-G11
cccacgcgtccgcccacgcgtccgcggacgcgtgggtttttccatcggtccatcgaaccacgattcccacgctatagtttttgtacacaagcaggatcattttaagaagatatatgtcaacaacaaccgctacattacgacagccaccaccatgagcaaccggtgctctggatcagaccaaaaaactagagttcttcaatgtttcgacaggtctggcgaaccacaaacacaaggatgttttttcatggttccttattgtgccctttcgggcacgatgagcatcctcctgcactagtcggctgtccagctctgctccacaatctcgcggactttgcggntgtactcccgctggttctcgctgaacagtcttgcggcttctgagtttgcaagggagttccggtttggatcacacagc

SEQ ID NO: 43917 - DNA, 417 bp, Zea mays
  Clone ID: LIB3066-043-Q1-K1-G12
cccacgcgtccggtcttcagagccatccgctggaggagatctatttgcacagcaattctcgctattgactacagacaagaagttagaattgtctgagcaaaagagctatacttccgtagcaaatggtatgtctggtgtgctcgagctttcagaggcatcgattgaatcatctggtgcaaaagctgctgcatgtggaactctttcggttctttcctcaatgtcaaataaagtttacaatgaccaaggaactccagcagcattcagagttcctgcaggtgctgtgattccttttggatccatggaggacgccttgaagaaaagtggatcaatcaaatcctacactaatcttctagagaggatcgaaacagctcaaattgaaaatggtgaacttgatagcctatcctcgaagcttcaagc

SEQ ID NO: 43918 - DNA, 303 bp, Zea mays
  Clone ID: LIB3066-043-Q1-K1-G2
agaggctcttgcattcaaccctgattatcagtagccaaagttcaatttcagccggtgattggcttcattgacatggagattttttccccacctgatgtcagtgcaaaaagtcaccaactccgattgctagctgtaaataactgccttacctgaagatactccattcctctgattaaaagctggtgacggtgtcattaagggtagaaaagaacgagcttgtgaaggtcaaatttctgcgaagccatggatttctgtgcttacaatatgttgttttcaatcggactttccttcctttttcttgtc

SEQ ID NO: 43919 - DNA, 376 bp, Zea mays
  unsure at all n locations
  Clone ID: LIB3066-043-Q1-K1-G3
ctgatgctccggcggcggcggcctcatccggtccctctagcgcaccagcgccatcgtcgtcgtctgagtcctccgccgcaccaggcccatcttctgatggcacctccagcgccccagcaccatcgtccggcgacgattctgattccgacgacgatgggtcagcttgagcctgaccgatgacgcgggtttgggttaccggtgccactcaaaatacgatcccttttattgtaaaagagggatcccttctttccattgcattcttgcaatccgtttcttcttgactatgtttcttcttgactatgtaacgataataacatgagataattatctgaatgacattatatnttttctaaaaaaaaaaaaaaataataattat

SEQ ID NO: 43920 - DNA, 442 bp, Zea mays
  unsure at all n locations
  Clone ID: LIB3066-043-Q1-K1-G4
tctgatccaaataagttgtctgatatgaaagaaaatgatttcagtagcaacagaaatgtctttggttactctggaaatacgagggatgatatgttgccactttcaagtacttccgaggaatctcgctttatgaaaatggagaacaataattcccggaaaacaggaagttctgttgctgctctcaaagaactttgcactgttgagggatataacttagtttttcaagcctgtccatcttcagcagatggtttagttgggaaagaatcttatgctcaggtacaagttggtggacaaattctaggcaaaggagttgggttaacatgggaagaggccaagctccaggctgctgctgaggctcttggaactttaagatccatgctatgtcaacttggtcataaacgatctggctctncaggtcattggcaccaaattttaacaagcg

SEQ ID NO: 43921 - DNA, 439 bp, Zea mays
  Clone ID: LIB3066-043-Q1-K1-G5
atcaaatccacggtttaataacgaaccgtgttaacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaagattataaatggacttactacaccccggagtacgaaacccaagatactgatatcttggcagcattccgagtaac

SEQ ID NO: 43922 - DNA, 342 bp, Zea mays
  Clone ID: LIB3066-043-Q1-K1-G6
atctgagttaaaggagtacttatgctggtgagactgcaacatcaaagaaaaagagaagaactcctgcgtggtgtgacagaatattgtggcgtggtgatgggattgtacagttatcctactaccgcggggagtctagattttctgatcaccgttctgtttgtggaaccttcgctgttgaggttgaggtgcgaaacaagaagacaaacaggcgctcatcaaatgctgacatgagaattgatgctgaagagctcttacccacgggcaagggtaaaagagatgagaatcatgttgcacgcgaggaggataggctagtattgcagccggactcgcagatgccgtacg

SEQ ID NO: 43923 - DNA, 392 bp, Zea mays
  Clone ID: LIB3066-043-Q1-K1-G7
cggacgcgtgggccggcgctgccgccccacgtttggtgctcaggtcttcgtggggcccttagccggcgacgagcatcaccagctgaaagatggcgaggataccgtctctgaagagcctcaatgcgtttccacatgcggaggaacacttgctgaagaagacttactctggtgctgctgcgacaattcttgggctacttataatgattacactgtttgtacatgagctgcagtcttatctcaccacatacacagtgcatcagatgtctgtagatctaaaacgaggagagactctgcccattcatgtcaacatgtcatatgcttctatgccatgtgaagtatcgagtgtggatgcaattgacatgtctgggaaacatgaagttgatttgcataca

SEQ ID NO: 43924 - DNA, 203 bp, Zea mays
  Clone ID: LIB3066-043-Q1-K1-G8
acgctcgtctcacgctcccttcctcacacaagatatgaggaaaggtaccgcccttttactacgacatccacaaggtgcgaggggaatacacgtgcatatacgcggcggctatcatggccttggttccggtttcggtgactactaccggcgacgtcatactatgcctatgcatcgtgctctgctgtgccgctgatgacgacccg

SEQ ID NO: 43925 - DNA, 385 bp, Zea mays
  Clone ID: LIB3066-043-Q1-K1-G9
ataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaaaccagtacaaggatcatggtaaattggatcgagattctacgcg

SEQ ID NO: 43926 - DNA, 424 bp, Zea mays
  unsure at all n locations
  Clone ID: LIB3066-043-Q1-K1-H1
cacctctccaaatctcgcccatctcgagccacagggcgcggagggccgcgtacaggagaagagggggtatggagcccgccgagcgaatcgagtccgggacggcgctggggaagcggccgaggagcagggcgctgccgcggacgcccagcatggtgacggtgccgtcggcggcgaagcaggggcgccaggagcggcgcgccgtctcgctgccggctgccggcactgggacgggagccgctgccgccatgccggtgggttactgttactactacggcggctcattcgccgcggtggagacggcggccttcttgaaggcgtgcggccgatgcagccgncgnctcgggcccggccacgacaccttcatctacaggggcgaggtggcgttctgcaaccaggagtgccgggagaagcggatcgagtacga

SEQ ID NO: 43927 - DNA, 467 bp, Zea mays
  Clone ID: LIB3066-043-Q1-K1-H10
cccacgcgtccgtggggcttccacaaccggtaacactgcatttcaagataaggggtttgatgctacaggatgggaactcgcccttgttaccgcaccgagcaacacgacttcatctgcgtctgtcggtcaattgggtggtggatttgacaagctcattttggacagcctttatgatgacggggcctacaggcagaggcaacagcaacaggtgtatggttcagcagtgcctaatccattcatgtcaaatgatcctttcgtgatgtcaaaccaagttgctcccccaccatcagttcaaatggctgccatgtctcagcagcatcagcagatccccacgatgatgcaaccaaatccttttggaccacctatgcagccacaggtaggcatgggtccagcaacaaacaatccctttctggatgctggattcggggcattcccagtggcgaacaatggccatcagcaacacaacc

SEQ ID NO: 43928 - DNA, 323 bp, Zea mays
  unsure at all n locations
  Clone ID: LIB3066-043-Q1-K1-H11
ggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccgcggcggcngnctcatccggtccctctagcgcaccagcgccatcgtcgtcgtctgagtcctccgccgcaccaggcccatcttctgatggcacctgcagcgccccagcaccatcgtccggcgacgattctgattccgacgacgatgggtcagcttgagcctgaccgatgaca

SEQ ID NO: 43929 - DNA, 375 bp, Zea mays
  Clone ID: LIB3066-043-Q1-K1-H12
gcggccacgcgtccgggtcgagctgcttcggcgacagagagccgcttcggagcaagcagcaatggacgctgagcagaggcaaagttcgggtggcatgtggggttggatcgctggaagcccgacaccagcagtttagttccgtgattcatatattttacttgtaacattatatatcatttgactgacaccctctacaatttttttatttgggtacttacggcattcgtgttcattttggacccacaaagaataaggtgttctagcgatcgttatactcacaattactcaaaatgtattctttaggtttagcaagggggtgctcatgttagtcgatgtgctggttatccttttgacgctgtgctggtttggctgtcc

SEQ ID NO: 43930 - DNA, 284 bp, Zea mays
  Clone ID: LIB3066-043-Q1-K1-H2
ctcgcgccaccgtccactgcgtcacacacataataatgaatggtaccgcccttttcctacgagatccggaacgattgaggcgaacacacgtacattcacccggaggcaataatggctttgaacccggcttcggcgatgactacagcctatggcgtgctattcctacgctaccggctcacgcgtgccgcggctctcaaccggtacctctgcgattacatcatccaggggaccatgtactgtgacacctgccgaaccacggacaggagcaacgtcagcgagtacat

SEQ ID NO: 43931 - DNA, 351 bp, Zea mays
  Clone ID: LIB3066-043-Q1-K1-F9
cccacgcgtccgcccacgcgtccgcccacgcgtccgagaatgtacacggaggtaaatattgcccatacataccctggaacaaattgtattaattgtcacagattgactgcactcagaattacacagcattcttttggacatttggtgggtaaatatgaaatctctttgggaatatacctgtatatgcagtggtagagaatatcgctgttccttttatggtggatgcactggaaagggaagaattgtactctgaccagccacagcatctcttttgatcatgtctatattctgctctcagtgaaaaaagagatttcattatgtcatttaacacggaccaccatttatgtgagc

SEQ ID NO: 43932 - DNA, 317 bp, Zea mays
  Clone ID: LIB3066-043-Q1-K1-E3
gccgttgtgccctcgaactcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgc

SEQ ID NO: 43933 - DNA, 384 bp, Zea mays
  unsure at all n locations
  Clone ID: LIB3066-043-Q1-K1-E4
gattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaagctgangatgatgatgaccttgatctttttggtgatgaaact

SEQ ID NO: 43934 - DNA, 393 bp, Zea mays
  unsure at all n locations
  Clone ID: LIB3066-043-Q1-K1-E5
gtgccgagcaaggccgcgtgggtgaaggtacacaaatgagaacgaaggcggctcggagacgaatgccagtcgcgtttggcacgacaatacacaagtgtccaccggagtagctggacctctcgcaaccgcacggtaggaggacgtgcggcggtggctgcgcctgtgcatcggatttcgtttgttttctccatgaattttgcatcgcgtgttagtgctccctaatatttggggcaaaacatatgtttagtagagggatatgggtcgactcagattaagtaattagcgagccaaatgtggtatcgtcgtccggttattggtaatgtatctgctgtggtataaatgtatctgctgttggtatacattatgaaatcacattntaattntctatgtagg

SEQ ID NO: 43935 - DNA, 406 bp, Zea mays
  Clone ID: LIB3066-043-Q1-K1-E6
gctggagctatcgtggcaggaggaaagggtactgcccaggacaaaatcaaggcactcagagaggcaggtgttaccgttgtcgagtcaccagcgaagattggctctaccatgtttgaaatcttcaagcagcgtggaatggtagaatagacgatggagacattgagaaaccgcattttgatgctcatgggcaattgcgagcaattccttccatggcctcaaacaaaactaatgaggctaccttttcttacgtgccttctgtttggaagatggcctcttcacctggatcaccttccaatgagctcatttccaataagacgtttcagagccatggacatgcttggagtcaatgtgaatgcctaatttcgaatttttattgtttacacatgtcaatctaggtttaccaatc

SEQ ID NO: 43936 - DNA, 459 bp, Zea mays
  unsure at all n locations
  Clone ID: LIB3066-043-Q1-K1-E7
cccacgcgtccggcctgaggaggtggaaggagcaactccttgggcaggtcgacacagagcagctgggagaaactgcggaaccagaggtcaaggtgctggacctgaccatcctgtcacctggcagaccggacctgatccttccgatcccgttccaggctgacgagaagggctatgcgtttgccctcaaggacggcagcccctacagcttccgcttctccttcatcgtctccaacaacatcgtgtcaggcctcaagtacaccaacactgtctggaaaactggagtcaaagtggagacccagaagatgatgctggggacgttcagcccccagctagagccctatgtctacgagggcgaagaagagaccacccctggtggcatttttgcgagaggttcttaatctgccaaactaaaagttggtgatgatgatggcaagtgcttnctggagatgagttactact

SEQ ID NO: 43937 - DNA, 455 bp, Zea mays
  unsure at all n locations
  Clone ID: LIB3066-043-Q1-K1-E8
cagacaatcagcagctagaccaaaagaaagaaaggctcgttatatgacagaccttgagcggaaggtccaaactcttcagactgaagccaccaccctgtcagctcaacttacactatttcagagggacacgaccggactttctacagaaaatgcagagcttaagataagtttacaggccatggagcaacaggctcaactccgtgatgctctgaatgatgcactaaagcaggagctggagaggcttaaacatgctactggtgagatgaccaattccagcgaggcatataacatgagattccaacatgttccatacaattcttccttcttcccgctttcccagcaaaatgcatccncacaccttggtagcacccagctgccactgccgttccacccaccccatcccaacgtgccaaaccaccagatgcgaaacactcttccggacataatgcagcaag

SEQ ID NO: 43938 - DNA, 425 bp, Zea mays
  Clone ID: LIB3066-043-Q1-K1-E9
ctcccgagtcccgatcgcaaccgccccccacattccccagagttagcccgatcagatcgttgttccctcgaggtgagagtaagatgagggagatcctgcatatccagggagggcagtgcgggaaccagatcggctccaagttctgggaggtggtgtgcgatgagcacggcatcgacccgacggggcggtacatggggacgtcggacgtgcagctggagcgcgtcaacgtctactacaacgaggcttcgtgtggtaggttcgtgccgcgcgcggtgctcatggaccttgagcccggcaccatggacgccgtccgcacgagcccctacggccagatcttccgcccagacaacttcgtcttcggccagtccggcgccggcaacaactgggccaaagggcactacaccgagggggcggagctcatcgac

SEQ ID NO: 43939 - DNA, 357 bp, Zea mays
  unsure at all n locations
  Clone ID: LIB3066-043-Q1-K1-F1
ccctccttctcctcgtcggaggagaactgtccgctgtcgtgactgacgttggggaggtcggcctcattcttgatggggcgcagacctgggcgtcgcgcagccgcctctcccacgtggcgacgttgcgggagcagtgcgggagacgacatcaggagtgcggaaggtggaggggaatcaaccactgcattggtgtagattggcgggcaacctgtccgggctgccatcgtcggacggcgaccaaatctaggcagcgcgggtgttggtggcctccaacgaggcctctcctcgactgacgtggtggacgcgacagccatcgagcgcanggtggagataatggtgttctcgaggatcctcgcg

SEQ ID NO: 43940 - DNA, 472 bp, Zea mays
  Clone ID: LIB3066-043-Q1-K1-F10
cccacgcgtccgcccacgcgtccgcccacgcgtccgaaaaaaagaaaaaaaaagagcagaggaagtagagtagactacgacagcgtccggcgaggaggcggaggcgaagatgaggaagaagctcggcacccggttccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggcgctgattcctgtggagatgaaagaggattacctagaagaaggtaaggtcatttgtaatcaacattttatgattcaattggctcacgt

SEQ ID NO: 43941 - DNA, 445 bp, Zea mays
  Clone ID: LIB3066-043-Q1-K1-F3
cggacgcgtgggcggacgcgtgggcggcgacgtctccacctacgacagcggcagggtctggggcgagaagtactacaatggcaacttcgagaggctcgccaggaccaaggccaaggtggacccctgcgactacttcaggaacgagcagagcatcccgccattgctcaagtgatcgatgatacccggtcccatccagatcctttcgaccgcgccaagcaaaaggacgacgagtcgtacatgattctgctgattatattaattagattgatcctgctttgcatgcgttgagccaggtgctttgcatggcgagttagctacgtagttggcatcagccacatgcatgacattaaaacacaagctgacagccggctacccaaagtaaataagatacgcgacatacacttgcgtgccaattagtatggctggttcttcttttttaatatta

SEQ ID NO: 43942 - DNA, 478 bp, Zea mays
  unsure at all n locations
  Clone ID: LIB3066-043-Q1-K1-F4
cccacgcgtccgggaaggcagtgagctgttccgcacccgcctcgccccgcccgcccgtctgatctgatgaggaaggtctgcccgaacctcgagcgcgacgacgcgctggacacggtgctggaggtacccatccccgaggagatgttctccggcggcggcggcggcggctcctgcgggttcaggttcggctgcagcagcgtcaaggcgtggatgcggtcgcacgccgccgaccggtgcggcgcgggcgagccgtgctccatgagccgcggggagctgcagctcatgctgggcgtcatcggcgcgccgctcgtcccgctgcccgtcgccgtcgtctgccgcgccaagcagtcgccctgctccgtcctctgcgagcagctcaagaccggtccaatcgagtcgtcctccgccaagtacatcgtgcagcagtacgtcgcggcgtcgggcggngagtgggcgctggacagggtcaagagcatgt

SEQ ID NO: 43943 - DNA, 466 bp, Zea mays
  unsure at all n locations
  Clone ID: LIB3066-043-Q1-K1-F5
cccacgcgtccgcccacgcgtccggtgatttgaaataattgggaataaatagttcgtgaatgcctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgncgncgctgcatctgcactaggcagtgctaaacaagatcgctcgatcgctcggcatgcatcgacaacctattcttaataacgttcattatctcggtcctatttatgacgaatgtcatgtatgttcttgtgactggcatgtatattctgatgactggcatggatcttggtcat

SEQ ID NO: 43944 - DNA, 383 bp, Zea mays
  Clone ID: LIB3066-043-Q1-K1-F6
gggcgacgtggatgagctgctgatgtcgcgtctcgaggatggcgacacctgccagggcgagagtggagtcgcgatgacgctggccgtcgacacgaagcgcgcagcgctgagtgtatgcgctgagatgcttgtctacatgacgctggtgttcaacgagttgaggaatacgctcgagaagcactgtcagtggaggtatcagatccgatgagcatgtgcatgctcggtgctgatgcattctctagcaagcgcgtccggataaagacgctggtgatttgtggtgtggtgacacatgaatgaatgatacgagaggcttgttcccacgtccgtgtacgaggactatggaatagcaaatctggtgctaccaacgaggcattacctatatg

SEQ ID NO: 43945 - DNA, 81 bp, Zea mays
  Clone ID: LIB3066-043-Q1-K1-F7
cccacgcgtccggctagcggttgcttcatttcattgttcattttttaaaaaattttatataccacgcctttgcattgagac

SEQ ID NO: 43946 - DNA, 304 bp, Zea mays
  Clone ID: LIB3066-043-Q1-K1-F8
gcgacaacctcttccattcaaccctgatcatctccacacccgcctcaccccgacccggggactggtctgattaacaaggagagtcttaacctacatcacgacaacgcacaaagcaaccaactccaattgctaactgccgatgacatgctcacctgaagatactgcattcctttcattaaaagctggtgacggtgtcattaagggtagaaaagaacgagcttgtgaacgtcaaatttctgcgaagccatggatttctgcgcttacaatatgttgttttcaatcggactgttcttccttattcttg

SEQ ID NO: 43947 - DNA, 417 bp, Zea mays
  Clone ID: LIB3066-043-Q1-K1-E2
cactaatccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgc

SEQ ID NO: 43948 - DNA, 399 bp, Zea mays
  Clone ID: LIB3066-050-Q1-K1-F7
atcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacattacagacatgaac

SEQ ID NO: 43949 - DNA, 424 bp, Zea mays
  Clone ID: LIB3066-050-Q1-K1-F9
cccacgcgtccgcccacgcgtccggaggaacgcgaacaaccaacgatcgcctcatcgcgatggctcgctctgtccccatcgccgtcgccgtcgcgcctctgctcctgctcctcctcgtctccactgcgtccgctgcacggaccgtgggcgacaccgtgcaggacgcgtgcagcaagacacaattccccaagatctgcgtggacagcctcgccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccga

SEQ ID NO: 43950 - DNA, 381 bp, Zea mays
  Clone ID: LIB3066-050-Q1-K1-G1
gtgaggatcattatcttaattatttatgtaccatgttcaaaatgctcttgttttggggaatctgctccggagagagcccttgaagcttgttgatgggggtcagtctcagagaacctttgtctacatcaaggatgccatcgaagctgtagtgctgatgattgaaaatcctgctcgagccaacggccacatcttcaatgttgggaatccgaacaatgaagttaccgttagggagttggcccaaatgatgacagaggtatgccatatattgttgaccctgactggtgtacttgttacttgtttctattgtaagtcatctattgtgatcttgtcacgaggttctagtattttcgcaacggacaaaagagtttgagagtactacct

SEQ ID NO: 43951 - DNA, 374 bp, Zea mays
  Clone ID: LIB3066-050-Q1-K1-G10
ggcgctctccgaccgctcccgcgagtcgctcctcccgagcttcctctacgcctcctcggcgcgctctttcgctgccacaggagccgccgcgcgcctccctgtctcctccccagcgcctgccacggctggagcaagaggcggcgtgccgttctcgatccaagcgcccaaagagaagatcgagaagtactcgcccggcttctatgccggctgcactggccgaagaatcgccaggtgccggcttacccacatgggcgtcacgccttttgaccttggcaagggccatatgccgattgacccaaccaaatacaagagtatctcatctggatttggtatcctgttaaaggagcaaggggccaggggtttcttcaggggat

SEQ ID NO: 43952 - DNA, 379 bp, Zea mays
  Clone ID: LIB3066-050-Q1-K1-G11
cccacgcgtccgccgagatcttcgaggtgacaccggcctttcacgtcgtcgaggtgaagaaggcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtccatcctctctttcttttcccctttctcaaagagctaggaccttgttcgactgaccttaaggctgtagggctctttgggaccatcttttgccagtt

SEQ ID NO: 43953 - DNA, 384 bp, Zea mays
  Clone ID: LIB3066-050-Q1-K1-G12
agcaggcgggcgcggagggccaccgcgacgccgcgggggtgtggtacgtgccctactgggagggctacgacgacggcttcgaccgcgacgcgcacgacgccacgcactacatggagcagatcaagctcgtgggcgccgccacgttgggggccgtcctcgaccgcctccacggcgtgggccgccccgtcacgctcgtcgtgtacacgctgctgctgtcgtgggtggccgacgtggcgcgcgcccgctccgtgcccgccgcgctctactggatccagccggccaccgttctcgccgtgtacctccacttcttccgcgccacggacggcgtcgaccgggccatcgccgcggcgggcggcgacccgtgggcgagcgtccggttcccgg

SEQ ID NO: 43954 - DNA, 390 bp, Zea mays
  Clone ID: LIB3066-050-Q1-K1-G2
cccacgcgtccgcgccctctcgctccagccgcttcacagcgccgccgctcgcctgtgcgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgaca

SEQ ID NO: 43955 - DNA, 404 bp, Zea mays
  Clone ID: LIB3066-050-Q1-K1-G4
cccacgcgtccgcgccctctcgctccagccgcttcacagcgccgccgctcgcctgtgcgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaagtcatg

SEQ ID NO: 43956 - DNA, 348 bp, Zea mays
  Clone ID: LIB3066-050-Q1-K1-G5
cccacgcgtccgcaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacacc

SEQ ID NO: 43957 - DNA, 402 bp, Zea mays
  Clone ID: LIB3066-050-Q1-K1-G6
gccgcatccagggatggagatgaagaagatcgcctgcgccgtcctcatcgccgcgggggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttcctttttccttcctctttctacttgattttcatttaacgaattggtatcgctgatgcacc

SEQ ID NO: 43958 - DNA, 378 bp, Zea mays
  Clone ID: LIB3066-050-Q1-K1-G7
gtgacgatcattatcttaattatttatgttccatgttcaaaatgctcttgcgggggggaatctgctccggagagagcccttgaagcttgttgctgggggtcagtctcagagaacctttgtctacatcaaggatgccatcgaagctgtagtgctgatgattgaaaatcctgctcgagccaacggccacatcttcaatgttgggaatccgaacaatgaagttaccgctagggagttggcccaaatgatgacagaggcatgccatatattgttgaccctgactggtgtacttgttactagtttctattgtaagtcatctattgtgatcttgtcacgaagttctagtcttttcgctacggacaaatgagttggagagtacta

SEQ ID NO: 43959 - DNA, 330 bp, Zea mays
  Clone ID: LIB3066-050-Q1-K1-G8
cggacgcgtgggcggactcgtttgataaaaaaaaaaaaaaaaaataaaaaaggaagaaaaaaaaaaaaaataaaaaaaaaaaaaaaaaaaaaaaaaaaaaaaaaaaaaaaaaaaaaaaaaaaaaaaaaaaaaaaggggcgccctttttaaagaacccaattttccttacctttcctttcaacttcttactttttttttagtgccacctaatttaatttaattgcccttctttttacaactttttaattggaaaaaccctgcctttccccaatttaatccctttgcataaaatcccctttttgccacttggcttattaccaaaaaggccct

SEQ ID NO: 43960 - DNA, 413 bp, Zea mays
  Clone ID: LIB3066-050-Q1-K1-G9
gggctgggctcatgctacgaggtgagatgcaggaaaaacctgagtgctcgggcaatgctgtcacggtgttcatcacagacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgctgggcagaagatcgtgttccacatcgagaagggctgcaaccccaactacctggccgtgctggtgaagtttgtggcggacgatggcgacatcgtgctgatggaaatccaggacaagttgtcggctgagtggaagcccatgaagctctcttggggcgccatctggaggatggacactgccaaggcgctc

SEQ ID NO: 43961 - DNA, 334 bp, Zea mays
  Clone ID: LIB3066-050-Q1-K1-H1
attacccaccccaaagagctaccctgaccatatttggccgcttcctcctctgcctggcggtaaccctagtccagccccccgagatctgctccgcgcgagcagccatggcggagacgctcgacatgaccctcgatgacatcatcaagaacaacaagaagagtaacccctcctccggcggggcccgccgcagccgctgcggatccgcccctggcggcagcaacggcggcgtcgggccgaccaagcgctccttcaagaaggctgggaacaagcacgcgccctaccagccgacgaaagcccctgacgctgacatgcatcacgacatgtaccctgcggt

SEQ ID NO: 43962 - DNA, 370 bp, Zea mays
  Clone ID: LIB3066-050-Q1-K1-H10
aaaacatgcagcaacacccctggcaagataaaagatagatctaagactgaagatgaagaggtgggaaataaaaagcggaggaggaagggaattaggaggaaggatcaaaaaacaaagatgcactatggggaagaggaagatgagtacaaagatgaaccagaagcagatgatgactatgcagacctggcgaggtataatggcgctgacaattcagagagagccccagatcaccttcttgcagctgctggccttgacgattctgatgccgaagatgacatgggtcatcctcaatctgcaatagaacggatgagacgagcttggtcagaatctgaagacgatgagccagtgaagaagccagcaacacaaccta

SEQ ID NO: 43963 - DNA, 82 bp, Zea mays
  Clone ID: LIB3066-050-Q1-K1-H11
cccacgcgtccgttcttttacttgaatattggttactgcattggtctttcactttaaggtcggtgactgcattgatcgaatt

SEQ ID NO: 43964 - DNA, 419 bp, Zea mays
  unsure at all n locations
  Clone ID: LIB3066-050-Q1-K1-F6
cccacgcgtccgcccacgcgtccgcacgcaacgacgcgcctcggcctcgcagaaggaggggccaaaaaggaaaagagaaaagaggaaaagaacgcagggaatgggcaagcagcagcaggcgccaccggcgcggcggtccacggcgatgtcggcgcctccgccaccgaagcgccggaagaagaagggccggccttccctcctcgacctccagaagcggagcctccgcctcgagcagcagctccagcagcagcagcccaaggggcgacgctccaaccgccggagcgccggctccgcggacgaggacgacgacggccccgcctccggctccggccgccgcgagaagaagctgcgcctcgtcatgggccttcacgacggatcacccaaggtagaaaagacgaggaaagcgacngatgggcatg

SEQ ID NO: 43965 - DNA, 383 bp, Zea mays
  Clone ID: LIB3066-050-Q1-K1-E1
cggacgcgtgggcggacgcgtgggccaccacctttaccaccgaagagagaaacgcgagcgaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacag

SEQ ID NO: 43966 - DNA, 422 bp, Zea mays
  Clone ID: LIB3066-050-Q1-K1-E10
atcagtacgcagatggccatggagggtcgtcgtcgtcgtcgtctcgttctgtggctcgggatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtagccctccgccgtatctgtcgcttgcacccaacggctccagccctctgctcgcgcagactgctctcaccactggtgtcagctacgcttgcgcagacgctggcgtactcgactcaaccaa

SEQ ID NO: 43967 - DNA, 314 bp, Zea mays
  unsure at all n locations
  Clone ID: LIB3066-050-Q1-K1-E11
cccacgcgtccgcccacgcgtccgcccacgcgtccgggctgcccctgcatccaccacggcggcggcggcggcggcgctgctgcttctgctcgtgtcgctcgccgcggcggcggacatgtcgatcgggtcctacggggagcgcaacgaccaggaagccccgcggatgtacgcggagtggatggcggcgcacggccggacctacaacgccgtcggcgaggaggagcggcggtaccaggtgttccgggacaacctccgctacatcgacgcgcacaacgccgncgtcgacgcgggcgtacactcctttcggcttgggc

SEQ ID NO: 43968 - DNA, 392 bp, Zea mays
  Clone ID: LIB3066-050-Q1-K1-E12
ggcaacgcactactcgttcgtatctttaagcttgctgctgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggatgctggtgaagaagaacaacagcacggcgatggcggcgggcgtgctgccgctggcgtcgctgaaccacatcagcatcgtgtgccggtcggtggaggcgtcgctgcgcttctatgcggacgtgctcggcttcgtgcccatccgccgccccggctccttcgacttcgacggcgcctggctg

SEQ ID NO: 43969 - DNA, 416 bp, Zea mays
  Clone ID: LIB3066-050-Q1-K1-E2
cccacgcgtccgcggacgcgtgggcttcaccatatgggaacaccttgcatcacagggagaattctacagttggtcaatttgcattcacaaccgcagaagctggaaactacgttgcatgcttctgggttgatagtgcagagaaaggatcaggagtatctgtgaatcttgactggaagattgggatcgcaacaaaagattgggatgctattgctaagaaggaaaaaattgagggtgtagaactagagcttcggaaacttgaagtggcagtacaggccattcatcagaacttgatatacctcaaagaaaaggaagcagagatgcgaactgtgagtgagacaacaaattcaagggtcgtctggttcagtactctgtcgctatgggtctgcattgcggtatcggttttgcaagtccgacac

SEQ ID NO: 43970 - DNA, 354 bp, Zea mays
  Clone ID: LIB3066-050-Q1-K1-E3
gaaacaacaagactgacagcgacgatgatgccacagctgcgtagcctcgtcgcgcgggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccac

SEQ ID NO: 43971 - DNA, 150 bp, Zea mays
  Clone ID: LIB3066-050-Q1-K1-E4
ggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgttt

SEQ ID NO: 43972 - DNA, 422 bp, Zea mays
  Clone ID: LIB3066-050-Q1-K1-E6
gccttgaaggagcaagggttgtacgacgccgacaaaatcaaagaggtcatcggaggtgccgactccgacaacgacggaaggatagattattcagagtttgtggcaatgatgaggaaagggacagctggtgcggagccaatgaacaacaagaagaggcgagacgtagtcctatagtgggtcagcaagtgtgtaatgtgtataggagctcaagcaagcaaatttgtgtatcagtacacagatgcaatggagctacttttgcggcttagttcacggatggctgtgtacattggggcattgtttgcgggggattttaatgctatgcatacttagggactgagaaagacatggacgagttcatgatgcgtgcagatcagtctggaagtcctggaccaaatagagagaaaacaataggatgacgattc

SEQ ID NO: 43973 - DNA, 258 bp, Zea mays
  Clone ID: LIB3066-050-Q1-K1-E7
cccacgcgtccgggaacacctactccgatgatccatctactgcttggcctgaccggcgccgcggagcttggccatgttcctcttcttcttctcctccaggtccgtcacctcctgctgcttggcagcttcctcggcgccgccgggcgccgccgggaccgggttcactacaggttccccgctgccgcggagcttcgggccggagccggagccggacctatcctggtctccggcgctgacgaccaccccgccaggaacctt

SEQ ID NO: 43974 - DNA, 386 bp, Zea mays
  Clone ID: LIB3066-050-Q1-K1-E8
gctgtggatggaagctatgttttcaacaagggaaagatccacaaggttcctgggggtgacatggaagctctcaagtctcccctgatgggattgtttgagaagcgaagagctgggaaattcttcctttatgtccaagattataaggaaaatgacccaagtactcataagggttacaaccttactaaactaacgacaaaagaacttatctcaaaatatggtttggatgataatacgatagacttcattgggcatgcagtggctcttcatagagatgatagctacttgacagaacctgcaattgacactgtaaaacggatgaagctttatgcagaatcagtggctcgctttcaaggaggatcaccatatatttatcccttgtatggttt

SEQ ID NO: 43975 - DNA, 226 bp, Zea mays
  Clone ID: LIB3066-050-Q1-K1-E9
cccacgcgttcgaaaaaaaaaaaaaaaaaaaaaaaaaaaaaaaaaaaaaaaaaaaaaaaagaaggaataaaaaaaaaaaaaaaaaaaaaaaaaaaaaaaaaaaaaaaaaaaaaaaaaaaaaaaaaaaaaaaaaaaaaaaaaactaaaaaaaaaaaacaaaaaaaaataattatgaaaaacatatattttaaaaaataaatataagacaacataagacataatattt

SEQ ID NO: 43976 - DNA, 366 bp, Zea mays
  Clone ID: LIB3066-050-Q1-K1-F1
gttcctcgtcgtctcgtgttgtttctcgcgttgccattgccccagctgtccgcccgcgcccgcggcaatggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccttccgtgtacgccaaggcggcggcgaacaaggacacgaaccagtactgcaagttcgacagccagctgctgacgctgttcacgtcgtcgctgtacctggcggcgctggcgacgtcgttcgtggc

SEQ ID NO: 43977 - DNA, 423 bp, Zea mays
  Clone ID: LIB3066-050-Q1-K1-F10
tcggaaacagttaagaattcatatataagagtgcatatatatatatataattctgccgggggaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcatgtgcagcaccttccgccgccgctgcatctgcactaagccgtgctaaattaacctactcccggcagttcgatggtggacgtttattctatttattggcttacttgattttttttcccctaacaataagaaaacgcacgtgctggcatgtacgttgcgttgtatatgcttttcttgc

SEQ ID NO: 43978 - DNA, 311 bp, Zea mays
  Clone ID: LIB3066-050-Q1-K1-F11
cccacgcgtccgggaacatcgtccatccgagctaagtaattaggtcgaaaatgacccgtgcgggcagcagtagcagcagccggcgtgtgacgctggtactgctcggtctccgcctgctgcttctggttggtgttgcgcatgcggtagtggagttggtgcctgctgatgataatatcgccgccgccgctgctggcacggcggtggacgatggcgagccgcctcagcagtgcgcgaccccggtgagcgtgtaggatgcgtgccgcggcgcgttcgagacgcacgccggcgtggcctacgaccactgcatggcg

SEQ ID NO: 43979 - DNA, 427 bp, Zea mays
  unsure at all n locations
  Clone ID: LIB3066-050-Q1-K1-F12
atcaaagagcacggtggtgatgacttctcctttacgctcaaggagggcccgactggcgcgtggacgctcgacaccaaggccccactcaagtaccccctttgcatccgctttgctgtcaagtctggcggctaccgcatcgncgacgacgtcatccccgccgatttcaaggctggcacaacctattagaccacactcaacattctaataaacctctcatgatgaaatatatttcaaaagaactcaactaacgcatgtgttacaagacaatattattttttcaatggctttttttggcaccagaccacccaagaaataagttatgctacatgtctcttctgaccccttgttgtgttgggttgatattattacataaactaaatacattatttatttaagattttaggagaaatatgttgatctgatccac

SEQ ID NO: 43980 - DNA, 330 bp, Zea mays
  Clone ID: LIB3066-050-Q1-K1-F3
cggacgcgtggggccgcgccatgacgatgacgatagccgccgtgctctgcctgctgctcttctctggccgtctcgccgcggcggagaagactttccgcggaggtggaggcggaggctacggcgggttggaggccggtggcggaggcggcggcggctattccaccccgagcgaggcggcgccatccacgcctgccgctggggagacgactaccccttcgtcaggcggcggttactccactcctagcgtggcggcgccatccacgcctgccgctgaggagacgacgacgactccttcgtcaagcggcgggggttacggcggtgcaaccggca

SEQ ID NO: 43981 - DNA, 415 bp, Zea mays
  unsure at all n locations
  Clone ID: LIB3066-050-Q1-K1-F5
cccacgcgtccgtccacacatggtggcacacatggcgcgagaaatgcagaaggtggcctcccgcgaagcagtggccccaccgccctggccaagggttcacaattttggtatgaaattcctgaaattcccttgaattcagggtccgaaaggaatatgttttccgaaattgacgttgtttaatataaattatagcatttttgttttaaaaatattaaatttatttgattttgacgtaaaatgcctgaaatttcggaatttcctgcttttctgtggagccaatttttttccttttcagaaactgtgaaccctgcctcacttaggtgctctagccttcgccgncggaatccatccagattataagtgttcccgatctcgctatcttaccctatgttttacccacttaaaagaaactatt

SEQ ID NO: 43982 - DNA, 422 bp, Zea mays
  Clone ID: LIB3066-050-Q1-K1-D9
cgcacgcctgatgtcgacgcgccggtgtcccgtcggccgcctccataccgcgtgctgagacggctggcgctgccgtcatcagaggtggctgttccgtccaccgtggcgcggattggggaagacagctgcatggctgccggaccttcgccaggacagctcggaccggggacggcacgtgcatggcggctggcacttcgtcgttaatccctgaacaaagacagaactcccgaaatcaactttcccgccagttttgcagcctaaacatcaagcgcgccattgtttggcgccattttctctcgcagcctcaacctgatcaacccgttgctgctgctcccatccatccccgtgctgcagcttgcatcaccttcccgtgtgcgattcatgagagcccacagccactgtctctgagcgagcattgtatg

SEQ ID NO: 43983 - DNA, 422 bp, Zea mays
  Clone ID: LIB3066-050-Q1-K1-C12
ctaccctcgtcgtcgtctcactcaccccgccttcacgcctccctcaccaaataagggcgcggccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcc

SEQ ID NO: 43984 - DNA, 321 bp, Zea mays
  Clone ID: LIB3066-050-Q1-K1-C4
cccacgcgtccgcccacgcgtccgcccactcgtccgcccactcgtactcccactcggtgggatcctcatcagacattacaccaattgatcaccaaaatatatcgctttaataccaactactcatgtcattgtactgtcggcaacaaatctagctgatgtttctgatcctgcccttaatcgcactggcagatttgaccgtctcgttatgctttaagctcctgataggtttggaaaagaatcaattctaaaaattcatgtcaaaagaagatagcttccactgaataaacatgtacatctaatcaatatagctgcaatgacaac

SEQ ID NO: 43985 - DNA, 387 bp, Zea mays
  Clone ID: LIB3066-050-Q1-K1-C5
cggacgcgtgggtgaccgcacgcccgcacaagctgctccgggctccgctgctggggtagggtttggactttggattggagccgcaccgccgcaccggcaccgcagccgtcgcagtgccgcacagccaccactcccatcttggtcttgcggccagtcgccctcggacctcggccatcgaccccttgcccgcttgccgagacgccgagtaagcgtcgaccgtcgtcgctgtcgtcaccgaggtccagcgcccaacagcccagcttcaagcctccagccatcggcgcccgccctcctccgccgagacgccgagtgccaagcgcccaagcaccccagtccccagcgcccaacaggctaacaggctgcaggtatgcaacctcttgtgatgcg

SEQ ID NO: 43986 - DNA, 362 bp, Zea mays
  Clone ID: LIB3066-050-Q1-K1-C6
gacaggcgttgctggaggtatgatgcacgcatacgatatgggcggattccctgggggggatactgccttatcctcggctgcccaaattgcgactctgacttctgaccttgcaaatgctaatcctgaacagcaaccaacgatccttggtgaaaacctatacccactgattgagcaactggaaccaaaccaagcggcaaaggtcactggaatgcttttggagattgatcacactgaagcacttcaactgcttgagtaccctgatgccctcaagtcaaaggtagctgacgcgatagatgttctacacaatgcgtcccatcagcaaaacgcaaacacttggaccagtcagcttgctacattatcac

SEQ ID NO: 43987 - DNA, 372 bp, Zea mays
  Clone ID: LIB3066-050-Q1-K1-C7
gtcgagcaggaggccaaccacaactccggcacgttcctcgaccgcttcaccgagtcgctgcactactactccaccatgttcgattctctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggag

SEQ ID NO: 43988 - DNA, 385 bp, Zea mays
  Clone ID: LIB3066-050-Q1-K1-C8
cccacgcgtccgcccacgcgtccggaacggagggaccctgaacagcgcaaggggagcttctcttctgaaggaagctatacatgttatcagctgcggctacgaagacaagaccgactggggaaaagagattggctggatttacggatcgatcacagaggatatcttgactggatttaagatgcactgccatggctggcggtctatttactgcatcccgaagcggcctgcattcaaaggttctgcgcctctgaacctttccgaccgtcttcaccaggtccttcgctgggcccttgggtccgtcgaaattttcttcagcaagcactgtccactttggtactgatacggcggcgggctaaaattcctggaaaggatttcttatatcaac

SEQ ID NO: 43989 - DNA, 428 bp, Zea mays
  Clone ID: LIB3066-050-Q1-K1-C9
cccacgcgtccgcccacgcgtccgaagaaatcttacatgccatcccagagaaaacaacgcaaattctgcaattgcccagtggaaatggccaagaaatcctacaaagatgcttgcttttggtgtccacaagcatatgccaatgacatggactcctcagaagaggatgaattggatgacaatttgaatgatatttttggccttaatgatgatggcattacttcgtctgtttctgcctccagggaccagctaaagtataacctcatatcttgcaaacaaatggttggtatttttgtcacagtctgggcaaagaaagaattaatgcagcatattggacatttgagaacgtcctgtgttggtcgcggaataatgggatatcttggaaataagggatgtatatcagtaagcatgacactataccagacaagctt

SEQ ID NO: 43990 - DNA, 170 bp, Zea mays
  Clone ID: LIB3066-050-Q1-K1-D1
aaaataaaaaaataaaaaggtagaattaaaaaaaaaataagcaaaaaaaaaaaaaaataaaaaaataaaaaaaaaaaaaaaaaaaaaacatcaatatttaaaaaatccaaattaataaacaattacaaataaatatataaatataatataaaacaacataaatacaataa

SEQ ID NO: 43991 - DNA, 408 bp, Zea mays
  Clone ID: LIB3066-050-Q1-K1-D10
cctgcttcgagatcaagtgcgataagcctgtggagtgctccggcaagcccgtggtggggcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctggcgctgctggtcaagtacgtcgatggcgacggtgacattgtggcagtggacgtcaaggagaagggctctgacacgtacgagcccctaaagcactcctggggcgccatctggaggaaggacagcgacaaaccgcttaagggacccc

SEQ ID NO: 43992 - DNA, 308 bp, Zea mays
  Clone ID: LIB3066-050-Q1-K1-D11
cgccattcccgcctagcttttcttccgattgcttccagaaaatcgttgagccctcgctgacgtacggctgcgaccgtggggacgacgggctttgatccattaagcaacttaccaccaaatcaaaaggaggggagatgtgagacaaaggacaggagcgcctagcaaatcaaaaggagctggaaaacgaaccacgggaaggcaggatgatggaaagggacaatcgtcttcctaagcggttcgtaaccgagaaacgaattattgaggtgacctaaaaataaaattggggccggccccttgggtctgaatcg

SEQ ID NO: 43993 - DNA, 422 bp, Zea mays
  Clone ID: LIB3066-050-Q1-K1-D12
agaaactatcgccagcaaagggagagcgccgaggtgatagagataatgcggtggtggtgctcatggttggatgaatgggggtgtcgggctatgcgcggttgacgtcctcatcggagcaaaccccttcaccgttggttgcctcgtgccgtggcctgggaagtcgatgactgctcatcatggtaggaggccccgaccgaccgtgcaaccgtgtgccgacgctgtggctgtgcgccaatgaaatcacgagcgaggtcacgagtcatctgaagagcaagttggtacctggaatctcaagtgccaggtcaagaacaggtaccacaggatgaggcgcttggaggatgctgtgatgagttcgtgagtggtctaggccgtcgtctcccagtcaactttgggttgctggaccgttgtctccttataatgta

SEQ ID NO: 43994 - DNA, 391 bp, Zea mays
  Clone ID: LIB3066-050-Q1-K1-D2
aaaataatttacttcatcctcccagcttacaagttaaaaaaccatcaaaagtttcagcagctgcgacagacaagaacgcgcacgtcgcacgctgtggcgtcgcagctgcgggaacacgacaacattcacatgaacttacttcagctactaataatacaaggcgacggtagatatagagagcatcttctgctagtctggttgtaaataaacgatcttgaaacgctgtcttgagccgctatacttttgtttttccttctttgtgcggagcaggtgcgtgcagctcagctgagctcagcagagcggcaggggcgcgccgttccactccttgaggcactcgagcagcgggtcgatgtgcttgcgctggttgatggccacgagcacctttgtgagc

SEQ ID NO: 43995 - DNA, 405 bp, Zea mays
  Clone ID: LIB3066-050-Q1-K1-D3
gacccacgcgtccgcccacgcgtccgccatagctcctgccctgtgtgccggtttgagctgccatctgaagagacagaagatttggatgagcctagcaatgtggacagaacagagaacacccatgaggaagtcagggccgatggccctgaagatgacggtgagagcagtaacagagcgtgggcccttgttccttggttcagtgggctattctcaacacctgaaccacaaactgtcagaggcgctttcactgatcagcagactcgctccacttctggaaccaacctgaatgctggcgaaagctgatctcttcctcctttgtgaataattcccctacatctgagaatagcaatggaccttgtcagtagataacttaattttctgtactgataattcttcttggatgaa

SEQ ID NO: 43996 - DNA, 399 bp, Zea mays
  Clone ID: LIB3066-050-Q1-K1-D4
cgccttggaaggcatccggcccgtcgaggctccttttgaagaggaagaggagttgggcttcgttgctgcgggttcccctgtccaggcggcttccgggtccctggttgctgcgtcacctcagggtcctccggttgcgccggtgagcgcgcccggtctgcctcctccggttgcgagttccggatcccgcctagctgttacggcggccgtcgcgcctttgtttgcggttgcgccgccggctgctgatccgccggtgtacaaccaggaggctcgggaatccctggcaggtctgggcgtgatagcttcgaccatcgagtcgggaatccgtccgtggcttcaggcgcttaacggtcgccttcggcaggcggagcatgggccctcagattgggagcgtcagctcgc

SEQ ID NO: 43997 - DNA, 105 bp, Zea mays
  Clone ID: LIB3066-050-Q1-K1-D5
gtcgactgtcggatactatcagagatacccaaccctcgatcgtgacagctttagggcatgtaatgatgctcataaaatgtcatgtaacgtacgtatttgtgtgtg

SEQ ID NO: 43998 - DNA, 412 bp, Zea mays
  Clone ID: LIB3066-050-Q1-K1-D6
cttcttcccaacccaacagaagcgaagcatctcttctccccccttcccaatcgggcggcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccctttgagcatggcgaggtgtttgttcttgatgatggtggagaggttgacttggatttggggaattatgagcgtttcatagatgttactctgacaaggataacaaca

SEQ ID NO: 43999 - DNA, 421 bp, Zea mays
  unsure at all n locations
  Clone ID: LIB3066-050-Q1-K1-D8
cagcgagcgagagcgagagagacagagagattgtccgcgcgtcagcgactccgggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgcntgtttctctgatcagaggagaggtggggaaatggattgcgattattggctgtattctgc

SEQ ID NO: 44000 - DNA, 414 bp, Zea mays
  Clone ID: LIB3066-050-Q1-K1-C11
ggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttcccctaacaataagaaaacgcacgtgctggcatgtacgttgtgttgtatatgcttttcttgctggcttcatttgctgattactgatgagttgtaaggtccctgcacgatccatttcacatggatatgatgcttaattgtattcctgcttatatggtatctatatttaattaattaatgatggaccatcgagtttattttgtatttttgacatattcg

SEQ ID NO: 44001 - DNA, 220 bp, Zea mays
  Clone ID: LIB3066-045-Q1-K1-G2
agaagggctacgacggcgccaaggccgacatctggtcctgcggcgtcatcctcttcgtgctgctcgccggctacctgccgttccacgacgccaacctggtggagatgtacacgcatgatcagcagagccgacgtcaagtacccgcagtggttctcccctgagctacggcggatgatgcccaagctcctcgaaccgaacccaaagctcaggatcacgatcg

SEQ ID NO: 44002 - DNA, 358 bp, Zea mays
  unsure at all n locations
  Clone ID: LIB3066-045-Q1-K1-G3
cccacgcgtccgaacgaattgtttgtccaggagaaggcccccgacgggattattctttcgccccgcgtgctctctatctctcccctctttctctccctctgcccgacgactaggccgccgccgtcaccgtcccgccgacgtcgtcggcgtcgtgcccaggtctntgtcggtccttgttcggcaacgagcaccctacagatggctgggaggcacagccatattctgatgcagccatctcaaaataaggcttctagaacatttatggattacaattcgattaatcatgccttggatggaatctgggggctttatggaaaggaaattaagggttttaacccaatggtccccaaccttacct

SEQ ID NO: 44003 - DNA, 359 bp, Zea mays
  Clone ID: LIB3066-045-Q1-K1-G4
ggaagggtacacagtgaacccaagcttggatttcttgccgaagtggacccatccaccagggtactgtcaaccgactccttcctcaagcacactgatgtggctatactgctggacaatgatgccatctacgacatctgccgacgatcccttgacattgagcgcccaacctacaccaacctcaacaggctagtgatccaggtcatctgataccttactgcctgcctgaggatcgatggtgctctgaacgtggatgttaacgagttccagaccaacctggtaccctacccgaggatccacttcatgctttcttcgaacgctccaatcatgtctgctgaaaaggcctaccacaagcagctttt

SEQ ID NO: 44004 - DNA, 295 bp, Zea mays
  unsure at all n locations
  Clone ID: LIB3066-045-Q1-K1-G5
gaggctacgacgtacgcatacggctgcgcgctcatggatgcaataggaaataatgagtcgcctgcctgatgggctagagcccggagaatggacttacctactggctgttatgactgaagctcggagaccgcttgggcgttgtacggcgtgcatgtacctgcgcctcacgtcgatgacatggacagattgaataaactgctcacgggcttggtgaaacaggagaggtagcatgacaagcactgcttgggagacttgacctcagtaagatgattctggctggnggccgtagattaca

SEQ ID NO: 44005 - DNA, 448 bp, Zea mays
  unsure at all n locations
  Clone ID: LIB3066-045-Q1-K1-G6
cccacgcgtccgctgctgtttatgctcctgcaacaatgaatatgctccaaactcctccatgtcatagcaacagccatgaaaaagagtcaggtgcagttttttcaaatagctttaacatggccccatcagtgacacctacctccccttttcaacttatgtctccaagctcaaccaactacacttccactcaaatcttcgaggaaaccaacaatttagaggacacttcaagagtctttggaggtggggataacgaaagcaacaacagtgaggaaccggatcccaagccggctgtggagatggaagacctaaaccaaggcaatgatcatacttcgaataaaacagctaactgtcaagattaccgtatggtcctgcgcaaggacttgacatacagtgatgttggaaacattggaagaatcgtgctgccaaagaaagatgcanagcctaacct

SEQ ID NO: 44006 - DNA, 417 bp, Zea mays
  Clone ID: LIB3066-045-Q1-K1-G7
tggcactaagaaccaaaagtatgataaaattagtgaaaagaaaatgcttacctcggcagaggtacttctttttgccaacacgaacattgtaatcctgtcatggtagctgttgcagacactgtttgaactaacattgtcttaaacagattctgtgcaaatcttacccgccggagttcgtctcatatttccactattgtcgatccctgcgatttgaagacaggccagattactatccaatgaagaagctctttcgtgatgtatctatacgggatggataccaatttgattacgcatttgactggactgcactcaagtacccttaaatgggctccaacaacaagctagttcaacaaccaagtgcaagaatggcttgggttggaccatcagttgagagaacagacaaagcttacatggggc

SEQ ID NO: 44007 - DNA, 448 bp, Zea mays
  Clone ID: LIB3066-045-Q1-K1-G8
atgagcccccgggtgctcgtgctcgtgttgggttgactggtttgactgttgctgaacattggcgtgatgctgaaggacaagatgtgcttctgtttattgacaacattttccgtttcacccaggcaaattctgaggtgtctgctcttctttgacgtatcccatctgctgtgggataccagccaacccttgccactgatcttggaggactgcaagagcgtattacgacaacaaagaagggttctattacgtctgtccaggctatatatgtgcctgctgatgacttgacagatcctgctcctgctactacctttgcccatcttgatgctacaactgtgttgtcacggcagatctctgagctgggtatttatcctgctgtcgatccactggattccacatcaagaatgctttctccccacgtgctgggtgaggatcattacaatactgttcg

SEQ ID NO: 44008 - DNA, 256 bp, Zea mays
  Clone ID: LIB3066-045-Q1-K1-G9
acagcttgcatacagtagagcaggggaacgagaagttaacgacaggaaagtatacaggagaagagagagcagctgctgctcatgagagaagacaaggactatgccatacttgtagatatgatccacgctgcgcttctgaccattacctttttgcgtactgcagatagaagataatcgcacgatgacgtagcaactgaactgacatctgcatccgaactatctgaagtacgcctaggaattgcagacacattcttag

SEQ ID NO: 44009 - DNA, 351 bp, Zea mays
  Clone ID: LIB3066-045-Q1-K1-H1
cgccatcgagatcagaaacttcctcggcgagaagaaggtcaggaaggtggacatgcttgatggcgtgaccatcctccggtccgagaaggtcaaggatgagctcatccttgacggaaacgacgtcgagctcgtatctcgctccgccgccctcatcaaccagaaatgccatgtgaagaagaaggatatccgaaagtttttggacggtatctatgtgagcgacaagggcgtcatcgaagaggagcagtgagcgacagtgtagccgaaatgccaggagatgaatatgaatgtcgtttgagttgcaattttgcgagactgaatgtgaacctttttctcattccttaaatagttgac

SEQ ID NO: 44010 - DNA, 326 bp, Zea mays
  Clone ID: LIB3066-045-Q1-K1-H10
gcgcccacgcatccactcactcatccccacgctttccctttactttaccaggtcaataaatatatgctcaggtgtcaattctaaggatacaccacatatatcaatatgacaatcatccactcatccgctactactacttcatcatgtctactacctttgatataaaattctcacctactgtctactactgatgatctgcatatctacgacgtttcttgctgcaaatcttaatttaataatgttctgcttcagattgcggagctgataacaccgtgaagctagtagacgtcatccattgccgttaatgtagccaccgcatcctctac

SEQ ID NO: 44011 - DNA, 458 bp, Zea mays
  Clone ID: LIB3066-045-Q1-K1-H11
cccacgcgtccgcccgatcaaccagatcttcctcctggacgatgtccagcagatgatcgacggctgcgatgagaagctcaactcctccgcgggcgtattctccactcgcctgcaggagaactccatgaagatcaagggagtgctgaaccacatggagcacgaactgtttgctgttgcagctgttatggctggcctatcaatactcggattcttgttctccgtactgaggttgcggatgcttgtctccctactggtgatcgctgctcggatccttctcaccaataccatcatcaggtctggtctgttgctactgttgcacatcgtggtggcggacacgtgcgtctcgatgggcgattgcgtggcgcaccacgacgcgcacacagcgctggacgacatcgctccgtgcgtggacgtggtcaccgctaacgagtcgctgtaccggagccaggaggtgacgt

SEQ ID NO: 44012 - DNA, 429 bp, Zea mays
  Clone ID: LIB3066-045-Q1-K1-H12
gcgcccacgcgtccgcccactcgtccagaaaactattcccttactatatccagcaaataaatatcggctttgttctcaaacccaagtatacacgcacacatatcaaacagacactcacccaataactccatactactacagggccatgtctactaccctcgacataacattgtcacctgctacctactaatgatcaactccatatctcccaccatccttgttacaaatctcaacttaataatgctctgcttcacactgccgagctgagaacacagtcaatctactacacccatcacactgccttgaatgtagccaccgcatcctctacactaaacacactcgtccaactctacaatctaaagcacgctgcacaatgacgaccccacaaaaacactcgacatggctgatctcttactcgtcactcaccta

SEQ ID NO: 44013 - DNA, 354 bp, Zea mays
  Clone ID: LIB3066-045-Q1-K1-H2
gaacgactcggcattgggagatttcgctgagcactcgccattcgggagcagcaattcgctgccagagttgggaccagatggcacacaagatctagccttctaccaaagaagcagccctgaacagcaatggagctggtccgggtctgttgcaacagaggattccgatgacttcgaggttgcaacgaattgctcgtcagatctggattgcgtgagaccatctagtgccccaaaagcttctggtttaacaaacggagggggctcagctgcaagaaagtcccaactgaagggtgcaaaaagttcagacatcataggagggaatcctgcaaaaaagtcatcgtcgttacagaaaaagct

SEQ ID NO: 44014 - DNA, 412 bp, Zea mays
  Clone ID: LIB3066-045-Q1-K1-H3
acggacgcgcagtcgcccattccgcatctcgccctcccgtcccgtcccgtgccgtacgtccgtgctccgattggccgccgcccgcctcgccctcctcgtcaacaaaagcccaccggaagcgagcgagcgagccaccctccccgccggcgacaccgtccccgtcccgacactaccccgactcctactgaccgccggcgtggggtgcccgggctccaccttcggcgacgacaccgttcccgccgcgcgcgccctcaccgtctgctccgtttgcgggggtagccggtgctccggcctcggcagctcttaaagccccctgcctcacaacaagatccaaaattccgtactagacttcttctacctccccttccagaactttctcttttggcatcccggacggtcgatctcgaccccc

SEQ ID NO: 44015 - DNA, 212 bp, Zea mays
  Clone ID: LIB3066-045-Q1-K1-H5
cacaaccagaagccacccattgcgtacgcgaggcgatcgggcatccgtcccagaggagaaactccggccggcgacgcgggggaaaatggggaagacgccggtgcggatgaaggcggtggtgtacgcgctgtcgcccttccagcagaaggtgatgccggggctgtggaaggacatcaccaccaggatccaccacaaggtcaccgagaactgga

SEQ ID NO: 44016 - DNA, 428 bp, Zea mays
  unsure at all n locations
  Clone ID: LIB3066-045-Q1-K1-H6
cccacgcgtccgcttcgtactcgcctacctccgcggctcaaacctttcccccttctgccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgncagctcttncaccctgagcagctcatcagtgggaaggaagatgcagccaacaacttttgcccgtgtcactacaccattggc

SEQ ID NO: 44017 - DNA, 187 bp, Zea mays
  Clone ID: LIB3066-045-Q1-K1-H7
cccacgcgtccggacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgtgaaggttc

SEQ ID NO: 44018 - DNA, 334 bp, Zea mays
  Clone ID: LIB3066-045-Q1-K1-G12
gctagggacctactagctcagcgccatgcacacgtgtttgtctactacgtatggacctcgaggcttgtgcggtggcattggcgtgcatgctgatggtatgggatcatgggagtttggagctgctgtggaacacccttccaaagaagctgacttgtggtgtcaatgccacctgataccttgaacagaaacgactctttcctaggctggcgtgtatccacaaatctgtcgtcacatacacatcacgtacgagaagtaccatggaaattgtgtatactacagttgtttcatcagagaggattttacgcaatgactgtcacgccggagactacattat

SEQ ID NO: 44019 - DNA, 420 bp, Zea mays
  Clone ID: LIB3066-045-Q1-K1-E9
gcatcgatcacgacaagatggcatgcacaaacaatgcgatgagagccttgttcctcctggtgctctggtgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcatgaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagaatctacgcgtggataacctggtcatcaccggca

SEQ ID NO: 44020 - DNA, 473 bp, Zea mays
  Clone ID: LIB3066-045-Q1-K1-F1
gcagcgaccggtcacgcgagacaccacgcgttcaactcgattaagcagctatcaaccaaccttagaaagctagagggcgtacccatggctcgcgctagcgtcttctttgtcattgccgctctcctcttcgtcgccatggtcgcagcaccgatggccgaggcaaagtccgtcgatgcccctgtggctgacgcgccagccgatggacctagcgggccatctgctgcacctggcccccagggtgtcgaacgcctgtcaggcaatgaggatgacgacgatgactccaccaattgaggccacacacgtcggcccggttaaatttggaacacgacatggaagacaaatgagagcaatgtctttaagaccatgataatgtgtggtcattcactcatccatggatacatccttgctctgcctctgtttctttctgtacgatcatcaatgtgttatcatgttgttagctaactgtatcgact

SEQ ID NO: 44021 - DNA, 447 bp, Zea mays
  Clone ID: LIB3066-045-Q1-K1-F10
cccacgcgtccgcccacgcgtccgctaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgaccttcgtggacactccaggagttttatcaggggagaagcagcggacgcagcgcagctacgatttcaccggagtcacgtcgtggtttgcggccaagtgcgacctcatccttctcctgtttgatccgcataagctggacatcagcgatgagttcaagcgtgtgatcgggtctctccgcgggcatgatgacaagatacgcatagttctcaac

SEQ ID NO: 44022 - DNA, 414 bp, Zea mays
  unsure at all n locations
  Clone ID: LIB3066-045-Q1-K1-F11
ctcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggngtgaccgacgcgaacggcacgtacacgatcgagctcaaggacagccacgaggaggacatctgcgaggtggtcttggtggagagcccgcgcaaggact

SEQ ID NO: 44023 - DNA, 448 bp, Zea mays
  Clone ID: LIB3066-045-Q1-K1-F12
cagcggatgagtgcgacggcgacgaggccggcgcgctggtcgccgccgcctgcaccggcagcggcagcgataccggctcgacccgggacgcgccggcggtgcggtccccgcgcgccgcgtgggcgctgttcgtggaggagtcgcggaggctgtgggcgatcggcgcgcccatcgccctgaacatcatctgcctctacggcaccaactccacgacgcagatcttcgcgggccacatcggcaacctggagctctcggcggtggccgttggcctctccgtcgtctccaacttctccttcggcttcctcctcgggatgggcagcgcgctggagacgctgtgcggccaggcgttcggggccggccaggtgtccatgctgggcgtctacatgcagcgctcctggatcatcctcgccgccttcgccgcgctgctcacgccgctctacgtgtacgc

SEQ ID NO: 44024 - DNA, 261 bp, Zea mays
  Clone ID: LIB3066-045-Q1-K1-F2
cggacgcgtggggacgttggcaagagaggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcgtcgtcgtcgtcgtc

SEQ ID NO: 44025 - DNA, 455 bp, Zea mays
  Clone ID: LIB3066-045-Q1-K1-F3
cggacgcgtgggcggacgcgtgggaagcaagaaaactagaaaaggctcctcccgaccgcagcgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaagcccaccatcacgtcccgcgagatcca

SEQ ID NO: 44026 - DNA, 451 bp, Zea mays
  Clone ID: LIB3066-045-Q1-K1-F4
cggacgcgtgggcggacgcgtggggtaagcgcaagatcaagccatcagcggcaacccatgaggattccaacatgatcccgcgcaagcccgtcgaagcagtggtggtgggtaagggtaaggtggccaaggataccgtgtccgagtcacctgctccaagccccgcccccgtctccgccccttagttgcgtgttgggcgccgctgcccgccggcccccggccaccatgcgtcgtgtctgcgcgcgcacgcacgcattgaacgggagatagaatatggtatcgttcaatgcagattgccatgctatagctccagagtttatctacctggtagcaccatgacacgatggcccgttcgtattttctggcttgctcgtacttttcagttccatggttttacaacaccttttactcccagcagaaaatccttaatatgcatgtactcctctttttttcc

SEQ ID NO: 44027 - DNA, 455 bp, Zea mays
  Clone ID: LIB3066-045-Q1-K1-F5
cccacgcgtccgcccacgcgtccggcaggatcgagccgaatcctccggaactcgccgccgggacgaaccgacctcacactattgatcgaggatgtcgtacgcctacctcttcaagtacatcatcatcggcgacacaggcgtggggaagtcatgcctgctgctgcagttcacggataagcgcttccagcccgtgcacgatctcaccatcggcgttgaatttggcgcccgcatgatcaccatcgacaacaagcccatcaaactccagatttgggacacggctggccaagaatcattcagatctattactaggtcatactacagaggagctgctggagcccttttggtttatgatatcactaggagggagaccttcaatcatctcgcaagttggctagaagatgccaggcaacatgcaaatgctaacatgacagtgatgctgatgggaaacaaatgtg

SEQ ID NO: 44028 - DNA, 410 bp, Zea mays
  Clone ID: LIB3066-045-Q1-K1-F6
cgactacatgagccagtaccaccgccccccgccgccgcccgtggcgtaccacccgtacgcggcgccgtcctcgccgtccccgcagtactactacgtgcgcaacatgagcatggaggagaacccaaactcgtgcgccatctgctgaagcaatcgatcccggccgctttgtctgtcgcgtcgcgcgcgcgaacgtgagtacgtacgtgtctaccggcccggcccgccccgccccgtccatgtgtacatccgtcgtcgtgttacgttattattacgatgagaagacagacgaatcaaactagctactcgtagcttttattattttgtgagtccaaagtccaaaccgtatagctgccagttcgtgaatgaatctgtaattaaattctccatgaaaaaaaaatgactccaagctg

SEQ ID NO: 44029 - DNA, 421 bp, Zea mays
  unsure at all n locations
  Clone ID: LIB3066-045-Q1-K1-F7
accagtgcaccgtcaccaggcggtcgccatacgattcaccgcgcacgtaacatgagaacagcgaaaacgaagatgcttccccgggcggcagcggacgaggagacgagagagggagagatggggccggacctcctgggacttggcttgctgccgccgccgatggccggcggcggccacggaggtggttcagcggcgcatcagaagacgggattcgacgagcccctacgtttcgccgctgacgcccctttgccggtgcgcgcttgcgtgcgcccgcggccccggcccgtggacgtggacgacggcgtcgtccctgcagcaccttcggcgagcatgccgaagccgnccgcgtcgtcgacggcacggtgggcgccagctgagctggcgtcgtccccgacgaagctcggttctttcagggagatct

SEQ ID NO: 44030 - DNA, 231 bp, Zea mays
  Clone ID: LIB3066-045-Q1-K1-F8
cccacgcgtccgcaggacggtcttgacccctcttctagattccctttttcttctggattgtcatcacatgatgggtctaatcagtcgtatggctcaacgaacccagaaaatcttctccggggtactgttcacggtggcaacagtaatcattatcaatctcagtttggaaggcactcaagtgacatggagtttgatgatcctgctatattagccatgggcaaagggctgatg

SEQ ID NO: 44031 - DNA, 309 bp, Zea mays
  Clone ID: LIB3066-045-Q1-K1-F9
atcaccatcatgtgctgctctagctgctgcgtcattatatattacatcgcgtatacgtataggtacggattcatacgtcttggaatcaattactgtgggtattgtattatacatatgcaggacacttagggcttgtacccgtgcctgtggctagtcattaatgagggagacatgcttttactgatctaatgtatgtagactcaattacatgctattacgatacgggatactatgcacactacttttccatcatcagcctgaattgagcgcttttgcgagagttgacactgtgtactcaaccactgtctg

SEQ ID NO: 44032 - DNA, 212 bp, Zea mays
  Clone ID: LIB3066-045-Q1-K1-G1
acgcagaccccttgccgcacaggatcgaccaggtactactgagctcgcttgctgcatggctcgtgcccgggcgatagacttacctactgaatgctactactggagacgagagacggttagacggtgatcgccctcatgatactcggctagctgccggcgtcgacagactgcatcaacttgctacgggcttgctcacaccataagactacggt

SEQ ID NO: 44033 - DNA, 465 bp, Zea mays
  unsure at all n locations
  Clone ID: LIB3066-045-Q1-K1-G11
cccacgcgtccgcacgccacaggcaaggcacagaggcttgtgagggagagcgaggagcggaggaggacatggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagattatggacagtgatacaggcacagcagatgactttgttggtgaagcaacgattccattggaagcagtgtatactgaaaggagcattccaccaacactctataatgttgtgaaaggtgaaaaatactgcggngaaatcaaagttggtctcacattcactcctgaggatactcgccagcggggtctcc

SEQ ID NO: 44034 - DNA, 398 bp, Zea mays
  Clone ID: LIB3066-045-Q1-K1-E7
acgcccacgcgtgcggactagttttagatcggtttaacttgggggctttaaaaaaccccgtcgcgaacggtttgcccagcccctcagagtcttcaatattcccacattccgcccaccaatcgactttacgccagtctcgcactcttctgaaagcgtctcgcgcgcctgttttagaaaggaaggaggacaattacgcagtgctctatgtccacatctggcacgcctgcatctaagtctggaacacccgctctggaaattactgactacagcacgtgactgcagcctgatggccaaaagcctggagataagaccgctgggcatcacgacattgaagacagatgagagcaatgtctgtcagaccatgataatctcgggtcatgcactcatccatggataca

SEQ ID NO: 44035 - DNA, 304 bp, Zea mays
  Clone ID: LIB3066-045-Q1-K1-D2
ggaggactccacgcgcgagcccgcccgcgccacctaccgccgcgcccggatccccgccatggccggcgcgccgcaccgggcccaggtccacgctgatagcacgactccgctgcagacggagcctgtacttgagaataacccctgcaagagtgcaaacgccaaggaccagattctttctggtacagagaatgtgactacaggcaatgcacggtgcgctagctacttgagaccgcccaacggtccaccagagaaggctagctctgtgggaaaagctggagagcaaccttatctctaccagcaaaat

SEQ ID NO: 44036 - DNA, 272 bp, Zea mays
  unsure at all n locations
  Clone ID: LIB3066-045-Q1-K1-D3
cncacgcctcccgcgaccccttggccttccttttcccggcccttccggccgcggccgttggggtggccgccttcgaaggcttccgccggccgaacaaggcccttccccaggccttcaaaggccggtggcggttcattcttaaccaattgaacggctttctcattgtccacctcaatcgcgccgctgaggcaccgcgacgacgcgcccgagaagtatgggggtggcgtcggggctcgccatgccgtgcaggcctcagctcagcgtctacatgc

SEQ ID NO: 44037 - DNA, 352 bp, Zea mays
  Clone ID: LIB3066-045-Q1-K1-D4
cccacgcgtccggaagcaactgaaaacagccgagcgatctcctctccctctccctgtccgatccattctccagcgcagcgaagtaaacatgtctgaccgggcaaagatgtcgtggcaggcgtacgtggacgagcacctgatgtgcgagatcgagggccaccacctcgcggtggcggccatcgtcggccacgacggtgccgactgggcgcatagcacggcgttccccgagttcaagacctaggacatggccaacatcatgaaggacttcgacgagccatggcacctcgcgccgtcaggcctgttcctcgtacctaccaagtacatggtcatccaaggcgagcctggtgccgtc

SEQ ID NO: 44038 - DNA, 435 bp, Zea mays
  Clone ID: LIB3066-045-Q1-K1-D5
atggctgcaatgcttgagaagcagtataacagtgagatcaattcattatctcatctgtacgacaagaatgtgatcaagcttgtagcagcctacaaatgcccaccagttttttacattattaccgagttccttcctggaggctcaataaggtcatacctaaacaatccagagaaccaccccatccctctagagagaaccatatccatcgctctcgatgtcgcccgtggcttggaatacatacattctcaggggatcgttcaccgtgacatcaagcccgagaacattctcttcgacgagaacctctgcgtgaagatcgctgatttcggcattgcctgccaggaggccttatgcgatgtgctcgtggaggacgaaggcacttacaggtggatggcgcccgagatgatcaagcagatagcgtacaaccgaaaggtcgac

SEQ ID NO: 44039 - DNA, 368 bp, Zea mays
  Clone ID: LIB3066-045-Q1-K1-D6
cccacgcgtccgcccacgcgtccgcactaatccaagacaaaacatggctgtgaatgtgagaaccatgtggtcgtcgatgcgggctcaggttgcgatggttgtggcgttggtgttcttggtgagcggagcatggtgcgttcctgataaagggcctccaggtaagaacatcagggctacctatggcatggactgcctggtcgctacagcgacatggtttggcaaggttactgatgccggacatgaccataatggtggcggatttggatgcgcggacgtgaataaggccgactggactagtactggcacatgccgagtccatggtcattcaaaggatgccttgtgccgtgattcctgcttcgagatgatct

SEQ ID NO: 44040 - DNA, 449 bp, Zea mays
  Clone ID: LIB3066-045-Q1-K1-D7
cgtgcatctggtgaagcatgcaatgatggtcagtctcatggtgatgaaaatatgaaactgggtgaagcttacactgaactgcagctggcaccttcctctggtgaggaggccatgacatgtatgtgtagtgagctgcccagccaggaggtggaggctccaagcagtgaccctttggagaataatgaagaaacgaaaaatgaagctgctgctcaaggatcagtaaatgaggattctgctcctcgtgctgaaaatgcaaagattgatgaagctgacacagaacaggaactgcttccatctggtgaggccacggtagacgaatccagcgagctactcagccaagacgaaaaggtggctcgtaaagatgcaaagatggaagagtctgctgctgctgctgctgcacagagacagctaactactgaagttgctcatgcaagtgaaaacgcgaaact

SEQ ID NO: 44041 - DNA, 445 bp, Zea mays
  unsure at all n locations
  Clone ID: LIB3066-045-Q1-K1-D8
cccacgcgtccgcccacgcgtccgcccacgcgtccggctgctcacggggcgccgccccatcgataccaccaactacatggaggacagcctcgtggactgggcgcgcccgctgctgagcgccgcgctggcgggggagacgggcttcgccgagctcgtcgacccccgtctgggaggcgagtactccgtcgtcgaggtggagcgcttggcggcctgcgccgccgccagcacccgccactcggccaagcgccgccccaagatgagccagatcgtgcgcgcgctggagggcgacgcatcgctggaggatctgcaccaggacggcggcaagcccgggcagagcgtgctcttcttcggcgggggcttcgacaacatctcccgcctaaggcagctcgccttcgacagcggcgactactcggactacagcaccgactcctncaccggtggtggt

SEQ ID NO: 44042 - DNA, 437 bp, Zea mays
  Clone ID: LIB3066-045-Q1-K1-D9
cccacgcgtccgacggtcgctcccacctttccgcccggcgaaaccctagcccgtcccgactggccgactgcgatgggcgctgcatgatcggtgcgtccccttggaaccgactgccttctggcatcgccaagcccgctgccgcggctgccgtcgtcgtagcggcgctcgcgtcctccttcctcgccctcccgcgtcctcgcgccgccccgcccccagcgggatccgggcccctcatgtcgaaggcaaaggtctacaccgacgtcaacgttctgcgtcccaaggagtactgggactacgacgcgctcaccgtccaacggggtgagcaggatgactatgaagttgtcagacaagttggaagacgtcaatatagtgaggtctttgaaggcatcaatgttgacaattatgagaaatgcatgattaagatccttaagcctgtc

SEQ ID NO: 44043 - DNA, 459 bp, Zea mays
  Clone ID: LIB3066-045-Q1-K1-E10
gcttcggtggtccaccatggcgcagcgagcggtggccacgatgacgactaataagcccctggtcctggtcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggacctcaagcccggcgctcagttccgcgagaagctgttcctgaacatcagcaagccgttcatcacgttccggtcggaccccaagaagcccgccgtcgtggtctggaacgacac

SEQ ID NO: 44044 - DNA, 457 bp, Zea mays
  Clone ID: LIB3066-045-Q1-K1-E11
cttaaatacatctaagtggatagaggaagttcgcactgagaggggcagtgatgttatcattgtgcttgttgggaacaaaactgaccttgttgacaagaggcaagtctcaatagaggaaggggagggcaaggcgaaggaccttggagtcatgtttattgaaaccagtgctaaggctgggtttaacattaaggcgctgttccgtaaaattgctgctgcacttcctggaatggagacgctctcatcagcgaagcaggaagacatggttgatgtgaacttgaggtccggcaaatgcaaactcgtcccagtctcaggctcaggctgggggatgcagttgttagttgcagtctctgacacttgcttgctcatgatctttgggactctgagcatcagaaagcgttatcactgatgcttctcttcggaagaagagttgattgcctctcgccagtgaacacaccat

SEQ ID NO: 44045 - DNA, 426 bp, Zea mays
  Clone ID: LIB3066-045-Q1-K1-E12
gcgcccacgcgtccgcgatggtaaattatttactgttggaggcaatgacggaaaaaacaaatttgaattggtaaacagagaaaagaggaaactgacacttggcgacattccattgtcccttacatgtgcacttcataaaggatctatactaacggacccaacttctgaagaagaatcaattatagagacctatgtgactgttgtcgttgattcttcagaccgcctagtgtcattacaaaaagttggaggcacagtgacatccatggcaactattaaggagtgcattagcttggcgaaagaaaggaggctgaggctaagagaaattctgatagactctgtcaaagccatggaagtcgaccatactgaataattctgcagatacattcagttaatctaaccggggatattcttgatgggtctctgtgc

SEQ ID NO: 44046 - DNA, 341 bp, Zea mays
  Clone ID: LIB3066-045-Q1-K1-E2
cccacgcgtccgcccacgcgtccgcccacgcgtccgggagaagaagaaaaggaacatttagacctgcctcactcacttaggcgtcttggagagtgtacattttatgatgatggcactgctaagggagagttgcctgaaacagtttattgctttgatggtgtcttctataattactttagcataggaatggatgctcaagtggcttatgggtttcaccaattacgtgatgaaaagccatttcttgcaagtggacctttatccaataagttgatttacgcaggatatacctgcaagcaaggatggttctttacgcaatgtattagtgatcctgagttaaaggg

SEQ ID NO: 44047 - DNA, 432 bp, Zea mays
  Clone ID: LIB3066-045-Q1-K1-E3
cccacgcgtccggactagttctaggacggcttcacctcggcgtcttcacaaacgccggcgcgaactctggcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttccgtgatctagaacccactgtgatcgatgaggtgcgcactggcacgtacc

SEQ ID NO: 44048 - DNA, 273 bp, Zea mays
  Clone ID: LIB3066-045-Q1-K1-E4
aaagtttctagtctagaaaaggagcgtcagcatcttcaatctactgtcaaagctcttcaaggagaaaagaagctattgaggaacattcccgtgaatgagaaggcaacaactactgtagagaaaccttgggttgattaaagagacgcattaactggcacagaagatttagatattggggaaaacagctctttagaaacgcttaccaacactgttgacacatgggaagatgctggaatatctgttttgcgtttcaacattatggctgaattttct

SEQ ID NO: 44049 - DNA, 449 bp, Zea mays
  unsure at all n locations
  Clone ID: LIB3066-045-Q1-K1-E5
cccacgcgtccgcgctgcctcgaggaccttagcctggcccacgagcttcgtatgctcgtatgcacccacggtgccactagcgtctactcgatgctcacgctcagtcacctctccaggggcagggcaccagtcgtcgccgtgtacctgttgcaccttgtcgagctcgcgacatcgcgcaagtacgccatcacgcagcagctataccacgcccgggatggtggcgacgatgaggacgagtggggctacgcacgtgagatcgagcatgtggcctncgccgtggctaccttcacctatgacaatgccatcctcgtgcggcagatgacggccatatccagcttgggctctatggacacagacgtgcgcaactgtgtggaggatgcgcgtgcgtcgctggtgatcatgcccttccacaaggagcagcgctacgatgggcgcatggtgtgccggca

SEQ ID NO: 44050 - DNA, 401 bp, Zea mays
  unsure at all n locations
  Clone ID: LIB3066-045-Q1-K1-E6
cagagacaccaagcgttgaactcgcctaagcagctatcaaccaaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacattgaaggaaaaatgagagcaatgtctttaataccatgataatgtgtggtcatccactcatccatggatacatcctngctctccctc

SEQ ID NO: 44051 - DNA, 374 bp, Zea mays
  Clone ID: LIB3066-054-Q1-K1-G3
cggacgcgtgggcggacgcgtgggttcttgcttctgcttactcgcatgagttgccacgatgtgggcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggat

SEQ ID NO: 44052 - DNA, 382 bp, Zea mays
  Clone ID: LIB3066-054-Q1-K1-G4
cccacgcgtgcggtgcgtgcctagcatgcatgcatgtgacgacctctcctgctcgctgcgtctcggtatctgcaactgcaagcaaggaaattaattaaaagaagatcggcgccatggcggcaacgacgacgacggggatgcagatgatgcacgtgcagcacgcggcggtgatgctgctgtgctcggttgtcttggcggcgtatactccggtcgcgctggacaactgccgcgactactgcatggctgcatgcaacgggtggaccatcagctgccagatctcctgtgccagcgcatgctactgagaagtcgggatcacaaccttatgtacgtcggctgtattatgcaaagcagaagcgcctgcatcagcacctacagcagcaca

SEQ ID NO: 44053 - DNA, 438 bp, Zea mays
  unsure at all n locations
  Clone ID: LIB3066-054-Q1-K1-G5
ttccacaaacgcaagccccaatctcgccgtcaccacctcaatccagcaaacgcaaaccccgtctcgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacanccgccgccttcacgcncaacgctacgcgctctnctaccaggaacccatncncgtcgagcagctcgtccagtccctctgcgacaccaagcaggggt

SEQ ID NO: 44054 - DNA, 436 bp, Zea mays
  Clone ID: LIB3066-054-Q1-K1-G6
gcgctccagattcctcgtcgcgcgcgctgagcaggagaggcgcgccgccatcgtgcgcgcggagggggagagcgaggccgcgcgccttatctccgaggccacgaccactgcgggcaacggcctgatcgagctcaggaggatcgaggcggccaaggagatcgcaagcgttctgtcgcgcacgcccaacgtctcctacatccccgccggcgacaatggccagatgctgctcgggcttaacgccgcccggcttcagaatttcaggacgagatgaaactgttcttggtggggaggagggaaagttgtttctgtagagcttctagaagtgttgctaagagtctggttttgattaatgaaatggctggaagtctgtttgtgctcaatagagtgtttcttctgtgaaataaaactggtctatgagatggtgtggccagctctt

SEQ ID NO: 44055 - DNA, 388 bp, Zea mays
  unsure at all n locations
  Clone ID: LIB3066-054-Q1-K1-G7
cccacgcgtccgcgcttcttccgcagaagaacaaggagaaaagggaggggttcgtcacgaggaggaggaggaggaggaggtgcgtcgttccaatcgaaccccggcgcacaatctagaggccggggtggatcatcatcctcaccaagacagaactccatccccgttaaggtgttaaacattaatcatggccacaccgccagacggggcgcccgctggacctgatgacacgtcgccgccgccttcttccaactcgtcgacgccgcctccttccgactcatcgacgccgtcacccaagtcctccggctcgggctcgccgtcgccatcgccacccgcaccgtcgttgtcgccgncaccaccggcgtcgccgcaagatagcacggcgccagcg

SEQ ID NO: 44056 - DNA, 469 bp, Zea mays
  unsure at all n locations
  Clone ID: LIB3066-054-Q1-K1-G8
cccacgcgtccggctcaacttcacgtgcatggagatgaaggacgagcagcagccgcagcaggccagctgctcccccgagctgctggtgcagcaggtcaaggctgcgaccagcgccgccggcgtgcagctcgccggcgagaacgcgctggagcggtacgacgatgcggcgttctcgcaggtggtgtcgacggcgcgcggcgcaggcctggccgcgttcacgtatctgcgcatgaacaagacgctcttcgacggcgacaactgggggcggttcgtgtccttcgtcagggctatggccgacggtggcgcgaggccagcgctgccgcggtgtgacacggngcactcggacctgtacgtcgggtttgtcgacgccgtcaaggagaggaaggcggcggaggccaagggcgccggcaccaccgcagcattgtaggtggtcgtcggtagatgcccatgcatgtgcttgcataatgca

SEQ ID NO: 44057 - DNA, 269 bp, Zea mays
  Clone ID: LIB3066-054-Q1-K1-G9
acggctgcgctcacacatactcctcattcaatatattccatcctctacattatatgtcaaaccaacagatgtcgttcatcgaccacaagtgctacccctgctcatacaacaacgtcaataaggcccctttcaacaacatgagcgcgtgttgcaacttacccatcttcaaagactgtctaagttgtatatcctgcttctagatcaactgctacaagccaacatactactctctcaagcaccttctacatgtacattacttacataaacta

SEQ ID NO: 44058 - DNA, 395 bp, Zea mays
  Clone ID: LIB3066-054-Q1-K1-H10
acgcgtgggatcctgaccctcaagtaccccatctagcacggaatcgtcagcaactgggacgacggggagaagatctggcatcacaccttctacaacgagctccgtgtggctcccgaggaacaccccgtcctcctcactgaggcgcccctgaacccaaaggctaaccgtgagaagatgacccagatcatgttcgagaccttcaacacccccgctatgtacgtcgccatccaggccgtcctgtctctgtatgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagat

SEQ ID NO: 44059 - DNA, 396 bp, Zea mays
  Clone ID: LIB3066-054-Q1-K1-H11
cccacgcgtccgcccacgcgtccggaggagaggagaggagagactagacccgctagctgaggccgggcggcgcgctggacacgaacatgatggggagaaaggcgctcggctgtgctcctcttctcctcctcttggccgccgccgtcgctccggccgagctcagcgtcggggcggcggctgcctcgggcgcggtcacccgggccgacttccccgcggggttcgtcttcggcgtcggctcctccgcgtaccaggtcgaaggtgcagttgcagaggacggaaggaagcctagcatctgggacacattcacacatgaaggctattcccttgacaacgccacaggcgatgtaactgcggatcagtatcataagtacaaggacgacgtaaagcttctgcatg

SEQ ID NO: 44060 - DNA, 299 bp, Zea mays
  Clone ID: LIB3066-054-Q1-K1-H12
aattccaggtcgcctacgcgtacggagagactagacccctagctgagccggtggcgcgctggacacgaacatgatggggggaaaggcgctcggctgtgctcctcttctcctcctcttggccgccgccgtcgctccggccgagctcaccgtcggggcggcggttgcctagggcgcggtcacccgggccgacttccccccggggttcgtcttcggcgtcggttcctccgcgtaccaggtcgaaggtgcaattgcaaaggacggaaggaaccctagcatttgggacccattcacacatgaag

SEQ ID NO: 44061 - DNA, 306 bp, Zea mays
  Clone ID: LIB3066-054-Q1-K1-H2
acgcccacgcgtgcgaccagagagtcggtgagagggccccgccaccggcaataacccacccaggcccagtcagactcagagcctgcaggctgcagcgtgtcggcgtcccgtgctgctctgccgccctccggcgcctgtggcggtgacgcgcacatacgctggagtagctagctaggcaagcgagcggtggtggtggtcgagcacgtagcacaaccagccatgacgcgccgcgggacgctcccgctggcgctgctgctgctgctggcggcgacaaccaccgtgtccgggcagggccgacccgtgacg

SEQ ID NO: 44062 - DNA, 325 bp, Zea mays
  Clone ID: LIB3066-054-Q1-K1-H5
ggagccgatacagctctgctgctctctggatcaagcatgtgtggcgatgtttccgtgaacggcgcaccggtggaagactacgaactgccaccggaagcgtactcccatgcaggagcaaggtctccgggtccgggaacgccgacgggggaggccgtgaagaaggcggatgaggtggtgagcaccatgctggccaggggcttcgtgctgagcaaggacgcgctgcggcgcgcacagtccttcgacggccggcaccagcagctgctgtccacggccacggcgcgggtggcgtcgctggaccgacgactgggcctcagcgacaagttca

SEQ ID NO: 44063 - DNA, 390 bp, Zea mays
  Clone ID: LIB3066-054-Q1-K1-H6
agatctgccgcacgctctccaacatgatcccttacgaacatgtccattgatttggttggttctttttcccgacccccctactacgttcagtaacgtggtcgtcgtcgtcgttaagtgcggcggcctaaaacatatgtaatttgatgctggtcgggtgtgtctgtcagtcgatagactggacgcatgccgacttcatgcggacctagcgcgtgtgcttcttttcggtgttgcctcatgcggcgtggcacatgtcttgagaccgtgggatggaacggctcgttgagaggcacgcgtgtagggcagcctatatatatgattctataacatgctaaatttgtgcttctttattactatatatatagccattcatcattcaattcactaggaaca

SEQ ID NO: 44064 - DNA, 407 bp, Zea mays
  Clone ID: LIB3066-054-Q1-K1-H8
ctcgcctgcaggagaactccaggaagatcaagggagtgctgaaccacatggagcacgaagtgtttgctgttgcagctgttatggctggcctatcaatactcggattcttgttctccgtactggggttgcggtttcttgtctccctactggtgatcgctgcttggatccttctcaccaataccatcatcagttctggtcttttcctcctcttgcacaacgtggtggcggacacgtgcgtcgcgatgggcgattgggtggcgcacccgcaggcgcacacggcgctggacgacatcctcccgtgcgtggacgtggccacggcgaacgagtcgctgtaccggaaccaggaggtgacgtcgcatctggtggcgctggtgaacaacgtcgtcgtcaacatctctaaccggaac

SEQ ID NO: 44065 - DNA, 312 bp, Zea mays
  unsure at all n locations
  Clone ID: LIB3066-054-Q1-K1-H9
cccacgcgtccgcccacgcgtccgcggacgcgtgggcacgagttcgacaacgatgacgggcgcngagggcctccattgtgatgcgatgcgaaggctgtggacagaaaataggaaaacgttttgggatttgtctcgtctgtccgctccgctccccctacatttctttgctgtttagtacataattctagatttacagaaaagacaaagtttactcttttctggatcatatgttttgtgctacttattgctgttctggccgcattgggccagcatgcagttattcacgggttcaacctgacaagcgctggctgc

SEQ ID NO: 44066 - DNA, 365 bp, Zea mays
  Clone ID: LIB3066-054-Q1-K1-G2
cccacgcgtccgcccacgcgtccgaaacgcgtcgcatccgctccacaggatcctctgcgcgaccggaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgcccgggggcgccggcggcggggaggagctctcggtggaggagcgcaacctgctgtccgtcgcctacaagaacgtcatcggcgcccgcagggccttcgggcggatcatctcctccatcgag

SEQ ID NO: 44067 - DNA, 384 bp, Zea mays
  Clone ID: LIB3066-054-Q1-K1-E9
cgtacgcatagcgcattatccttttgagctcaacttgtcatctatgatatgtcttgcaactgatcaggtgtgggctacttcatgattcagatcgctgctagcatgaccaagatttacatggtgcttcaacttgtcaatgggggcagaactgttcgactggattaaaacatacaagatgcaaatatggaggaacaacaatcttccttggtggatggacttaaaactcccactactgtggctgatcaagaattcacagtcgtggagtgcttgtccaatcatgagtatcactcgcagactcttggatatgtaattggtggaactaacatgagatgcgacacctaccatctcacatgaaggatcaatctcttaattgccacactggac

SEQ ID NO: 44068 - DNA, 363 bp, Zea mays
  Clone ID: LIB3066-054-Q1-K1-F1
aaagaaagaaagagtgatcgtcatggagagcaggaggaagaatcaacagaagacgagctagagttgggatttccatccagctgctagcggccctcctactcttggagcttgtgtcgctagtgccgggggcgtcatgcgaggagttgcccttggatttttgggtgagtgcactacggggggtcggggcaaaggacgtttcaacagccgatggatgcaccaataagaataaggacaccgtgctctgctctgcccaggctaacacggtaaccaatttcatcaaccctaccaactctgaggaacaaggctataggaccatcggggagtccatcggtaacatccctgatgatagcaccaaacgggtca

SEQ ID NO: 44069 - DNA, 301 bp, Zea mays
  Clone ID: LIB3066-054-Q1-K1-F10
acatgttcacgcaatccatgatttacatttaccagtagatgccgtcaaaataagcgtgggttgatgtaaggtcaccatcggtttgcccaacgtaccgatgctcgacctgtaacaatactgcatcgccaatctccgtgccgaatctatagtactgatggaacatattccggtatgctcgcaagaactactcaaacaacaagattctgagccgtctcgaaattgtacacggaaaggctggcagctacacatggctcacttacaagcagctatactacaccgtgctcaatgttaggtctgccat

SEQ ID NO: 44070 - DNA, 402 bp, Zea mays
  Clone ID: LIB3066-054-Q1-K1-F12
acggcaaggcaaaacctgactgctcgggcaatccagtcacggtgtacatcactgacatgaactgcgaggctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaaggtctgcaaccccaactacctggccgtgctggtgaagtatgtggcggacgacggcgacatcgagctgatggaaatccaagacaagttgtcggctgagtggaagcccatgaagctctattggggcgccatctggaggatggacactgccaaggcgctcaagggcccctttt

SEQ ID NO: 44071 - DNA, 429 bp, Zea mays
  Clone ID: LIB3066-054-Q1-K1-F2
cccacgcgtccgcccacgcgtccggaacctgagcgcctaattaaggaatttgtcactttgaaggcgatatttaaatcacatgtgctgagggtgcacaaatccaaatttgcacagtttatcatgttttatgcttgttccctgcatcctgagattggcgatggctttgctaattttcttactgatatttttattgacaaggacaaaaacgaggatgcaattactagagtgtctgcagtttcatatgttggaagctatctgtcccgggcaaggttcatttccgtaaatatagttgtttctgtactcaaaaggctagtggactggtgtgattattattgtggccatcagctggacaatggggtgacagcaaatcctataaagcaccagctattttatgctagctgccaggctgtgatgtatgttctatgcttt

SEQ ID NO: 44072 - DNA, 424 bp, Zea mays
  Clone ID: LIB3066-054-Q1-K1-F3
ggccaacacacattgtttacattgctcatgggaaactgcaattagcactgcctttggaaaaggtgaaagaaatgagtcagttatctctcatgaggactgtggagagctggttgaggaaagaaagagacgaggacaggaggaggagaaaggagcgaaaggagaaaggcctcccagaattcgacaaggttgtcgagggtagtcgggttataggtgatccagcaaagaacgcagacagagttataaacaacgggtgggcagctggacggcttacctcgacgattgcaggagaggaaaatttcgtcttcagctctaacagcgtacttaggcaatgatctagttttggtttcctttatctatacattggaaacggtaataatagtcttgcggatccaatagagatatcgtgggggcttgggcatttata

SEQ ID NO: 44073 - DNA, 421 bp, Zea mays
  Clone ID: LIB3066-054-Q1-K1-F4
atcacgacaagatggcgtgcacagacaatgcgatgagagccttgttcctcctggtcctctggtgcgtcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccgggcaggggaa

SEQ ID NO: 44074 - DNA, 429 bp, Zea mays
  Clone ID: LIB3066-054-Q1-K1-F5
cagaaatcaatacccgaaaagtggtcggcacatacggttatatgtctccggagtatgcaagggatgggatcttctctgtcaagtcggacgtattcagctatggagtattgctgctggaaatcgtcagcggtaggaggaacagaggagtgtattcctattcaaacaaccaaagccttctaggccatgcatggagcttgtggaacgaggagaagagcatagagctagcagacgaaagaatgaatgggtcgttcaactcggacgaagtgcagaagtgcatcagagttgggctcttgtgcgtgcaggagaacccagacgaccgtccgctgatgtctcaggtgcttctgatgctggctagtaccgatgccacctcactgccaactcctaagcaacctggcttcgccgctaggagagttctgatggaaacagaca

SEQ ID NO: 44075 - DNA, 400 bp, Zea mays
  Clone ID: LIB3066-054-Q1-K1-F6
cccacgcgtccgcccacgcgtccgcccacgcgtccggacatctactaccagcactggtatggcgcttctgccagagaagcactgcgccttgtttgatgaagcttgtggagccatggcgggcagtaatagtcctgaaggagtgccagtagtgacttctgctgatgaccctccgacccgtgccaatattccatttctctgcaattcagttgatgaaacctgtgaagccacagggggcggcagtgctcccttggagggtcagatatgtacgggtttctccaagttgatcagcttggaggtgaagaaaggcctccagaagtgtgcgacgttcccaccctcatctggtcagcctcagcaggaggattgttcatgctgccatgtatgtgacgggctcacgtgtgct

SEQ ID NO: 44076 - DNA, 466 bp, Zea mays
  unsure at all n locations
  Clone ID: LIB3066-054-Q1-K1-F7
cgccgatggagtcgcttgcctcgcaagcgaggccggcggcggtgctctggctcgccggctgcttccangccgcgcgcctccaccgcgttgtctccttctgcgccagctcgagggcactatccatcaggattgcacagtgcttnctgctgaacgggcttatcttccttgggagcttgcttacacttacatcggtggtcattccaactctactgtggatactacctgagcgatgcaatcaagcagcaggacatctttgtaaccccaggcaagcctatctaactattcaatcttgcgcttcgggcttggtgagattttttatgtattatgggtttatccactttatgtcttcagcttcatattaaggaccatttgggataatgacattgccaagcatgcatgggatgttgtgaaagtaagagcctagtttgacttaatcactggatgctcaccacgtaactgaaacaaa

SEQ ID NO: 44077 - DNA, 136 bp, Zea mays
  Clone ID: LIB3066-054-Q1-K1-F8
ctataacatgctaaatttgttctaaaaaataaaaaaaaaaaaaaaaacaaaaaaaaaaaagaataaatataaaaaaaaaaaaaaaaaaaaaaaataattataaaaaaaaaaaaaaaacactattcataatcataac

SEQ ID NO: 44078 - DNA, 391 bp, Zea mays
  unsure at all n locations
  Clone ID: LIB3066-054-Q1-K1-F9
attaacgtagcttcttctagnnctctagctaggctcgtctggctgcaagaaaggtaacacgcgcaggggtgggaggggaaggaggaggancgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcacc

SEQ ID NO: 44079 - DNA, 391 bp, Zea mays
  Clone ID: LIB3066-054-Q1-K1-G10
tgttaacttaccataacaacaactcaattcctatcgaattccttcctatcgaattcctatggtaaagttcctataggatagaacgtacacagggtgtacacattatatatgaatgaaacatattcattaacttaagcatactcctttttttatttaatgagttgatattaattaaatatctatttttttagatttttgcaaaggtttcatttacgcctaatccatatcgagtagaccctgtcgatgtgagaattcttaattcatgagttgtatggagggacttatgtcaccacaaacagaaactaaagcaagtgttggatttaaagctggtgttaaggattataaattgacttactacaccccggagtacgaaaccaaggatactgatatc

SEQ ID NO: 44080 - DNA, 399 bp, Zea mays
  Clone ID: LIB3066-054-Q1-K1-G11
cccacgcgtccgcccacgcgtccggagacagtgtacacatacatactctgctcgtctgctggggatcgatcgcttggtctcgttgttgcgtagataggtactagaggactatagctactagtaggactaggagaggatccgagggagagagagtaaggccaagatgatgcgcgcgaaccgggagcagagagtggccttctcgtcgacgaaggaggccgacgcggtgcccaaggaggaggtgtgggaggtccggcccggcgggatgctggtgcagaagcggagccccgacgcggacccaccccccggcggcgcgcccgtgcccaccatccgcctcaaggtcaagttcaacggcgtctaccacgagatctacatcaactcccaggcatcctttggcgagct

SEQ ID NO: 44081 - DNA, 404 bp, Zea mays
  Clone ID: LIB3066-054-Q1-K1-G12
aaagaaacaagcgcccacgaacaactacctctccaccaacaatggccttcaggtcctccagggtacgggccacggtgatgttggctgcgctgttcgcggttggtttctgcaccaccccgctcaccttccacgtcggcaagggatccaagcctggccacctgatcctcacccccaacgttgccaccatatccgatgtggagatcaaagagcacggtggtgatgacttctcctttacgctcaaggagggcccgactggcacgtggacgctcgacaccaaggccccactcaagtaccccctttgcatccgctttgctgtcaagtctggcggctaccgcatcgcctacgacgtcatccccgccgatttcaaggctggcaccacctataagaccacactcagccaattt

SEQ ID NO: 44082 - DNA, 437 bp, Zea mays
  unsure at all n locations
  Clone ID: LIB3066-054-Q1-K1-E8
gtaacacagttgagcacgacgatgggatccctcgctaataacatcatggtcgtgggcgcggtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccncatcttcaaggacggcaaagggctgtggctcatgctacgaggtgagatgcaaggaaaaacctgagtgctcgggcaatcctgtcacggtgttcatcacagacatgaactacgagcctatcgctccctaccacttcgacttgagcggcaaggccttcggtt

SEQ ID NO: 44083 - DNA, 397 bp, Zea mays
  Clone ID: LIB3066-054-Q1-K1-D12
cccacgcgtccgcccacgcgtccgcccacgcgtccgggaaacacacgcacgtccgtccctggctccgtgcgagcagacgaaacaagggttttctgctgctgctcttgacttgcaaacacactgcccgggtggctgcaccctgctggtctcgaccccgtggccgaaacctgctcgcgatccgtgatccgctgcgagggtttcagcgccgacggccccgtttctgggcatgtgagctcacatgggtggacaaacggagttcaagggagggagatttggtccagtccagaccagacacggccacgaccaaaccaattctccgtgggcgtccggacgtgcctgcacgggtcagtctgaagagaaatctgggactcggcactcccgagtgacgagcgtagcc

SEQ ID NO: 44084 - DNA, 354 bp, Zea mays
  Clone ID: LIB3066-054-Q1-K1-D2
ctcatgggcgagtaccaccgtccctaccggggcgacctccgctcgccgccgtcctccgtgcgggacccggccttcacgcacgccaacggctacttctcctcctccgcctccccgaactccaacaacggctacttctctcccgtcttcgcgaagaatgacgctttccctgggaccggcgctggcgcaggcggcgaccggcggatcgagatctacaccacggcgcctcctccgcacctcccgccgccacccggccacacgctggcgctgcccccgccgacggggtggaaggaggggcgactgggtggaggtggaggcggcggcggcggcggcaggaaagcgggaggtggtgggggc

SEQ ID NO: 44085 - DNA, 325 bp, Zea mays
  Clone ID: LIB3066-054-Q1-K1-D4
ctcacgcgtccgtccacgcgtacggtcaaattgtagttgtctggcacgtgtcgcactgagggaggagcagtctaccacgctaaacatgaagccggagaaagcgtgtacagtaccggaatccatcaccatggcgggatcagcgttgctcaacgctctcgtcctccgcgcgccatccgcgtcgatctcgtgctcgtctaaggtccgcaacgccggcgcctttgtgttctcgaacccaccgcgcttcccatccctgcgttctgagcgccgcgtcgcccttccgcgggcggaggcggtcggtgaccctgaggacgagtgggtgccggag

SEQ ID NO: 44086 - DNA, 446 bp, Zea mays
  Clone ID: LIB3066-054-Q1-K1-D5
cgcgggttttctgacgaggcgcccccgccatcgcctgttgccactgccggaaagggaaagaaggtggcagaagaggagtacgacgagaagaaggtggcagcgaccccgcagccggccgccaaagcacaggtggtgggatggccaccagtctgcaactaccgcaagaacacgatgactaccacccagctggagggcagcaaggaggatggtgatgccaagcagggtcaggggttcctgtacgtcaaggtcagcatggatggcgcgccgtacctcaggaagatcgaccttaagacttacaagaactacaaggacctgtcgaccgcgcttgagaagatgttcagtggcttcagtactggcaaggaccgctcatctgagtaccgcatggatggtgaatatgttctgacttacgatgaccaggatggaaattggatgcttgtcggcgacgt

SEQ ID NO: 44087 - DNA, 458 bp, Zea mays
  Clone ID: LIB3066-054-Q1-K1-D6
cggacgcgtggggtcggagcagagagagacttcctcgcctccatcccatcccgccgccggcgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttggttgtttttttttccttcctctttctacttgattttca

SEQ ID NO: 44088 - DNA, 450 bp, Zea mays
  unsure at all n locations
  Clone ID: LIB3066-054-Q1-K1-D7
cggacgcgtggggtcaactcgatcgatccatcgcatctctgccttgtattttggatgtcgatccgtgtggactgttacaaaatattacatatgtgaccaatccaaggggtgcgacagttttccccaagggacacaccccttgggatacaccccttcacttgtatataagtgtaatgatctatggaatacaatcactgttctctgcctctctctttgttaccactgagtaaacttgagtatacttcaacacgttatcagcactgcttgcgagatcagagaaaaagacttgtgctaagttccttgttcagatgaacgtggacttggatcgctacagcatgcaacaacggattttcttaaaacanatcgctcataagttggagaaaggtgatggtatggaaactactcttnctctccgcttttcgctgtctgctgtctgcgtgtaattttata

SEQ ID NO: 44089 - DNA, 441 bp, Zea mays
  Clone ID: LIB3066-054-Q1-K1-D8
cccacgcgtccgagaaggagaactgtaccaaaagtgcagaaggccattctggactctgcattgcccatggtggtggaaggcggtgccagtttccagactgcacaaagggtgctcagggaagcacaaagttctgcaaggcacatggtggaggaaagcgctgcacattcgtcggatgcaccagaggggctgaaggcagcacttcattttgtaagggccatggtggaggcaagcgctgtgcctttcagggcggtggcgtgtgcccaaagagcgtgcatggtggcactcagtattgtgttgcacatggtggtgggaaaaggtgtgctagctttggttgcactaagagtgctagagggcgcacagagtattgtgtgcgccatggaggtggcaagaggtgcaagttcgagagctgcaccaagagtgcgcaggggagcactgatttct

SEQ ID NO: 44090 - DNA, 305 bp, Zea mays
  Clone ID: LIB3066-054-Q1-K1-E1
cccacgcgtccgcccacgcgtccggaaggtcatcgccaaagacgtcatcccggcgaactggagacgcgatgccgtctacacttgcaacgtccaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatatacatgccattttt

SEQ ID NO: 44091 - DNA, 385 bp, Zea mays
  Clone ID: LIB3066-054-Q1-K1-E10
acgatccaggacacggacggcattcctccagaccagcatcgtctgatctttgctggcaagcagggggaggatggttgcaccctcgcggactacaacatccagaacgagagtacccttcacctagatctccgtctcaggggtagtatgcagatctttgcgaagaccctgactggaaaaaccatcaccctgcaggttgagagctcggacaccatcaacaatgttaaggctaatatccaggacaatgaggtcatccccccgaaccagcagcgtctgatcttcgacagcaaacagatggaggatggcaccaccttagcagactacaacatccacaaggagagcactctccaccttgcgctccagctccttggtgaccactaagtcatgg

SEQ ID NO: 44092 - DNA, 391 bp, Zea mays
  Clone ID: LIB3066-054-Q1-K1-E11
gaaacgtcagtcctgtcgatttgcctaaatactggtgctctgctctacatgataccattggggcttacttactccataagcacacgcgtttccaacgagcttggcgctgggcagcctcaggccgcgaagatggcagcaaaggtagtcatgtacatggctttgtctgaaggactcgttatatccttgacgatgaccctgctacgcaacatttgggggtacgtgtacagcgacgaggaggagatcgtgacgtacatctctaagatgttgccgatcctcgggatatctttcttcatagatgggctccatagctctctttcaggggtgctcacaggctgcggaaagcagaagatcggcgcggccgttaatctcggagcgttctacttgctaggca

SEQ ID NO: 44093 - DNA, 387 bp, Zea mays
  Clone ID: LIB3066-054-Q1-K1-E12
agaacgcctgccgtcgagctagcactctagcaattccacccaataactaataacatctccgcgaaggccaggttccttggaccactatatccaggagcgacgaagtgatccacccgccagccatggagatgaagaaggtcctctgcgccgccctcgtcgccgccgtctcggccaccgacgtgctggcctaggtcgcctccgaggcgcccttcgaggcgcccgccggcgcggccggtggtgcggctggccctagcgcaagcggcgccgacgacgtcgccgtgcccgacgccggggcgctcgtcgcctacttcctcgactactacctccactgagcgacgacgcgcggggcggcaacgatgggatgcatcgtgtttggatcatccgatt

SEQ ID NO: 44094 - DNA, 369 bp, Zea mays
  Clone ID: LIB3066-054-Q1-K1-E2
cccacgcgtccgcccacgcgtccgcccacgcgtccgcccacgcgtccgcggacgcgtggggaaaggtggggttttcctacatataactgggaggagatgtcaaaggataattatgggtggtggcgagctcgtctgacacagatggcaaagtacttcacagcatacaggatagaccacatcttgggtttctttaggatatgggagcttccagatcatgctgcaacaggtttagttgggaaatttagaccttccatccctcttagtcaggaggagcttctaagtgaaggtctatgggattttaatctgatgagccaaccatacattctgcaggaaatactggaagagaggttggatcctcttgacagtcat

SEQ ID NO: 44095 - DNA, 216 bp, Zea mays
  Clone ID: LIB3066-054-Q1-K1-E3
cggagaaaccttctgactaaggccgccgtcttgaggtagcgcccgtcgccgactttcttggggtcgaggttgatgatgatcatgccaggcctgaaatcgaagttctccttgacaatcttgaggatctccttgccggagatcgcgccagtgccgtacgtgtcgactaacactgacagaggctcgggcactccattggcttaagacacctggaccatg

SEQ ID NO: 44096 - DNA, 422 bp, Zea mays
  Clone ID: LIB3066-054-Q1-K1-E4
cggacgcgtgggttcgaataacacaggtgagcgcgacgatgggatccctcgctaataacagcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgcttcggcaatccaatcacggtgtacatcactgacatgaactacgagcctattgctccctac

SEQ ID NO: 44097 - DNA, 394 bp, Zea mays
  Clone ID: LIB3066-054-Q1-K1-E7
cccacgcgtccggacgacaccagcggcggcgggtgcgggtccatggagttctggccggaggtcctggcctccagcggcgggcgcgagttcgtggccggcggggtgggcggcatggcgggcgtgctggcgggccacccgctcgacacgctccgcatccgcctccagcagccgcccgccgcgggcgcaccacgccgccgcgacgcgcacccctcagccccgcgcctcctacgcggcatcctccgcgccgagggcccctgcgcgctctaccgcggcatggccgcgccgctcgcctccgtcgccttccagaacgcgatggtgttccaggtgtatgcggtcctgtcgcggtcgctgggccccgtcaccttcgagccgtcgttctacgcgagcgtggcgc

SEQ ID NO: 44098 - DNA, 387 bp, Zea mays
  Clone ID: LIB3066-054-Q1-K1-D11
cccacgcgtccgctcagcagcactgaacagtctcttcgccattgggtgtgccagcggagcatttattggcggggtgatagcagatcacctgtcaaagtacttcccagattcggcacgggtcatgtgtgcccagtttagtgccttcatgggcatcccgatttcttggatcctcctcacagtcatcccccagtcagttgactactggtatgccttcgccgtcacgcttttcttcatgggcatcacgataagctggtgcgccacctcgacaaacaaccccatgttcgctgaggtggtccctcccaagcaccggaccatgatctacgccttcgaccgtgcgttctacggctcattcgcctcgttggctggccctgcagtgcgcctaatcac

SEQ ID NO: 44099 - DNA, 391 bp, Zea mays
  Clone ID: LIB3066-043-Q1-K1-C9
cggacgcgtgggaaaaaaaaaaaaaaaaatttaaaataaaaaaaaaaaaaaaaaaaaataagagaaaaaaaaaaaaaaaaaaaaaaaaaaaaaaaaaaaaaaaaaaaaaaaaaatataaaattaaaaaaaaaaaaaaaaaaaaaaaaaataaagggtgaccttttaaatggtcaaaaatttctttacccttattttcaaaattatatttttttaatagtgacactaaatttaaattcttttcctactttttaaaaatttcttaattggaaaaactcttgcgttaataatttttatccattggacccaaaacctcttttgtcaagatgacataatagaaataaggccctatccattggattttcctaagattcctacacctttattgggaaa

SEQ ID NO: 44100 - DNA, 448 bp, Zea mays
  unsure at all n locations
  Clone ID: LIB3066-043-Q1-K1-D1
cccgtccgatggcnctnntctaccagannnagctatggggaggggcntaccagacatngggtcggttgggacagccnnntcaacagcagtggtcagagctcatgcatggccattggcngnngatccantcnnaccatgtnnctgtggacccaacaacangnctagtgtttgggcttctaaacaaagtgannctcccgcnnacttggcatgctnnttggacatccnnntggtctcaaaagggcncnntgtcattggtgggcanngctacnntcggtnntgggcaccagcantnncttccgnngcccgggcccgggtgtccccaatgctnnnttgagtgagggggatgcactnnggcacattngctctgatgggaccaataaagtttcccaacttggagacacttcaagggatttatgagnggagtggacctattgatcttggggaaagc

SEQ ID NO: 44101 - DNA, 447 bp, Zea mays
  Clone ID: LIB3066-043-Q1-K1-D10
cccacgcgtccgcaccttccatcgacaaaatggaggtaccgcgcctcccccagggtgcccttccatgcatggcgttgccgcggccgtccccgcaatcaactcccagatctcgtgctcacctccccgcaatcaaggtcgtcacgcccgatgaggatggccgcgagtcgccgcacggcggtccgggccccagcgatagctccggcgcaggcgcgaggaagaagctccggctcaccaatgagcagtcgacgctgctcgaggacaccttccgcgcccacaacatactctccaacgcgcagaagcaggagctcggacggcaggtggatctcagcgccaggcaggttcatatcgtcttctgcgtgtatgtagttggttcttcttcaattctctatgtggggaaaacattaattgggattttcccagcaatcagcttgataggcgacatcatca

SEQ ID NO: 44102 - DNA, 463 bp, Zea mays
  Clone ID: LIB3066-043-Q1-K1-D11
gaaagatgcattcctggaaacaccatcgccgtccaagctgacatgccatacagtggcctgggatcggtcggaacagcatttttgtccaagttcgaatgttctcagatgccacatccactgttagagcacgtgaccttcgtggacactccaggagttttatcaggggagaagcagcggacgcagcgcagctacgatttcaccggagtcacgtcgtggtttgcggccaagtgcgacctcatccttctcctgtttgatccgcataagctggacatcaacgatgagttcaagcgtgtgatcgggtctctccgcgggcatgatgacaagatacgcatagttctcaacaaggccgaccaagttgatgcacagcagctgatgagagtgtaccgagcactgctgtggtcgctcgggaaagtcctgaacacacccataagtcatgcgtgtctacataggttcattcaacgac

SEQ ID NO: 44103 - DNA, 326 bp, Zea mays
  unsure at all n locations
  Clone ID: LIB3066-043-Q1-K1-D2
cccacgcgtccgcccacgcgtccgcggacgcgtgggcaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgnctctacacccccttcttccacggacgaggagttgagcccttccccgccagca

SEQ ID NO: 44104 - DNA, 305 bp, Zea mays
  unsure at all n locations
  Clone ID: LIB3066-043-Q1-K1-D3
cccacgcgtccgcccacgcgtccgcccacgcgtccgcccacgcgtccgggggctctcccaggaggacctcgtcctgctctccggcgcgcactccatcggcggcgcgcactgcttcatgttctccaaccgcatctacaacttctcccaggacgccgacgtcgaccccacgctggacccggagtacgccaagtggctgcgccagatgtgcccgccgcggcagcccggcgacgaccccgagcaagcgcccaaggtgaagttcgacgcgcagacggnggagcggctcgacgtcgcgtactactccgagc

SEQ ID NO: 44105 - DNA, 433 bp, Zea mays
  Clone ID: LIB3066-043-Q1-K1-D4
cccacgcgtccggcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcaggcggacagggaccgcgccggcgtactgctcaccaggaacgtcggcatcagcgacaacctgcgccccgacaacccgctcggctacttcaaggacgtgccgctgcccatctgcgcctcgctgctcaagcagttggactcggacgacgacgacgatcagtaatagcacatcgtcgacgaccgcagactggctggcac

SEQ ID NO: 44106 - DNA, 386 bp, Zea mays
  Clone ID: LIB3066-043-Q1-K1-D5
cacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggctcgcctcaacgagcagatcaacgtggagtacaacgcctcgtatgcataccactccctcttcgcctatttcgaccgcgacaacgtg

SEQ ID NO: 44107 - DNA, 381 bp, Zea mays
  Clone ID: LIB3066-043-Q1-K1-D7
actgtggccagtgccaaacagtgttgatgtatccatacggagcaccgtctgtcaaatgtgctgtttgcaacttcattacaaatgttggcggggtgactcccatgatacctttgccaccaccagcactacctgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaaccgtgtgtagctttgtccaaactatctaaaaagggtttaagaatacataccttgtatcatactgctgtttggcgatcg

SEQ ID NO: 44108 - DNA, 219 bp, Zea mays
  Clone ID: LIB3066-043-Q1-K1-D8
cccggtcgacccacctccgccaccgtaccaacgctggctgatcttgttccatcatcaaataatggatgagtgctattacatatgtggcatcactcaaagcatgacttccatgttgaactatctttcaccttagcaaacctaatatactaatcgacattagaatcctctaaatacttataactatagcctcatttacttattccactgaaacacaacata

SEQ ID NO: 44109 - DNA, 444 bp, Zea mays
  Clone ID: LIB3066-043-Q1-K1-D9
gggatggggttcaaaaatgaagtttcaaataaatctattgttgagcccactcttgaatttgcaattgtacaagatgcagatcgcttggatgcaattggggcaattggtattgcaagatgttttacatatggtggtagcaagaacagcgcattacatgatcctagaattctgccacgtgatagcttgtcgaaggaaaagtacatgtccaaggaagagaagcagacatcaatcaatcattttcatgagaagctctttaaactgaaggacatgatgaagacagaggccgggaaaaagagagctgagaaaaggcataggttcatggaggaatttgggggctgaattctacgaagagtggagtggcagagcttgaggttgaacaaccaggttttgagcctatgtcaaagtgtgcagttggcgaaccatttctcaacaacccatgatgat

SEQ ID NO: 44110 - DNA, 305 bp, Zea mays
  Clone ID: LIB3066-043-Q1-K1-E1
cccacgcgtccgggaaacccatctgtcatagactgcacttgtgagcttccaagaagttccttcgttccagcagacgagtatctttgtcttgcaacttgggataccagagctccaacaccataccaaattgaaaaagctgcacgttgggcttgtggaaagagatctgaggggaagccggtttatgtccattgcgcatttggttagaaatccaccttttgttataattaattacaggattggatcttgatgttcagattatgcacaaaattatattttctgctatttatgcaatatattaactgtca

SEQ ID NO: 44111 - DNA, 389 bp, Zea mays
  Clone ID: LIB3066-043-Q1-K1-E10
atcgcggcggtgtcggtgaaggggagcaagcgtgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctcatgcattccgatatggtgccggagttaaaaaaatgtaaatcaatgtgcaaactcaaatgacatcttaaccagttgtgat

SEQ ID NO: 44112 - DNA, 448 bp, Zea mays
  Clone ID: LIB3066-043-Q1-K1-E11
ctccttctgctcggaacgcacacaccgaccggtacccgatctccgatccgctcgtcgatccgaagatgcagatcttcatcaagaccctcactggaaagactattaccctcgaggtggagtcttatgacaccattgacaacgtcaaggccaagatccaggacaaggagggcatccccgcggaccagcagcggctcatctttgctggcaagcatcttgaggacgggcgcacacttgccgactacaacatccagaacgagagcaccctcgaccttgttctccgcctcaggggaggcatgcagatcttcgtcaagaccctcactggaaagactatcaccctcgatgtggagtcttctgacaccatcgacaacgtcaaggccaagatccaggacaaggagggcatccctgcagaccagcagcggctcatttttggcggcatgcagctcgagga

SEQ ID NO: 44113 - DNA, 434 bp, Zea mays
  unsure at all n locations
  Clone ID: LIB3066-043-Q1-K1-E12
ctcctccatcgagcagaaggaggagggccgcgggaacgaggcgcacgccgcctccatccgcgcctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactccnctgatcgcgcctgcaaccttgcaaaacaggccttcgatgaggcgatctctgagctagaca

SEQ ID NO: 44114 - DNA, 452 bp, Zea mays
  Clone ID: LIB3066-043-Q1-K1-C8
cgccccttatcgccctcgttatttacatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccagtgtcacaagtgtgcataagctgtggagtcaatatgggagagtacttttggatatatgcaaatttatgatgatgatacagaaaagggcagtaccattgcatcgattggtgcatatg

SEQ ID NO: 44115 - DNA, 415 bp, Zea mays
  Clone ID: LIB3066-043-Q1-K1-B10
cgcatacagcgagaagaagcccagcagcaagggcgcaagcgcaactgatcccgcacacgggtgatgttccacatccatgcctataggccactcacctcaccacgcagcgttaccggccgtactactatatctacatacgaccgtgggacaacgtcgaccggagctcgatcggcgcagttgccgcatgggcgtggctgtcaaagttcctttgtttctttcttgatttgtgcttgcgttgggttcggtgttccactttctttttatgtgattattaatcttgttttcaaaaaaaaaaaaaatgcaaaaagctgaccgcgctaaacaacaaaacaagtcacacgcccgaatcaggacggtcaatggacctagaccaagaactggccccaaaaaaaaaaaaagggcggccctttttaag

SEQ ID NO: 44116 - DNA, 455 bp, Zea mays
  Clone ID: LIB3066-043-Q1-K1-B11
ggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctaccgcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcg

SEQ ID NO: 44117 - DNA, 366 bp, Zea mays
  Clone ID: LIB3066-043-Q1-K1-B12
gaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccacggtcgtcgacagggccgtcgaggaccgcatggtggccttcacgtacctgcgcatggg

SEQ ID NO: 44118 - DNA, 417 bp, Zea mays
  unsure at all n locations
  Clone ID: LIB3066-043-Q1-K1-B2
gtgaacatcaccgcgcccgcggacgtcgagaacacggacggcgtccatgtcggcgggtcctgcaatgtacgcatcaccaactcaaccattggcaccggcgacgactgcgtctccatcggccctgggagcgacggtgtcatggtgaacaacatcacctgtggccccgggcagggcatcagtgtgggctgcctaggccgctacaaggatgagaaggacgtgagcgacgtgacggtgcgggattgcgtgcttaggaacaccaccaacggcgtgcgcatcaagtcgtacgaggatgccgagtctgtgctcacggcgtcccatctcaccttcgagaacatcaggatggangaggtggccaaccccatcatcatcgaccagtactctttgccccaagaggtcctgccccgcaagcgaagcaac

SEQ ID NO: 44119 - DNA, 354 bp, Zea mays
  Clone ID: LIB3066-043-Q1-K1-B3
gcgtccgcccacgcgtccgcccacgcgttcgcggacgcttgggcggacgcgtgagtgccaacttcacgagcttgtgtgaatagtctggggtaccgactgcataaattactgcagattgcgacacctgtaaaagttacacaagaacatcttgatcgagcttaccaggcaaccaaatctgcagatctgatgaacttggaatcaaggtctatagcatctgaagatattggaagacaggttcttacttatgtggaaaggaagcccatctagtatttcctgaaaacagatgacgagatcactttgaatgacattgtcgtaaccgcaaaggagatgatgtgtacaccactcactatggca

SEQ ID NO: 44120 - DNA, 473 bp, Zea mays
  Clone ID: LIB3066-043-Q1-K1-B5
cccacgcgtccgcccacgcgtccgcccacgcgtccgcccacgcgtccgcccacgcgtgcgcccacgcgtccgcccacgcgtccggttgagtggcaacccggtagcacaataggagttgtgattgttgattcaagttactacgtaagtacgtatattagagcatgactaataatgcgaatattgttaaaatggatacgcaggagggcaggaggtgagcttttgcatgtctagatattagcagagtaacgagggatcgattgctatttgtgattgtccccggcccgtgtttggctactcaccgttcaatttcggtttctatcccaatgatagaggcgaaggtaaaggcatagagaccccaaacttaaatccaaaataaactacaggaagagagagggaagggaccacaggagagtcattaagtaaatccacttgttgtctgattagggtaggaaatgatgtctgaaagtgacgag

SEQ ID NO: 44121 - DNA, 475 bp, Zea mays
  unsure at all n locations
  Clone ID: LIB3066-043-Q1-K1-B7
cggacgcgtgggcggacgcgtgggcggacgcgtgggcgacaaaatatctcgccgttcccatggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcangagggggaggcggaactgggcggngaggtcgatgggatcagcgtggaccagttcttcgacgcgctgtacgacggcgaggaggcgaaaggtgagcgggaggcggnggcaagcgcggatgtggactccggcagggacgatgtgctggaagtcgtgacgccagaggcggggacggtggangtggatggcgatgatcccat

SEQ ID NO: 44122 - DNA, 425 bp, Zea mays
  unsure at all n locations
  Clone ID: LIB3066-043-Q1-K1-B8
cccacgcgtccgaccgagacccccctcaagctcgccgagtacttcaacgtcaccgacggggtgttcagctacaaccagatgggcgacgtgccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtncggtccaacgtctgggaacggtactatcctcgggagcagttctacatcag

SEQ ID NO: 44123 - DNA, 436 bp, Zea mays
  unsure at all n locations
  Clone ID: LIB3066-043-Q1-K1-C1
cccacgcgtccgaacgacctggccaagtacacggcgagttggatccaggtgtcgcacgttgacaacatcgtcatcaacggctccggcacgctcgatggtcagggcaccgcagtatataccaagagcaagactgacgtcgtcaaggcgatgcccaacacactagtgttgttctacgtgaccaacggcactatttccggaattaaactactcaactccaaattcttccacatcaacatcgacacttctaaggacatcaccgtgaaggacgtgaacatcaccgcgcccgcggacgtcgagaacacggacggcgtccatgtcggcgggtcctccaatgtacgcatcaccaactcaaccattggcaccggcgacgactgcgtctncatcggccctgggagcgacngtgtcatggtgaacaacatcacctgtggccccgggc

SEQ ID NO: 44124 - DNA, 458 bp, Zea mays
  Clone ID: LIB3066-043-Q1-K1-C11
gtgcccagaatgttgcaggtctatcaccgccaagctattcagctggagtgcagtctgagggactggatgacctttcacattcccataagtttgccgttggtactagagttcaagctgtgtggagtgaagatggagaatggtataatgcaaccgttgaagctttgacaccaaatggatactatgtagcctacgatggctggggaaacagtgaagaggtggacccagataatgtgaggctgcttgaggaagaagcagctgatgccttgggacaagctgaaaaggaagctgaagctacaaaaatggcaataaagaggaaaattgaacaagcagcaacatctgattttcaggcgcgtagcttgccggccaaacttcgtatcgaaccaagtgaccctgaggatgtaaaagctgcaaagcgtaagaaaatacatgctttcaaatcaaaatcccgctttgagcag

SEQ ID NO: 44125 - DNA, 339 bp, Zea mays
  Clone ID: LIB3066-043-Q1-K1-C12
gaccgacgcgtccggtgggcagaatgttgcaggtctatcaccgtctagctattcagctggagtgcagtctgaagggctgggggacctttcacattggcataggtttgccgttggtactagagttcaagctgagtgcagtgaacatggataatggtataatgcaaccgttgaagctttaacaccaaatggatactatgtaccctactatggctggagaaacagtgaataggtggacccagataatgtcacgctgcttcaggaacaagcaactgatgccttactacaaactgaaaatgaagcttaagctacaaaaatggtacttcacaggtgtattcaaca

SEQ ID NO: 44126 - DNA, 171 bp, Zea mays
  unsure at all n locations
  Clone ID: LIB3066-043-Q1-K1-C3
cggaattctccgggntcggacccacgccgtctcgcgccgcgactnggcgtcgaccaggccgccgccgctgtggagccgcnnctcgcgggcatanncgcggcgtcccgcgctttngctggcgcccntgtccgacgggcgcagatctcaacgagggggccagctttctcgtcg

SEQ ID NO: 44127 - DNA, 429 bp, Zea mays
  Clone ID: LIB3066-043-Q1-K1-C4
accgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgaaggggtggcggcgatctccaaagggggga

SEQ ID NO: 44128 - DNA, 472 bp, Zea mays
  Clone ID: LIB3066-043-Q1-K1-C5
gcaaggaacgcaccccgaatcccaactcctgtgtccgccatcgcctcgtggcggtcgctcctgctcctgctgctgctgctgctcccccagccgctcccgcccggagcacgccgccggcgccgacgccggcgcgtcgcatggatatggcccccgcgtctgtctacttcaatccgcgctcggtcgaggaaatcttcaaggacttctccggccgccgcgcggggctcgtccgcgccctcacctccgatgtggacgatttctgcagcttgtgcgacccagataaggagaatttgtgtctctacggccttcccaacgggagctgggaggtgtcgccgccggcggaagaggttcctccggagttgcccgagccggcgctcggcatcaactttgcgcgcgacggcatgcagcgccgcgactggctcacactcgtcgccgtgcactctgactcgtggctcatctccgtcgcattcttcta

SEQ ID NO: 44129 - DNA, 73 bp, Zea mays
  Clone ID: LIB3066-043-Q1-K1-C6
cccacgcgtccgaaaaaaaaaaaaaaaaaataaaaaaaaaaaaaaaaaaaaaaaaaagaaagggaaaccaatt

SEQ ID NO: 44130 - DNA, 378 bp, Zea mays
  Clone ID: LIB3066-043-Q1-K1-B1
cccacactctgcctgacacgtgggttatgcccctgtttactcctaccgaacttaccaccagggaagatcttatgcagattccgtcagcacccctgttgaaggcctaccacactgtgtacgaggactacctgtcggagcttgacaaggtcatcaaggttctccatgaccttgtcgacgagcagaattacgcctcgctcatgctcctgcatccatggtacttcatacacacactcgatgtgcgcaccaaaaccggacgccccttctgcgcctttattaacccagtctaactggcgcccggagactacggcggactggcaagtgccattaggctgctatgacacatcaacgacgagtttctcatcctatcatactctgact

SEQ ID NO: 44131 - DNA, 390 bp, Zea mays
  Clone ID: LIB3066-042-Q1-K1-H2
gtccggtggcaatgcttatgtgattggtgactctgcgaagcccgggcagaagtggcacgggtactacgccgctgagcaccctgaggagcctgtcgttactctggagatgtgcatgactgggctggacaagaagaaagcttctgtcttcttcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggcttcaacccgggctctttctcttatggtgacct

SEQ ID NO: 44132 - DNA, 319 bp, Zea mays
  Clone ID: LIB3066-042-Q1-K1-H3
aatgtttcagcggcgccggcgcatggggcggagggtctgtctgaacggcgaccggtgtccgccttgctgtccagacgcgaatcggatcatggcgcccccctgccagtctgccacctcaggcacactcagctgtcggtgtggtggcatgcctcggtatgctgacttcggctcttctcaacccttctgcctcgaggcctgcatctcctcgactcgtcgccgatctcttgtgatcctgtctcgacctcggccctcaactgaatattcaagacatggaggattacccagccataggtttcacttatctgggggagtttgatga

SEQ ID NO: 44133 - DNA, 405 bp, Zea mays
  Clone ID: LIB3066-042-Q1-K1-H4
atcgacctgacggggcagggccacgaaaagctcctctccccagttaccgacgttaagtacgtcccgaaccagtggtgcgtgttcgacgacggggccgaggacaagtccaagctgcctagcaacgtccagtatgcatgtgcgagcggcgactgcacggcactcggctatggctgctcctgcaatgggctggacgagaagagcaacatctactacgcgttcaacatgtactttcagatgcaggaccaggatgtgcgcgcctgcgacttcgaagggcttgccaagatcacagacaagaacgccttcacgcgcggctgcctgttcccggtccagataatcagtgccagtgctcgggtggcgccagctctattgatggcggggctattggcattgcttgtgaatgtgaat

SEQ ID NO: 44134 - DNA, 325 bp, Zea mays
  Clone ID: LIB3066-042-Q1-K1-H5
gactcatcgagtgcaaagcagttgttatcctaagaaccatgcatatgctaccagaataagagagatgagagcggttggtggccaaggctcctgaaaaaggacatgtgttcttgaaggttgactggacaaatggtaggatgaggatggcgaagatgttgaatgttagtatttcacttctggttgattatgttttttcttatgcgcttgacaaatctagatatgcaaccagacatgctttattcttgttcctattttgttttccttatgtattaattccttaacttgtaatgcacatgatattttccttatgtattaatttcttaac

SEQ ID NO: 44135 - DNA, 433 bp, Zea mays
  Clone ID: LIB3066-042-Q1-K1-H6
cccacgcgtccgcagcaacctcaggttatgtggggggtcgtcggcaaaacgacgctcgtggggcattggctacggcagaaactagtgtctggctgccattggttgtgggaggagcagaggaaaacaaattgttggttacactctgtactactgcgtcatgatattgtcggctttcgctttgtggcttttggaggaaaactggagatgtggcagctttggctttatggttcttggaggaacagccagagtgcatgagtcaaagcgctatattctctgtagtgaagtgaagcacgcacgcacgttgcttttccttcactccatcggccaccaagttattaatgcattgcatgccagctggcccatctgattcctagcgacaggaacatcattaagcaactagtactagaagtatgtaggttgatgtcgatgatgt

SEQ ID NO: 44136 - DNA, 413 bp, Zea mays
  Clone ID: LIB3066-042-Q1-K1-H7
agcagatgaaaggacgtgttgttgattgggatgtacctgaacaagcatctgggcaacatgtaatgaaggatgaaccacaggttggtggaatttatgttagactttttcttaaggaccccaaatttccactgagaaaccctaaaagattccttgaagggctcctagatcaatatgtctcctctgttgctgctacgcattatgaagcaattgctacagacccagagcttcctttactactgtctgcggcattggtttccttactacgagttcatccagcacttgctgaccatgttggctacctcggttatgttccaaagcttgttgcggctatggcttatgagggaagaagggagactatggcatcctggcaggctaccagtgcatcgaatgcagaacctagcgaacattgacac

SEQ ID NO: 44137 - DNA, 447 bp, Zea mays
  unsure at all n locations
  Clone ID: LIB3066-042-Q1-K1-H8
cccacgcgtccgcccacgcgtccgcccacgcgtccgaggggggtcaaggacggcgccatggacctcatcaacaaatggcagcaggtggcgccgtccctccccgatgacctcatgatccggatcatggccatggagcaggatgccatgttcgaggccctgtacctgggcacgtgcaaggacctcctcccgctgatggccagccgcttcccggagctgggcgtcaaacaggaggactgcaacgagatgccgtggatccagtccgtggccttcatccccatgggcaagtcggacaccgtgatggacctcctcaaccggacgttcaacatcaaggccttcggcaagtacaagtctgactacgtgaaggaccccatcccgagggacgtgtgggagaagatctacacctggctcgccaagcccggtgccggngtcatgatcatggacccctac

SEQ ID NO: 44138 - DNA, 458 bp, Zea mays
  Clone ID: LIB3066-043-Q1-K1-A1
cccacgcgtccgcccacgcgtccgcccacgcgtccgcccacgcgtccggtggatgcatacactcgttaaatctcctcacttcttctccggatggtttcagttctgcttttccctctcgcccgccctagatccgctgggatctgagtctctgtttgatgctgctttccaagccccgccatagatccgctgggatatgagtctctgtttgatgctgttttccaagcctgaggagttccggccggagtggttcataggcgaggagaagagcgtggacgcaaccgtcggcgggaaggcgaggagaagagcatggacgccacgcgacgtcatacaatcgcattattgtttggttggtactctaaagacgcctcttgttctaatttattgcctgcagaatcatatgctaaattagaaacagacgcttcgtttcttcctaaatagaaatactaatttactgggtt

SEQ ID NO: 44139 - DNA, 127 bp, Zea mays
  Clone ID: LIB3066-043-Q1-K1-A11
aaacacactgaacccaataatccgatcccacataaacttttctctttgtccgttcgatcgatcgctgccgagtcgtatgtcatacaccatcatcacccataaccattgtctgcaacctgtcttattt

SEQ ID NO: 44140 - DNA, 309 bp, Zea mays
  Clone ID: LIB3066-043-Q1-K1-A12
cggacgcgtgggcgacggcgtcatgcatgcatggatatatacaccgtacctagtggtagactgatatataggtgatttctttttttctttttttgtgtgtgtggtttgatatcaacatccagtagctagctagcaaaccaagcactccgacccatttgcatgcctgcatgtattgacctgagcacctggtactgctgtgtgatgccattagaaaagcaagcaagagagcttgctagctagctacagctcaagtgatcaggggccaagagcacaaggcgtgcagctgattaattaagcaagtttcatccc

SEQ ID NO: 44141 - DNA, 440 bp, Zea mays
  Clone ID: LIB3066-043-Q1-K1-A3
acgatcgctcgaatgactggcttgtcgatataattaattgcaacattggtcatgatgctagctcggcatgtcttatcggtgtgctgcacatctatggcttcgagagcttcacggtgaacagattcgtacaattctgcattaactatactattgagacactgcatcgacagttgactcatcacgtgttcaacacggtacacgacgagtaccctggacagcaaactgattgaaggcatattcagcgtggtgacaatcgagatgctcttgaccttatggagtggtaacctcgtggtggtatcgtacttcttgatgaagcatgtatgctgcacactgccactgacgagacatgcgtgctgaaagtctaccatagttttgaaaagcacaagctgcttgtgaagccccagctatctcgtgacgactgtacaatctgtcactacgcc

SEQ ID NO: 44142 - DNA, 436 bp, Zea mays
  Clone ID: LIB3066-043-Q1-K1-A4
cgaccaaaccctaggcgttcggcgggcgtcaccacggcggcgaagaaagggtgcctcgcgtggccttggtgtccccgaagtcgtcgacggtgcagctcgatccgcctcgtcgagcatgtcgaggagggtcccttgcaaattcttcttgcatggagcttgcttcaaaggagattactgtgaattctcccatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcatcctccaattcttctcagctagttgcttcttccagagatccccattgcagcgaatgccaaacgggattatgtgaccaaacacagcagatttgcaagtcaacagcagcactt

SEQ ID NO: 44143 - DNA, 436 bp, Zea mays
  Clone ID: LIB3066-043-Q1-K1-A5
cggactacttcacggcgtacggcgtcgtattccggaacgacgcgccgctggccaagcccggcgccaagggcggccaggcggtggcggtgcggctgttcgggaccaagacgcagatctacaactgcaccatcgacggcggacaggacacgctgtacgaccacaagggcctgcactacttcaagggctgcctcatccggggcagcgtcgacttcatcttcggcttcggccgcagcttctacgaggactgccgcatcgagtcggtggtcaaggaggtggcggtgctgacggcgcagcagcgttccaagtccatcgagggcgccatcgacaccggcttctcgttcaagaactgcagcatcggcggcgtcaagggcggacagatctacctgggccgcgcctggggggactcctcccgggtggtctactcgtacacgaagat

SEQ ID NO: 44144 - DNA, 419 bp, Zea mays
  unsure at all n locations
  Clone ID: LIB3066-043-Q1-K1-A6
cggacgcgtgggcggacgcgtgggtgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggngaggtgtccggggtcacgctgctcaactncaagttcttncacatgaacatgtaccggttgcaggacatgctaatcaaggacgtgaccgtga

SEQ ID NO: 44145 - DNA, 364 bp, Zea mays
  Clone ID: LIB3066-043-Q1-K1-A7
cggacgcgtgggtagttctagatcgcgagcttccgccctttttttttttttttttggttttgttttattttttttttttttttttttttttttttttttttttttttttttttttttttattattttttttttttatttctttttttatttttttttataattttattttttttttaaaaaaacataattatataattttattattataaaaattattactttaaaatttatttacaaaaaattattattttttttatcttttttaataaaaatcttttattaatattttattttttattaaattaaattattattataattcatttaattttaaatgtatcctttaacatatttattattttt

SEQ ID NO: 44146 - DNA, 453 bp, Zea mays
  unsure at all n locations
  Clone ID: LIB3066-043-Q1-K1-A9
cccacgcgtccgagctcctcgggaatccggtgccaggcctcgccttctcgcggcggtgctccctccctcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcaccaccaccagcagcagcaaccgcagccgcggaatgccggcatggacacccgncacccgtgggtcg

SEQ ID NO: 44147 - DNA, 359 bp, Zea mays
  unsure at all n locations
  Clone ID: LIB3066-042-Q1-K1-H12
cccacgcgtccgcccacgcgtccgagaagctccagttgggtgccccaagtgcctgaaaccgagcgtgtcttcccttgaaaacggtcgtggaacagacctgtggaaaaaattgggatgaacttgccacttatttcgttgttgttgttcttctttggtcttcgcgcggtggtttctacctgccaaagacgaataattcccggctggggcccctccagtccactccacccatgcttttgtgtcangcggagcggaggtagagcatagggagtgaataaccgctaccttatttcatttctatgatgtatctatctaatntggtccttccctgataatgcacgacccgtagtgttaacaagcgt

SEQ ID NO: 44148 - DNA, 400 bp, Zea mays
  Clone ID: LIB3066-055-Q1-K1-D12
aaggatcctgtcgtcaaggtgatgtccaagggaacgcctagacggaaggcggagctagaagatctggtgctcatgttgtccacaattaatgccatgcacatcgagacgaggtcgctcgacgtcatgacatccagggtgcgcatggctgatcaagttatgcatcttaatgagaagaagatgttccctactgatcacgacaaaggcaacaatgtatgggtccttgacacacgggctagcaatcacatgaaagggagtctcgaggcgctcgcgccactcaacatatctgtgcgcgacacaatgcgtattggcgatggatcactcgttgagattgacggtattggctatatgatgctctagaccaagacatagagctataaagagctcgttgaagtctacttta

SEQ ID NO: 44149 - DNA, 459 bp, Zea mays
  unsure at all n locations
  Clone ID: LIB3066-055-Q1-K1-D3
ccgtccgcgtgacgcatggggcaccangggcggctctagttaatgttggacctgggtacaatgggcgaagtcgtttcgatggtgctaggcgtgtctctttgcgcattttggggataaactcttgaagcagtatgttgacgctgaccctgcaatcaaggacgaggtggtcgacagctcccttgaattcctcatccttgctagtgatggactctgcgatgttgtcactaatgaggaagctgttgccatggtcaagcctattcaggacccccaggaagcagcaaacaagcttgtcgaagaagcgtcccgaaggggaagctctgataacatcaccgttgtcatcgtacgcttgctatatggaactaccggtgataaatcacgcgcagacaaagagaccaccaatgaccaaaactcctaattacctactgtatggatccctcatgcgtgtgaagtcttctggct

SEQ ID NO: 44150 - DNA, 418 bp, Zea mays
  Clone ID: LIB3066-055-Q1-K1-D4
gtcatgcgtacgcacctacatacgcatacgcatgcagtatacgctgcactatgcgctgcaggacaggccgcacatgctcaccgctgtcatgacctcgtccacctcgacttgcacctcgactcggcccttgacgtcgcccttcacgcccacggggaggctcacagctgctgcgccagctggtgcagcggcgagcgcactggtcaggtgtctgcttctctgcctgcacatcctcctgcgcatccttctcctcatctttcactccttcttctagactctctccatgatcccggacatcctcctggactacttcctatccgacttggtctacgctggagcgctcttctgtgcgctcctcctattcctgtggctgtttctgtttcggcttgcctttgcgctgccgctgccgctcgcgctccga

SEQ ID NO: 44151 - DNA, 428 bp, Zea mays
  unsure at all n locations
  Clone ID: LIB3066-055-Q1-K1-D5
ctcactcgtgcgtattgacacagactcacggaacccggacacgagcacatacttgctgcagtgttgacgcttacgtctgcttcggcgtcatgattggtgctgctaagtgctccccgtacgatatgcagacgtacaacctgatagacacgcagagctggcacacgatccacgtgtacccggccgacatggacgtggagtcatactgacatcacgacatacgctggcatgtgataggcagacagttccaacatcctgggagcggcactaccatgcgtgagcgacctctacatgagcctttctgctagcctgcaccgattactactactaggagttcctgatggctcgactactgattacaggtgcctcanagacggctggcttctgctgcacgagtcactacggaggcacacgctaaaacgacgaacgac

SEQ ID NO: 44152 - DNA, 454 bp, Zea mays
  Clone ID: LIB3066-055-Q1-K1-D6
tttttctccagtcttgcggtcgccgggtccttgtgctaggatggccgagtgcagggcgtggtggggaaatcatgggagaaggagaaagtcgctggggtcgtgcaagcgctgatggtggcgtggtgttcctggagagtgaccatgatgcctcatcagattgcgtcgcatgtcttctgcgtctagtcgagcaaaaagggaatggctggtgagcatgcagttcttcgccaaagcagacgcatcaacactgaaccgctgctcgtcgcgagcagcgctgttggcgcccatgcttttggtcaagaacatgtaccacaggatgaggcgcttggaggatgctgcgatgtgttcgtgagaggtctaggtcgtcgtctcccagtcaactttgggttgctggaccgttgtctctttataatgtaattatttatttattttggatagaactcctgttatgtagtaa

SEQ ID NO: 44153 - DNA, 440 bp, Zea mays
  Clone ID: LIB3066-055-Q1-K1-D7
cccacgcgtccgcatctgatcactcatatgtatcacggaagcatgaggaggataaggtgatgatctttgagagaggagatttggtcttcgtgttcaacttccactggagcaatagctattttgactatcgcgttggttgtttcaagcctgggaagtacaagattgttttagattctgacgatggccttttcggtggatttagtcggcttgatcatgacgctgagtacttcactgctgactggccgcatgacaacaggccgtgttctttctcggtctatgcacccagcagaacagccgtcgtatatgcacctgcaggtgcagaggacgaatagggcacagcagcggttgttggggaagaacttcagagggatgtactgctggtggactgacaccactgccacgcgcgatgctgccagatgttgccctcgagaccacgtggc

SEQ ID NO: 44154 - DNA, 454 bp, Zea mays
  Clone ID: LIB3066-055-Q1-K1-D8
gttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctga

SEQ ID NO: 44155 - DNA, 426 bp, Zea mays
  Clone ID: LIB3066-055-Q1-K1-D9
cggacgcgtgggcggacgcgtgggttcttgcttctgcttactcgcatgagttgccacgagggggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtggccttcaagggagctctggatggtggcctggatattcctcacagcgagaagaggtttgctggtttcaagaaggatgacaagcagctggatgctgatatccatcgcaagtacatctatggtggccatgttgctgactacatg

SEQ ID NO: 44156 - DNA, 370 bp, Zea mays
  unsure at all n locations
  Clone ID: LIB3066-055-Q1-K1-E1
nccacgcgtncgcccacgcgtccgcccacccgtccgcccacgcgtccgcaaaagaagtcgggtaatgctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgac

SEQ ID NO: 44157 - DNA, 420 bp, Zea mays
  Clone ID: LIB3066-055-Q1-K1-E10
cggacgcgtgggcggactcgtgggcgagtctgcggaattatgaaccttcggatgtaccttgtgatatgtcatctgtttcgaaggaaacaaaatcccaaccccttgcggagaaaaagtctacaggcaagaaatcagcaggtccagcatctgctgtcagtggctctgtttctacagttgatgctttcgtatgagaagcttctttcgtctattccggaattcgctgattttggaaagctttttaagtcatctgtacctgtagaattgactgaagctgagaccgaatactcagtgaatgttgtgaagcatatttttgatcgacatgttgtgctccaatacaactgtaccaatacaattcctgaacaattgcttgaacaggttattgttttggttgatgcttctgaggctgacgaatttttagaa

SEQ ID NO: 44158 - DNA, 405 bp, Zea mays
  Clone ID: LIB3066-055-Q1-K1-E11
cccactcgtccgttctatctttcaaactgtacaagaaggctcccaatttgaactcatgcctgagggatctatatgtggagcggatgcgcttcgaagctatgaaatgcatgtctaggtcatatcgcccaactgtacctgtgggatatgttgcacagattttggggttcatgagaactgatacaggctgtgcaaccaatggggatgatggattagaagaatgcgaaaaatggttgaaagcgcatgggatagttctttcagaaggtaacagtggggaatcacaaatagacatgaatgcttcgtcttctacactttacatgccatatccagataatgcggttgcacatggtgatgcatcacttgctgttgatgactctttggcacggactgactgacatcttaaaaggt

SEQ ID NO: 44159 - DNA, 409 bp, Zea mays
  Clone ID: LIB3066-055-Q1-K1-E12
gcaagcgatcgtcggagcagagagagacttcctcgcctgcatcccatcccgccgccgccgggtctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctaccgcgcattcccgatgcgtgggcgtgctctgattgcgcacggcggtggcagtggcacaccttcgtc

SEQ ID NO: 44160 - DNA, 444 bp, Zea mays
  Clone ID: LIB3066-055-Q1-K1-E2
cccacgcgtccgcccacgcgtccggcgccggcgggcggtgccagtgccaccgcgctcgcggcggccgtgaacattaagcagccgctgcacggcgcatcgacgctgttcgcgctgctctctctctcgctgctcctgctccgcctgctcctccgcctccgcctggccgccttccgcgacgcggcgctgtcgctccacctgctggcgcgcctacgcctacgccccgtcctcctctgcctcccggcagcctgccacgacggcggcgccggcgccggcgccaccacgctgcgcgtctggtgccccgccaccccatcctccaagccgccgctgctcctcctacacggcttctgcggggacgccaagtggacgtgggcgccgcaacctccgcgcctgtcccgccacttccacgtgtacgcgccggacctcgtgttcttcggcgcgcagtcc

SEQ ID NO: 44161 - DNA, 431 bp, Zea mays
  Clone ID: LIB3066-055-Q1-K1-E3
gaaagatgtggcgctgaatttcctgaggaagtccttaaacaagcttgagaatccaaatgacgtcctggccttattgttagctgctaagatatgcagcaaggagcgccatcttgcctctgagggtgtcgaatacgcaagaagagtaatcgcctgtgccgaatcatcggatcctcatctgaagagcgtcggcctccatttcttggggagctgtctaggcaacaagtccaaggtcgtttcgtcggactaccaaagatctctgctgcagacggagactctcaagtcgcttgcagagtcgattggccttaaccgctacaacgccgacctcatattcgacatgggagttgagtacgccgagcaaaggaacatgaatgccgccctgagatgcgccaaggagttcatcgaggcaacgggcgggtcggtttcgaaaggat

SEQ ID NO: 44162 - DNA, 349 bp, Zea mays
  unsure at all n locations
  Clone ID: LIB3066-055-Q1-K1-E4
gtcgactcgcacgcgtctcgtggcacgtttcaaatctgtggcccctctgcnngttcgagatnctgatctganngctggcaccagtcccactttgcgcgcatgggcggagggactncgtgagccgccaagccccaatctcactggcaaagttcggcggtagtgccagaagctcgcctggcgagcctcactcnnaccatcgtaggagaatctgnntcgtcgactctcgccgtaaagcccgtacgagaatnctcgcatctncgtggtctgtctgctactctcacgttctgtccactactctngatatcactcnnttctggaaagggctaagagggtggcaccgnnngtgttt

SEQ ID NO: 44163 - DNA, 361 bp, Zea mays
  Clone ID: LIB3066-055-Q1-K1-D10
cggacgcgtgggcggacgcgtggggacgacgaccacctcgccgtcgcccatgtcgtcggtgggggactgctccgacgccatcgtcctcaacagcaagcgacggcgccaccggtcgccgtccgccgcttcatcctcctcctcgcacagcagcagcaccacacagaaagaggaactggaagacgaggaggaggacatggccaaatgcctcatcctcctcgcccagggccccgccgccattgaggcagctagagtaatgccggcaccccgtagcaggccaaagagcacggtgagccgcaggttcttggccgccgtcgaggccagaggtggtgtgtgcgtgtcgtacgaatgcaagacgtgcaac

SEQ ID NO: 44164 - DNA, 93 bp, Zea mays
  Clone ID: LIB3066-055-Q1-K1-B4
gacgcgcactgtaacagcgcattaagcgctgccactgtgttctatacgcgtatcgagaccaatgctcttgtcagcaccatagtttatgattct

SEQ ID NO: 44165 - DNA, 176 bp, Zea mays
  Clone ID: LIB3066-055-Q1-K1-B6
cccacgcgtccgcccacgcgtccgatcaaaggaaaaaatgaaggcctatcaaatatgtcatgaggcacttattatataacgtcgtcaatccatttcttaactcttctcttttaaacaacagcgaagtctcactataactatatattcagatgactaatactcagaacgatgatgac

SEQ ID NO: 44166 - DNA, 411 bp, Zea mays
  unsure at all n locations
  Clone ID: LIB3066-055-Q1-K1-B7
cgagaggagaaccagcagcctccaataagagccagccagagaaactaataaaactgtcgcggccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgnctcggggcccttcgccagcagcggcgcgcncgccctcgccggcgcgcccgccgcgctcttcttctccttccttgctactacctcactaagcgtgtgcgtg

SEQ ID NO: 44167 - DNA, 420 bp, Zea mays
  unsure at all n locations
  Clone ID: LIB3066-055-Q1-K1-B8
gcaatcgagaggagaaccagcagcctccaataagagccagccagagaaactaatagaactgtcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgnctcggggccctccgccagcagcggcgcgcccgccctcgccgccgcgcccgccgcgctcctcttctccctcctcgcctactacctncactaagcgtgtgcgtgcg

SEQ ID NO: 44168 - DNA, 397 bp, Zea mays
  unsure at all n locations
  Clone ID: LIB3066-055-Q1-K1-B9
gaagaggttgccgttaccgaccatgtcgcagcagccggcgccggcgccggcgccgccataggggccgtataggcaggtgagggaggcgacgccccatagccgggcgatctcctgcgtgcggttctccccctgcgggcgcctcctcgcgacagcctccctcgacggaacggtagcgctgctctccccgtcctcactggccgtaatcgccgtcctgcgcggccactctgacggcgtgtccgacctgtcctggtccacggagtcgttctacctctgctccgcctccgacgaccgcaccatccgcatctgggacatccggcccgtcctcgccggtggcgcccaggcagccgtcgtctccggcgcagaccgctgcgtncgcgtgctcaaggggcacaccaac

SEQ ID NO: 44169 - DNA, 91 bp, Zea mays
  Clone ID: LIB3066-055-Q1-K1-C1
caacataaaactaataaactgtcacgatcactttcaactaacacccaaccaacacctcccaactcaatccaaaactacataccaccaccac

SEQ ID NO: 44170 - DNA, 374 bp, Zea mays
  unsure at all n locations
  Clone ID: LIB3066-055-Q1-K1-C10
cggacgcgtgggcggacgcgtgggctgacgcgtgggctgacgcgtggggcaaacagcagtggattgttcacgctcacgagaaanaaggttntgcgtgtgatggaagcgagctggtgcttgcgtatgccagcaagctgcgattctgagtgtaacacataaggatgttctttcattcttcttttttgttcccttgttgcatcaaattgtgccttaaccacgtcgatgtgctgccaaattgtcaatccctgatacggtcaatcatggatggaccgactgcaatataaatatattataccacanaatagcgcgacctttgctacgaaaaaaaaaagcatcngntacgacatcgaatacaccgtctgcgccctcaaagt

SEQ ID NO: 44171 - DNA, 390 bp, Zea mays
  unsure at all n locations
  Clone ID: LIB3066-055-Q1-K1-C11
cccacgcgtccgggaggcctgtccaccaccgaaccaccaccaccccgcgcgccgagctcacgccgatccagatccaccagtcgtccctccggtctgcgacgggcgccttcctcctcgtcctcacgcgcctccggaagccagtgcctgcgcagtgaagcatccatctgcctctcctctcgtcggatccggggccggccaggcggcggcagcatgaagcgggtgtcgtcgcacgtctccctcgcctccgaggcggagatcaacctcgatctgtcgcgcctcatcatcgacaagcccaggttcacgctggagcggaagcgctccttcgacgaaccagtcgtggagcgagctctctcaccgncagaacgacggcttcgacagcgtgctgcagtc

SEQ ID NO: 44172 - DNA, 306 bp, Zea mays
  Clone ID: LIB3066-055-Q1-K1-C12
cccacgcgttcggccacgctttcgacgagctacgcagagctaatggacacggcgcgctagggcggactcaaagtcaccagccgtcatgtccgttccagcaacggcggcgttacttctggtactcacgtcaccttccgaatgcacgtgcctgcccacggaagatatcgttagggactagtatctctgatcaccggccagtcaggccgccgcagctacaagcacgtgtcgctcgactgctacgtcatgtccgatgctgaggtacacatgcatgtgtagtgcttcatcgtctacatgcgcacgttcacg

SEQ ID NO: 44173 - DNA, 92 bp, Zea mays
  Clone ID: LIB3066-055-Q1-K1-C2
cggacgcgtgggctcacgctggggttgcatgcagggaatgcttgcattcatttttcatttagttaagaattcattgaaattatgagttatat

SEQ ID NO: 44174 - DNA, 373 bp, Zea mays
  Clone ID: LIB3066-055-Q1-K1-C3
gcaacatcgtcctctacggtggtaccactatgttccctggcattgctgacaggatgagcggggaaatcaccgacctggctcctagcagcatgaagatcaaggtggttgctcctccagaaaggaagtacagtgtctggattggaggatccatcctggcatcgctcagcaccttccagcacatgtggattgccaatgctgagtacgacaagtctggcccatccatcgtgcacaggaaatgcttataattctttgggcccaagagatgcaaagccgagaagatccattatcggcagcctggcgcccagtgactgtcttctttagcagctgcgcattcattatcatgaacaaagctctctgtcggtctatccgctga

SEQ ID NO: 44175 - DNA, 512 bp, Zea mays
  Clone ID: LIB3066-055-Q1-K1-C4
cggaattctccgtggtcgactccaactcgtctcggacacttcgatggacacaacgactgattcatccttgacaagtagttgtacttatgactacttatttcagttgcggcaagagaaatactctggcgccataaatgctcctgaagactttgcactgtcctgctgacactcgtcagatatgttagcatgtggagaggaccttggccttatccctgcttgtgttcaccctgttatgcaagaactagtgttgattggattgcgtatccaaagaatgcctagtgaaccaaacttggaatttggtattccttctcagaatagctatatgacagtttgcgctccctcatgtcatgactgctctacattacgtgcttggtgggaagaagattaaggaagaagaagtcgtttctacaagactgtagatggcactgatgaagagccctcatctcgttgcaccccagaagtagtgcacttcattgttcagcaacatgttgacgctccatcaatgtgggcaa

SEQ ID NO: 44176 - DNA, 450 bp, Zea mays
  Clone ID: LIB3066-055-Q1-K1-C5
cgggcacaaccagctgacgggcagcatcccggcggggctggtgcaggggcagttccggtcgctggtcctgtcgtacggccagctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagcggctgtccacgctgcagaagctggacctgagctacaaccgcctgtgcgggccgctccccaagggacacggcgtcatcaagcacgggtgcaagccgtacgcgcacaaccagtgccgcaaagggacccc

SEQ ID NO: 44177 - DNA, 456 bp, Zea mays
  Clone ID: LIB3066-055-Q1-K1-C6
gaggcaggaggaggaggaggaggccatggcgcgcgctgcgggcgtggaggcgcaggcgcggcggcggccacggctggtggggtacgaggagctgccggagtacctcaaggacaacgagtacatccgcgggcactaccgcgccgagtggcccgtccgcgacgcgctcctcagcgccttcgcctggcacaacgagactctcaacgtgtggacgcatctcggcgggttcctgtttttcctggcgctcgcggtcgccggagggtggacggaggccgccgacgaagccgctcccgggatcatgaggttcgtggtgacaccaccagctaacgcttcgtggggtagcggccagcattcgggtctgccaagccacgacggcagggcgtcgcagtccggcgtgccgcggtggccgcggacggtgttcctggtgggcgccatgtcgtgcctggccatcagcgcgac

SEQ ID NO: 44178 - DNA, 437 bp, Zea mays
  Clone ID: LIB3066-055-Q1-K1-C7
gacgagtagaggttagatttaggctgaggtaagatggtgtgcatccggcaggcgacgcatcgaagacctgctggcgatgcaggcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggaggacccctccgagccctgccacggtcacatcacctccctcgcggtcctccgctcccaccgcaagctcgggctcgccactaagctcatgtccgccgcgcaggccgccatggaccaggtcttcggcgctgagtacgtgtcactccacgtccgccgatccaaccgcgctgccttcaacctctacacctctaccctcgggtaccagatccaggacatcg

SEQ ID NO: 44179 - DNA, 415 bp, Zea mays
  Clone ID: LIB3066-055-Q1-K1-C8
cccacgcgtccgcccacgcgtccggtgaggtgagtaatatgaagcaagagaataacaaggtgaccaaagagctacaagctgggctcgagcatgtaaggggcctccaagtggaaattgggaggacagttctgaagctcagagacaatattgaactatccattgggagaagcagtcgagcacatcagaacttcagatatctatcagggaaggccggggtacctcaacgaacttccttatttggttctaggacgaaaaagacatcattattttcatgtatgcctcccattgccaaagccgatttctgacatgaggtcaagtctttttagataacattggttagagggttagctaattttttcttctattcgatatgggtggttctctatgaacatgcttaaaaaaattgatgcaaggt

SEQ ID NO: 44180 - DNA, 308 bp, Zea mays
  Clone ID: LIB3066-055-Q1-K1-B3
ctgaaatgagcattttatattaacgaggatttggccctattacacgaacagtacatataggactcgcatacaatttacaatttatagcataatcacaacttatatcatacaaatacacaaaaacacacttgactaactatataatccatttcgacactattatatctacacatgtgttacttgcactacttttatcaatactactcattggctataacatactcacattgacgagagctatgataatattaacactatattctattgcactatttccaccaatattctaataatgatgaccactttat

SEQ ID NO: 44181 - DNA, 393 bp, Zea mays
  Clone ID: LIB3066-055-Q1-K1-C9
cgcagagactcggaagtcggaaagaatccctcctgttcttcgtcaaccctccagaacctgcgctctcttcctctacgagactacgaccgtgtaaggatggccgtcgagcgcttgaagaccgggttcgagcagttcaaggccgacgtctacgacaagaagccggagctgttcgagccactcaaggcgcaccagtcgcccaagtacatggtgttcgcctgctccgactcccgcgtgtgcccgtcggtgaccctgggcctgcaccccggcgaggcctttgccgtccgcaacatcgccagcatggtgccgtcctacgacaagaccaagtacgccggcgtcggctccgccatcgagtacgccgtctgcgccctcaaagtggaggtcatcgtggtcata

SEQ ID NO: 44182 - DNA, 452 bp, Zea mays
  Clone ID: LIB3066-055-Q1-K1-A10
ctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaagaagccgtggagaagaccgtcgtcgaggaggagaagccagcggcagcagcccatgcagaagaaaaggtcgccaccgtcgtcgagaccacgacgacggtggaagcgaaaaagaacgccgaggaggccgggaaggagaaagctgcgcaacaaaacctgatc

SEQ ID NO: 44183 - DNA, 446 bp, Zea mays
  Clone ID: LIB3066-055-Q1-K1-A11
gtcggggcggcacgccgccgctcgcgtgggcccagcggttccggatcgccggcggagatcgcgacggcgctgctgttcctgcaccaaacgaagccggagccgctggtgcaccgggacctgaagccggccaacatcctgctggaccgcaactacgtgagcaagatcagcgacgtcgggctggcacgcctggtgccgccgtcggtggcggacaacgtgacgcagtaccggctgacggcgacggcgggcaccttctgctacatcgacccggagtaccagcagacgggcaagctgggcgtcaagtcggacatctactccctcggcgtgctcctgctgcaggtggtcaccgcgcggccacccatggggctcacgcatcacgtcgagaaggccatcgacgcgggcacctttgagcagatgctcgacatcaccgtcaaggactggcccgtcga

SEQ ID NO: 44184 - DNA, 169 bp, Zea mays
  Clone ID: LIB3066-055-Q1-K1-A12
gagataccttaaggctccacgaaataaaatactcatggctcgcccgatttgtgatcaaaaaggaaaaaggtacataatactacaaaaaaaaaaaacaaaaccaataatacacaaataaactaaaaccaaacaacaatacagctaaaccaaaactacataaacaagatca

SEQ ID NO: 44185 - DNA, 395 bp, Zea mays
  Clone ID: LIB3066-055-Q1-K1-A2
gacgccgcgacctccgggggcttggctttgggaaatggaccagccgctcactgcccccagtcagtggccgcgcgccgcaccaagtgagctagctactctctaggcggagtgaagcgaagctagcttagctgcctcgagcttgagctgagcttgctcacttttctcccctcttcttctagtaccggcacacacaccgcagctgcgaaaaaggaagctctctctctctggtggtgccggtgcgccgtgcttgcttgcttgcttgcggctgcatccatggacgcctacgaagccaccaaggtggtgttctcgcggatccaggcgctggacccggaccacgccgtcaagatcatgggcttcctgctcatccaggaccacggcgagaaagagatgatacg

SEQ ID NO: 44186 - DNA, 443 bp, Zea mays
  Clone ID: LIB3066-055-Q1-K1-A3
attttggatcttacaaagaaaggtgtttgcattttgaaggactgttcaatgcttattatggaggaggcagacaagcttctctctcctgagtttcaaccttccatagaacagttgattcgctacctccctgctagttgactgattgatttgaagcttggaaaagagggtgttgagacagtgaactttctgtcgttcttcaacaaaagcatagaactgcgtaaatcgtgttgaactattggcgaagaagatcacagagcttggttattcttgcttctatattcatgcaaagatgctacaggaccaccgcaatagagttttccatgatttccgtaatggagcgtgcaggaatcttgtttgtactgatctttttacaaggggaatagatattcaagctgtgaatgttgttatcaattttgatttccccaagaactctgaaacatatc

SEQ ID NO: 44187 - DNA, 447 bp, Zea mays
  Clone ID: LIB3066-055-Q1-K1-A4
ggccatcttcgtcgaccttgagcccactgtcattgatgaggttcgcactggctcgtaccggggactgttccacccagagcagctcatctcgggcaaggaagacgcagctaacaactttgcccgtggccactacactgtcgggaaggagattgtcgatctatgcctggaccgtgtgcgcaagcttgcagacaactgcactgggctgcagggattcttggtgttcaatgctgttggtggtgggactggctctggacttgggtcacttttattggagcgcctttcagctgattatggcaagaaatccaagcttggattcaccatttatcctttcccacaagtgtcaacaacttgtggataaccctacaacagtgtcctctccacacactccttgcttgagcacactgatgttgcagtcctcctggacaacgaggctatctatgacatatg

SEQ ID NO: 44188 - DNA, 434 bp, Zea mays
  unsure at all n locations
  Clone ID: LIB3066-055-Q1-K1-A5
cggacgcgtgggcggacgcgtgggcgccccgcgcggcggtggcaggccgctccaggaggagatgtacgcatcccccgggaaccgcttcgcctgcggcatcgccgccttcaacgggagacaagaggacgcggcggacgccgaggcacagaggacggtggctctcgtggccagggacccgcccacgagagagatgacggtggatcagctgctcgtcaaggccaaccagctgcatcatctcctcgaccggttcatcgcctgccgccctgtaggcgcggccaaggcgaaccgagtggtgggggtctctctgtacccgctgatcaaggagagcgtgcagctctactgcgagctcacggaggtgacggccacgctcatcgagcagttcgcggagatggagaccgcggactgcgagcgcgtgcacgcnctcttctgcggtc

SEQ ID NO: 44189 - DNA, 407 bp, Zea mays
  Clone ID: LIB3066-055-Q1-K1-A6
aaaaaaaaaaaaaaaaaaaaaaaaaaaaaaaaaaaaaaaaaaacaataaaaaaaaaggaaggggtacactttacaagctcgcaaccttataactgttctattctgaccccatcaactctactatcatgcgccacctattttcaacctactcctctgttaatttacaactccctcgcttcaaaacctttgtcctgcacaaacttcttcgtcctgcagctcatccacctttcagcacatgtcctattatccttctgccctgcaactgacgatctttcctgaattcgaccttccctactgtcgcgcatcatgcacggtgaatggggttattactctccccggcaatgatactctagccctctgcctcttacccactcctcatccttttaacttcccatctttctacattc

SEQ ID NO: 44190 - DNA, 440 bp, Zea mays
  Clone ID: LIB3066-055-Q1-K1-A7
atccagattccagcagcaacatctgcatcgaggattgctacatttctactggtgacgattgcatcgccatcaagagtggctgggatgagtatggaatcgcctatggccgcgccatttctggcatcaccgtgcggcggatcacaggctcctccccgtttgctggcttcgcggtcggaagcgagacatcaggtggcgtggagaacgtccttgcagagcacttgaacttcttcaactcagggtttgggatccatgtcaagaccaacacaggcaggggcggcttcatcaggaacatcactgtctcggatgtgacgctggataacgtccggtacggcctgcggatcgttggcgatgtcggcaatcaccccgacgacagctacaaccggagtgcgctcccgatcgtcgacgcccttacggtaaagaatgtccagggccagaacgtc

SEQ ID NO: 44191 - DNA, 357 bp, Zea mays
  Clone ID: LIB3066-055-Q1-K1-A8
accacgcgtccgaaaattataaaaagctatattctaagcatattgaaagggatggtgagttgtgattaaaaaaaaaaaagcagaaaaaaaaaaaaaaaaaaaaaaaaaaaaaaaaaaaaaaaaaaaaaaaaaaaaaaaaaaaaaaaaaaaaaaaaaaaaaaaaaaaaagggccgcccttttaaaagaaccaaacttaactacccctgcattccaacaaaaaacttttaaaaaagggaacccaaatttaatttaactgcccgcgttttaaaaacttagaaactggaaaacccttgccatacccaatttaaaccccttggcaaaaaatccccttttccaaacttggcaaaataccaaaa

SEQ ID NO: 44192 - DNA, 292 bp, Zea mays
  Clone ID: LIB3066-055-Q1-K1-A9
cccactcgttctcggactcgtgttcgtactcttaggaaaaacaaataaacagaacatatcgggactaagggaactaattctgcaccaaaacaaattcaattacattcatacaccatatactaaaacttatacaacatccttccattctaaaacacccatttttacaccagtcatttcctacttattctatttataatcaactcatatatcttaacttaattaacaaaaactttccaccgctttaaatgatacaaccttacgtattcctacctaataccccctaactcttata

SEQ ID NO: 44193 - DNA, 402 bp, Zea mays
  unsure at all n locations
  Clone ID: LIB3066-055-Q1-K1-B1
cgtgttgcaaaccgcttcatccttgatcaggatgttgctatngctgccatgggcccatccggggacgttcagactacaactggttcagacgcccgacctacatgctccgttactagattaatcagcccgtgtacccatgtttaccgtctgcaaaagacaagataaaatttgcctcttttagcgtcagtatattaaggcctcagcactgcacattacgtgctgcgatggaggaattttttgagaatttgttttatttcttgtcgtgtccaaaatccacaaatctgtcaataatgataggcaagttcgactgacgtggctgacttggttggccacccgatgttttcttacaacgagtcatgaaccataccgtnccatcttttggtggaagaatttactttgggc

SEQ ID NO: 44194 - DNA, 408 bp, Zea mays
  unsure at all n locations
  Clone ID: LIB3066-055-Q1-K1-B10
cccacgcgttcgcccacgcgtccggtctaggtttcctctctcaccatagcgcccgctctgtggcccttcgttcacctctacttactctactccctgcctgccagggagaggggaagtcagaggcacggagtggcgcagagcagacgcccgtgaaccattgtagctgtccctgtcgtcgtcatcgtcgtcgtcaacgaatccgcacaaggaaaagatggagaagaagccgaccatcctcatgaacaggtacgagctcgggcgcacgctcgggcagggcaccttcgccaaggtgtaccacggccggaacctcgcgtncggcgagagcgtggccatcaaagtcatcgacaaggagaaagtgatgcgcgtcggcatgatcgaccagatcaagcgcgagatctccgtcatgcg

SEQ ID NO: 44195 - DNA, 451 bp, Zea mays
  Clone ID: LIB3066-055-Q1-K1-B11
cccacgcgtccgagtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgg

SEQ ID NO: 44196 - DNA, 357 bp, Zea mays
  Clone ID: LIB3066-055-Q1-K1-B12
gcagatcgagcagaggtcgacaagacgagacaagagaatgcctgtgagcaggatcgccgtgggcgctccgtgcgagctgtcccaccccgacaccgtcaaggccgccgtggccgagttcatctgcatgctcatcttcgtcttcgacggctcaggatcgggcatggccttcagtaagctcacggacggtggcgccgccactcctgccggcctgatcgacgcgtctctggcgcacgccctagccctcttcgtggccgtctccgtgggtgccaacatttaccggcggccacgtgaaccctgccgtgaccttcggtgcctttgtgggcggcaacatcagcctcctcaaggccctggtctact

SEQ ID NO: 44197 - DNA, 417 bp, Zea mays
  Clone ID: LIB3066-055-Q1-K1-B2
cgtctcgctcgtggctgccctactcgtgctgcttgccctcgccgtcgtttcctccacgcgcggcgcacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaagcagctgcaggaattcaagcctgttgaagagggtgctagcgcctaaagatcttgtcgtctcctgtgcaattt

SEQ ID NO: 44198 - DNA, 439 bp, Zea mays
  Clone ID: LIB3066-055-Q1-K1-A1
cccacgcgtccgcaaattatgggatattctagccgtgtatgcatggattgacatagatgttggttactgccaaggaatgagtgatttatgctcaccaatgatagttctactaaaggatgaagcagatgccttttggtgctttgagaaattgatgcgtagattgcgaggaaatttcaaatgcacagatcaatctgtgggagtatccaaccaacttcaacatcttgcatctattattcaggttcttgacccaaagctacatgaccacctagaaactcttggcggaggtgactacctttttgcgttccgaatgttcatggtgctatttaggcgtgaagtatcatttggagactccttatacctctgggagatgatgtgggctctagaatacgaccctgacattttcttcgcaacatgcgaagaacaaggtgcaatacataaa

SEQ ID NO: 44199 - DNA, 397 bp, Zea mays
  unsure at all n locations
  Clone ID: LIB3066-037-Q1-K1-B4
cccacgcgttcgcccacgcgtccgattgcaagcaataataatggagacgacgactaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgagggaggcgtacaggcccgacccgtacaacgtcaccaacagcttcaacgccgccgtccacagagctgtcagcagcagtcggcgtgagatgctggagaggccgtggaagcacatgaagaggggcccgttccgggcgactaaccctatcgacaagtgctggcgctgtcgcagagactgggcgacngaccggcatcgcctggcccgt

SEQ ID NO: 44200 - DNA, 451 bp, Zea mays
  Clone ID: LIB3066-037-Q1-K1-B6
cggacgcgtgggcagagttttaaggtttcccagcagagaagagcgcgtgcaaccaccacattgatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggtcctggctccaccaacaacaatatcatcaacagcatcatcaatagtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctcttcagggacacgaatagcgaggcagg

SEQ ID NO: 44201 - DNA, 416 bp, Zea mays
  Clone ID: LIB3066-037-Q1-K1-B7
gcgcggtctcgtggtctcagttgtaaggcttgacagctagcaagagcgcgtgcatccaccacatggatataattaataagcaaggtttagagaagaggcatcatgggcactaagatgaagaaggggatcctgaagccgttccgctatatctcaaccatcatggatggtaaggaggctgaaatgcaaattgggttcccgactgatgtaaaacacgtggcactcatcagctgggatggtcctggctccaccaacaacaataacatctacagcatcaactatagtggcggatcacctatctggatgaaggattaccactcggcaccgcttgactcgtcctcttttaggagtgagagtgggggcacggctgctgcatattcctgggcttctcaagagatagtcatggatggagcaagcgt

SEQ ID NO: 44202 - DNA, 448 bp, Zea mays
  Clone ID: LIB3066-037-Q1-K1-B8
cccacgcgtccgcagagataggcgtcttcgtactcgcctacctccgcggctcaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaacattggcaaggaga

SEQ ID NO: 44203 - DNA, 412 bp, Zea mays
  Clone ID: LIB3066-037-Q1-K1-B9
cccacgcgtccgcaccctcgtctcacccttcctccctcacacaaataataaggaaaggtccggcccttttcctccgacatccacaaggggggaggggaaaacacgtacattcacccggcggcaataatggcctcggttccggctccggcgacgacgaccgtctccgtcatcctatgcctatgcgtcgtcctctcctgtgccgcggctgacgacccgaaccttcccgactacgtcatccagggccgcgtgtactgcgacacctgccgcgccgggttcgtgaccaacgtcaccgagtacatcgcgggcgccaaggtgaggctggagtgcaagcacttcggcacctgcaagctcgagcgcgccatcgactgggtcaccgacacgaccggcacctacacgatcgagctcaaggaca

SEQ ID NO: 44204 - DNA, 390 bp, Zea mays
  Clone ID: LIB3066-037-Q1-K1-C1
ccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcatcggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgaccttctggccggcgccgacaagggt

SEQ ID NO: 44205 - DNA, 476 bp, Zea mays
  unsure at all n locations
  Clone ID: LIB3066-037-Q1-K1-C10
cccacgcgtccgcccacgcgtccgcccacgcgtccgggacgccgcctccgtgctcaccgtctccaagatccactacgagaatatcaagatggaggactcagccaaccccatcttcatcgacatgaagtactgccccaacaagttgtgtaccgccaacggcgcctccaaggtcaccgtcaaggacgtcaccttcaagaacatcactggcacctcctccaccccggaggccattagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagctggcatgcttctagaccctncgtcgactgacccatctctctagttataatttttctctcgtccttgcatggcatattagttgctatccattggtaacgcacaaca

SEQ ID NO: 44206 - DNA, 67 bp, Zea mays
  Clone ID: LIB3066-037-Q1-K1-C11
tcgtccacgccttcggccacgcgttcgtggacaccttggccaagatggcgttcatcaggcatatcgc

SEQ ID NO: 44207 - DNA, 55 bp, Zea mays
  Clone ID: LIB3066-037-Q1-K1-C12
tctaaacttcattctgccaaccgtatctatactcttgcaaatctacacctttatt

SEQ ID NO: 44208 - DNA, 199 bp, Zea mays
  Clone ID: LIB3066-037-Q1-K1-C2
ccctcctacacctttctccttttcttgccactgcataacaccttctccggcgagagcatggcgatggcgtaccgtgtcctgtaggtcaccctggtatcggctaatgacctcaagaaagtgacgctcttctcccggactcgcatctacgccttggcttccatgtacggattcgacctccgctttccttcccacagcaccc

SEQ ID NO: 44209 - DNA, 390 bp, Zea mays
  Clone ID: LIB3066-037-Q1-K1-C3
cgacaagatggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccattcaggtggatggcaatctgctggcgaccacggacctaaaccagtacaaggaacatggtaattggatcgagattctacgcgtgga

SEQ ID NO: 44210 - DNA, 184 bp, Zea mays
  Clone ID: LIB3066-037-Q1-K1-C4
tcgtgcgacgacgccttccacagacaacgcgatctttcgcctgtgtcctgctgtccatctttttcatcgggcatgtcgtcaacgaagtgtcaaccggcatccattcgaaatcgtacggccccgacgactcctccgacatcaccaaatcctgcacttccacctacggcaagacagacaactccat

SEQ ID NO: 44211 - DNA, 426 bp, Zea mays
  Clone ID: LIB3066-037-Q1-K1-C6
cccacgcgtccgcaagatggcaaatgctctcctaggtggcctgtgggcgatcgtcgtcgtcgcggtggtcgtcggcgtggtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaatgtggcgctggagtcggtgaaaacagcggtcgagcagtccaagacgatcggcgaggctaatgccagcgactccatgaccgagagcgcgcgggaggactgcaagaagctcctcgaggacgccgttgacgacctcaggggcatgctcgagat

SEQ ID NO: 44212 - DNA, 446 bp, Zea mays
  Clone ID: LIB3066-037-Q1-K1-C7
gtacagtcatcacagaaaaggatcgaggatctcattgaggcgttttctaacaaatctgtggtcactgaaggtaacaatttaattgcaattccagaggatcctgaattgtctgccaaacttgttcggaagactacagtgaagaaaagacatggttggtggaggcaatttcgtttgctttttaagcgagcatggatgcaggcttttcgtgatggaccaacaaacaaagtgagatcacgaatgtctgttgcttcagcagttatatttggatctgtgttttggcgaatgggaaaatctcaaacatccatacaagacaggatgggactacttcaggtggctgccataaacacagcaatggctgcattgacaaagactgtgggagttttcccaaaagaacggagtatagttgacagagaacgagcaaaaggttcctatgcacttggaccata

SEQ ID NO: 44213 - DNA, 440 bp, Zea mays
  Clone ID: LIB3066-037-Q1-K1-C8
cccacgcgtccggaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgactgcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaag

SEQ ID NO: 44214 - DNA, 449 bp, Zea mays
  Clone ID: LIB3066-037-Q1-K1-C9
cggacgcgtggggccaccatacatggctatatatatagccggcggcttacacaaatggagaaggttctccttgattgaagatctaatcaaaataggaaggatactaatcagctagctactttctctcctagccaatctccttctatgtttgctgcatgcacaatcaatcaggcggtcgccttctatgtttgctgcatgcgcaatcaatcagatgactactttccatcctagccactcacctgctgcgcatgtgcctttgctgcctgctcagctcggcgcacatcgcgggctctcctacgcctgacgtgtcaggagaatttgaactgctgcaaacactaaaagaactgcttggtgatgccagcactctgggagcacgtcaaagagctgcataagatgcattttcgattatgtcagatggagttgtgaaccgtgtatgggatttagtctgc

SEQ ID NO: 44215 - DNA, 413 bp, Zea mays
  Clone ID: LIB3066-037-Q1-K1-D1
cccacgcgttcgcccacgcgtccgcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctgagaaatgtaaggttgtggtgaaaccaaccagggttgttgttactcttttcaagggttctaaaggcaactggttag

SEQ ID NO: 44216 - DNA, 205 bp, Zea mays
  Clone ID: LIB3066-037-Q1-K1-D10
aaaaaagtgtaagctatagagagagagagagggtggctgagagaagagaacttatagcgaatgctgtacttggctgaagtcatgtatgcatctggagctctaacggaaatgtctttttgccaatggttttatttcggtttgggatctacacatttgctttgtaatgttaattacattagtacatacatgtttccagttatgtgtt

SEQ ID NO: 44217 - DNA, 317 bp, Zea mays
  Clone ID: LIB3066-037-Q1-K1-B2
attggtggctcctcgagccattcatgatgttgctaccattctcatagacatttcagcagaagtgatcgatatcttatcttgccttcggatagagaagtggatacagagacacatggattgagaacatgatactgaagccgatccggcatatgtcaaccatcatggatggtcaagtcgcgcaaaggcaaatcttgttgcctaccgacgtttaacacgtggcacacatcggtaggaatggtcctggctacaccatcaacattgacctcatcagcaactacaatagttgcagagcacctaactggatcaaggattaccac

SEQ ID NO: 44218 - DNA, 334 bp, Zea mays
  Clone ID: LIB3066-036-Q1-K1-H7
cacaagtagggttaggaaggctgcggccagcggcgagaggaggaggggtgggtcagcgatgactgggaaggcgaagccgaataagcacactgcgaatgagatcgccgtgatgatcgacgcggcgactactaaccggggcggcggcaaggccgggctggctgaccggctgtggcaggacaagggcggtcatgcgaagctggcgtgcccgctctgtcggactccggctcccgacatcgagtgcatgcagatccaccacgaggcgctccaccgcaagctccccttcgagccgtagtagctcctctacctgcactctttctgccgctctgctgctgtt

SEQ ID NO: 44219 - DNA, 371 bp, Zea mays
  Clone ID: LIB3066-036-Q1-K1-H8
cccacgcgtccgcagtctcgtgggacacactgctcataggttaagagctcaaaagctacctgtctatttatctacttcactcaggtgaatccctgctgtgctgttatattgtttcttctttttaccgttggctattttctttgctccaagaagatcatcgtcatgccaaagtgcgttttttaacgtacataataatgtggtactttgctgatgctaaaatgtaagtgtggagctcatttggaacatacgttctatggggtactcgacgaagaacattgattatacatgtttctggcacattctcatgttaagaataagcacccgctattatttttcgcattcatgtaaaaaaattttacataacatataat

SEQ ID NO: 44220 - DNA, 416 bp, Zea mays
  unsure at all n locations
  Clone ID: LIB3066-037-Q1-K1-A10
aattatattctctctctctctctttcatttctatagccagcaggtagcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcangcggtggagttggagatggagttggtgcctgctgatgcaattgcgatgactatggatcatgaaccgccgcaagaatgcgcgaccccagtgagcgtggaggaggcgtgccgcggcgcgtctgagacgcacgccggcgtggcctacgaccactgcatggcgtcactgggcgccgacccgggcagcaaggatgccggcaacaagaacatgcacgcgctggcggtgc

SEQ ID NO: 44221 - DNA, 381 bp, Zea mays
  Clone ID: LIB3066-037-Q1-K1-A11
cccacgcgtccgagcaaagggaaaatggctgtttccacaaacaacactctcagggtgctgggcaccctaatggttgtatgcgccgcagtatgcacagcgaaaaggaccgtagcaaagacaggagacttggctccagcccctgctccattaggagcttgaggcgctattttattcccagaaggtgcggctagagccagcaggacgttcgacatatcgaagttcggcgcgaccagcgacggcaagacggactcgacacatgtggtccaggacacgtggacgtcaacgtgcggagcgattggagacgcaacgatgctcattcccaatggcgactacctggtgggccctctctacttcagaggcccgtgcatggaggacattaac

SEQ ID NO: 44222 - DNA, 473 bp, Zea mays
  unsure at all n locations
  Clone ID: LIB3066-037-Q1-K1-A12
cgagctcctcgggaatccggtgccaggcctcgccttctcgcggcggtgctccctccctcttggtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcaccaccaccagcagcagcaaccgcagccgcggaatgccggcatggacacccgncacccgtgggtcgacgccgggttcgccaggcccagggcgcccg

SEQ ID NO: 44223 - DNA, 381 bp, Zea mays
  Clone ID: LIB3066-037-Q1-K1-A2
ttcccggtcgaccacgcgttcgggacgcgtgggctcgccagccatgggcaagatcaagatcggaatcaacggcttcggaaggatcggcaggctcgtggccagtgtcgccctgcagagcgaggatgtcgagctcgtcgccgtcaacaaccccttcatcaccacggattacatgacctacatgttcaagtactacaccgtgcacggccaatggaagcacagcgacatcaccctcaaggactccaagacgctgatattctgcgagaagccggtcaccgtatttggcatcaggaaccccgaggagatcccgtggtgcgaggctgctgctgagtatgtcgtggagtccaccggtgtcttcactgacaaggacacggctgctgcaca

SEQ ID NO: 44224 - DNA, 450 bp, Zea mays
  Clone ID: LIB3066-037-Q1-K1-A3
gtcgcctactgttgcttgtggttgtggccagtccttcccctctcatcccgggccccggggaaaattttgccccctgaaaccctatcgcgtcggatcacaagcaagggcaaaattttctgcgactccggctgaaggacgctgcggcacctatgtcggacgacactggccgcactatacccaagttcggcgaatgggacgtgaacaacccggcctctgccgacgggttcacggtgatcttcagcaaggccagggatgagaagaaagccccggcccaaggccacatcagggacaggtcggcgtcggccgacagctaggactccaggtccagggatgagaagatgacctcctacagctccaggaccaacgcatcgaagaaatggttctgctgtgtctcgcccagtcccacacagtcttgagggagctaatgagccgtgcagtgctgcattttct

SEQ ID NO: 44225 - DNA, 412 bp, Zea mays
  Clone ID: LIB3066-037-Q1-K1-A4
gtcgcctgctgttgtttgcggttgtggccagtccttcccctttaatcccgggccccggggaaaattttgccccctgaaaccctagcgcgtcggatcacaggcaagggcaaaattttctgcgactccggctgaaggacgctgcggcacctatgtcggacgacactggccgcactatacccaagttcggcgaatgggacgtgaacaacccggcctctgccgacgggttcacggtgatcttcagcaaggccagggatgagaagaaagccccggcccaaggccacatcagggacatgtcggcgtcggtcgacagcaaggactccaggtccagggatgagaagatgacctcctacagctccaggaccaacgcatcgaagaaatggttctgctgtgtctcgcccagtcccacacagtc

SEQ ID NO: 44226 - DNA, 417 bp, Zea mays
  Clone ID: LIB3066-037-Q1-K1-A5
cccacgcgtccgcccacgcgtccgctttcacctccagcctcataagcctgcggttaggggggcataaccccaaccggagaggacggccgacggctacgagctacgtagccgtggtccggcgagtcggggattccagatgcttcaaaatcatcaaaaaggaaagctgcaagggggatgccaactccacagtacacatactgtgttgccagaacatctttccgagcacatgcactgggaataaccgctgcttgggtagtgcaatccataattgaagtatacagatgtttcatccgtaagcctagtgaggactgtgaagcactatcaagcgacggcaatgaacagtttgacgatatgaataaattcagattgttcgggaggaagatttatgggattaccatcaaaagttgtttctctttg

SEQ ID NO: 44227 - DNA, 448 bp, Zea mays
  Clone ID: LIB3066-037-Q1-K1-A6
ggtaatcggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttgcacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcagcgacgactgcatctccatcggacccgggacctccaaggtgaacatcaccggcgtgacctgcggtcctggccacggcatcagcatcggaagcctatggcggtacaagg

SEQ ID NO: 44228 - DNA, 395 bp, Zea mays
  Clone ID: LIB3066-037-Q1-K1-A7
cccacgcgtccggtttccggtggaggatccggtggcgtcgatgctggtgtctccggaggcgccaaagttgacggcaacattggaggaaaagcgggagggagtggaaatgcatatactggagctgatgcaggtacaagtgtttcaggtggaggatccggtggcgccagtgcaggtaccagtgctaccgtgggtgctggtgtctccggaagtgccaaagttggtggtggcgtaggaggaaatgcaggaggaagtggcaacgtctatactggaaccggtgccgatgcaggcgtttttggtggaagatccggtggcgccaatgctggtatgggagctaccataggtgctggtgtctgcggacgcgtaaaatttggtggcggcgccagaagaagtgtaag

SEQ ID NO: 44229 - DNA, 399 bp, Zea mays
  Clone ID: LIB3066-037-Q1-K1-A8
atttcccggtccgaccaacccttccgcggattcttaatatttccttagccttatcttatttaatttaaggatttgcgtcaagtccgtgtgtgatcattccatgaaatatatgatatgggtttccatttgtttgaaaaaaaataaaaataatacaaaaacaaaaaaataaaaataaaaaaacaaaaaaaaaaaaaaaaaatacaaaaaataaacaaaaaaaataaaaaataaaaaggggggcccctttttaaggtccaaagtttctaacccctgcattaaaagttaaaaccttttctttagcggccccaaattcaattaattggtcggcgttttaaaaccaccggacttggaaaaacccggggttccccaaattaataagtctggagaaaaatccccttt

SEQ ID NO: 44230 - DNA, 294 bp, Zea mays
  unsure at all n locations
  Clone ID: LIB3066-037-Q1-K1-A9
cccacgcgtccggaacgacagctgcatggagttcctcagggccatgaagatcgtggaggtgcccactttcgtcttcatcagggacggccagatcgtcggccgctacgtcggctccggcaagggggagctcgtcggtgagatcctccgatacaacggcgtcagggtcacctactgaagtgaagtagtgaacaacaaaccagtcagagtcagagcaagcgcaagccgacaagcaacgcttcgatacaaaattgaagacgatacanaattttagattactgcgacatccatcgacga

SEQ ID NO: 44231 - DNA, 254 bp, Zea mays
  Clone ID: LIB3066-037-Q1-K1-B10
attctgcaaatactgctagacttgcgtatcgttggatatgtcctatcaggaggtaaatgttgtttcaccatcagtccttaaatgcagacttaacatgatttattgccaagcgccactaccaataccttgctttaggtttaaacacgtcacagttacaggcagcctcagataccatagagtctataaacaagttattcaacaccctctcacatatatcggatcatatttagtttacaacggacaaaccttttttg

SEQ ID NO: 44232 - DNA, 331 bp, Zea mays
  Clone ID: LIB3066-037-Q1-K1-B12
tctacgcgtacgactagatctagatccagatctagacctctatctcacatctcagggtccatttcgaatgtctaacatttttcattacgtccacgtctacaatgctaaacctcaccatcaataccacactcaactcaaacgacagcgctttaaacacaccggagcatacggaccatacatttctcacctgtactacaactggcccacctgcacctgtcatcaattgtcacagacgtggcaccacttgtccccaagctttaaggacacgacttttatctccccacatgcattcacgaacactttacgaacatgttccttagctttaccaaca

SEQ ID NO: 44233 - DNA, 362 bp, Zea mays
  Clone ID: LIB3066-036-Q1-K1-H6
gcgcatgactcgtgctgcgcatgagcatcgggatggccaactcaactagctaggacggacgacagggaagcgacttgaagtgtctgatcaaaactcttctagatttggagaagaacctctagatgagaaaggaggtataggtgaacgaaacttcacgtctcttgcatgacgcgtgcagtgcatgagatcgggatggtcaactcatctagctgtgactgacgacactgagaagacaacagatagcgtcaacactcattatatggataatagtgtatggatagatatatagatactcgtcacaccgaatgctcacttgcgcatgatctgctcctgaattccatcgttcctgaaccagtagatca

SEQ ID NO: 44234 - DNA, 387 bp, Zea mays
  Clone ID: LIB3066-036-Q1-K1-F4
tggacgcgtgggcaaaccgacgatggcgtcgaataagacggtcctcatcgccgcggcgaggcttctcatcacgctcgtgctggaggccgcccctgcggcgaccgtcatggactgcaaggccggctgtgacgaggtcacgggcccactccacatgagcatggaggactgcatgaagaggcgcaaggagatcgctgctaagcaagggcctacggacccttacaaggatcacaaacttgacatcccatgaactaatcaatgctactatatcatctgcctatccatgcatgcattgcattgcgtatgcacactgtgcgtgcctgcccacaaagctcgacaacacagcgatctacacggatttgacatcgagtacactcgatcgagagatcg

SEQ ID NO: 44235 - DNA, 273 bp, Zea mays
  Clone ID: LIB3066-036-Q1-K1-F5
ttggctaccctcgtcgtcgtctcactcaccccggcttctcgcatcgctgaccaaatataggggccggccttttccgacattcacaggggggacacgaaatcagcggccatggtctctattccggcgacgaccttgagcgtcatcttatacgtcctcttgtgtgcctcggctggcaccggccttgacaacgacgctatgcgactacgtcatccagggccgcgtatactgcgacacctgccgcgccgaggttcgtgaccaatgtcaccgagtaca

SEQ ID NO: 44236 - DNA, 280 bp, Zea mays
  Clone ID: LIB3066-036-Q1-K1-F6
gcaagccgtgctcggaggcgaggcgttcgcacacctcgccgcgcgtccttggcctcgcgccgctccaccactgttccgttgcgcccgctaacgatcacgcgttttcggtgggagagagagtaagtagttagaggtcgggacaggatgctcgggttcaggcatatgtcatcttcttccgctgaggctcacgctctatcggatcagctgtgcgaaggggtggcggccttcttggccgctcgataggcgatggagacgccgctgactgcagctgatgcaacgt

SEQ ID NO: 44237 - DNA, 110 bp, Zea mays
  Clone ID: LIB3066-036-Q1-K1-F7
gcgtacggaacgttctgtgtggcctgtattaacacggattgtactcctcaccatatcggctcggggggctacatgtctatagccttacgcgctaggggacgtcagaggcc

SEQ ID NO: 44238 - DNA, 359 bp, Zea mays
  Clone ID: LIB3066-036-Q1-K1-G1
aatgggtggatcgacgcatgcgtacgggacgcccgtgcaggccgtggtcgagcccgacctaaaggtgaccatgtacgcgccaccggtcacgacgcacggctactccatgaaccagcggctgctggtgctgtccgtcaccgcgttcgcggccaacgggcagaggtacacgataacggtcgacgctccgggaaagcctgagctcgcgccgccgggatactatctgttgtacgtcatagcgaaaggcgtgccgagcaaggccgcgtgggtgaaggtacacacatgagaacgaaggcggctcggagacgaatgccagtcgcgtttggcacgacaatacacatgtgtccaccggagtagctgga

SEQ ID NO: 44239 - DNA, 374 bp, Zea mays
  unsure at all n locations
  Clone ID: LIB3066-036-Q1-K1-G2
tccacgcgttcgtccacgcgttcgcacaaggcgaggccgagtcgagtagcgcgaccacaaggacacacaccgcgtcgagtctcacacggcagggcacgcgtcaaggcgatccgttccatgccgccgccgccgctgccggaggagaagccgcttgcgcggcgaaagccagagccgaagccgcctaagcccaagcccaaggggcctaggccgattgggccgttgcctcagcgggacggggaccccggcggcggcgtcgccacgtcccctccgctcctgttctgcggcgacggctgctccggcccgtgcgcctacttgccccagtgccagacgcctactncgtcgtaccctggtgccaccgtgcgcctccgatcgag

SEQ ID NO: 44240 - DNA, 337 bp, Zea mays
  Clone ID: LIB3066-036-Q1-K1-G3
cccacgcgttcgctgtgaagttgacattgaacagatggaactccttctgtgccaactgagcggtacggacattaccgagctcattgccgtcggcagggagaagtttgcttcagtcccatgtggcggcggcggtgtggctgtcgcggcagctgtccctgctgctggcagcgctcctgcagctgaggccaataaagaagagaacgtggacgagaacgaagaaagcgatgacgacatgggcttcagcctcttcgactaagcttgtgcaatagtcaagaatattgttcttgagtcgctgaagcagaggggattaaaatcttaatcatgtttggactttaac

SEQ ID NO: 44241 - DNA, 363 bp, Zea mays
  Clone ID: LIB3066-036-Q1-K1-G4
cggacgcgtgggcggtggcgttgacactggaccgatggaactcgtcatgtccgaactgagcggcacggacattaccgagctcattgccgtcggcagggagaagttggattcagtcccatgtggcggtcggcggtgtggctgtagaagcagctggccctgctgctggcagcgctcctgcagctgaggcgaagaaagaagagaacgtggacgagaaggacgaaagcgatgacgacatgggcttcagcctgttggactaagcttgtgcaatagtcaagaatattgctttagagtcgctgaagcagaggggattaatatcttaatcatgtttggactttaactttgtactatgttggaaagttcttg

SEQ ID NO: 44242 - DNA, 335 bp, Zea mays
  Clone ID: LIB3066-036-Q1-K1-G5
cgacgcccgtgcaggccgtggccgagcccgacctaaaggtgaccatgtacgcgccaccgttcacgacgcacggctactccatgaaccagcggctgctggtgctgtccgtcaccgcgttcgcggccaacgggcataggtacacgataacggtcgacgctccgggaaagcctgagctcgcgccgccgggatactatctgttgtacgtcatagcgaaaggcgtgccgagcaaggccgcgtgggtgaaggtacacaaatgagaacgaaggcggctcggagacgaatgccagtcgcgtttggcacgacaatacacatgtgtccaccggagtagctggacc

SEQ ID NO: 44243 - DNA, 327 bp, Zea mays
  Clone ID: LIB3066-036-Q1-K1-G6
caggatcgatggcagatacggagcatcgaacagtatttgtcaccgtgtggactacatgcttcgatgctcttgtcatggcggtagattctccataagtgaagaaggctgtattgcataaaggttatagtaatcttcttattcagatgggccgatgaacatatgtaccattgaaggtctcacgatatgcataccattaagatgatcatttcacattatcaccaagcatcgatgacaatatgagaacagcttacatagttatcagtcatgcatgttcaggatgcatatttgaaacacttgtactctgcaaaccactaatcgctgttgtaa

SEQ ID NO: 44244 - DNA, 259 bp, Zea mays
  Clone ID: LIB3066-036-Q1-K1-G7
tcgcccactcgtccgatcaacttgacaacttattactagcacaaactgaagctacagtctatacacacatgcaaattagattgatcgagggagatcgagagagagctcttaactaatttgagggcgatcgatagttaagctatggcagcaagtggcgatcgatgtggagatgcatggttcatgtaattatattattgctgtgcttgtgatatacacatgcatggatcattaaaaaaaatatgacaagcgatcacctacg

SEQ ID NO: 44245 - DNA, 310 bp, Zea mays
  Clone ID: LIB3066-036-Q1-K1-G8
atcacaagtaaaggtatgtttctaagccttagtacattggttttgtgtactaacatgttgtctaagtgttagaaacaggagaaagaagaaaagaaaagaagtggagagtggctgtgtacagccaaaggctgcttcgggctggggcaccggactgtccggtgtgcaccggacagtgtccggtgcgccagaccagcgcggagcaaaccagccgctatcgggtttttctccggcgacttcggctaaaattcaccggactgtccggtgtgcaccggactgtacggtgagccaacggtcagccgagccaacggtc

SEQ ID NO: 44246 - DNA, 388 bp, Zea mays
  Clone ID: LIB3066-036-Q1-K1-H1
gcgagctggcggacggaacgacgacgatggcgaggagcggcggcgggatggaaggcaacaagtgggcgcgcatcttcaagcacctctcacgaaggacggacaacgagatcaagaactactggaacacgcgcttgaagcgccggcagcgcgcgggcctgccgccctacccgacggacgtcgagcggcagatcaagctgctgcgcgcgcagaacgtcaacccgttcgcagacgcagacgccgacgccggccacgccaacgccagcgccggccttccggggccgccgctcctgtacgacgtctgaaacccgttcgcgttgctctacagcataccgtcactgtcgcagacgggcttgcactcgcactcggcactgatcaatcagaactaccc

SEQ ID NO: 44247 - DNA, 323 bp, Zea mays
  Clone ID: LIB3066-036-Q1-K1-H2
ccatgacgcgtgcagtgcatgagatcggcatggccaactcaactagctaggacggacgacacggaagcgacgtgaagtttctgatcaaaactctccgagatttggagaagaaccgcgagatgagaaaggggggagaggggaaggaaacttcacgtcgcttccatgacgcgtgcagtgcatgagatcggcatggccaactcaactagctaggacggacgacacggagaagaaaacagatcgcgccaacacgcataagatggaaaaaagtgtatggatagatagatagatactcgtcacaccgcatgcgcacttgcgcagcatct

SEQ ID NO: 44248 - DNA, 421 bp, Zea mays
  Clone ID: LIB3066-036-Q1-K1-H3
gggtaaaagaaagcgaagaagtccgtggagtcctacaagatctacatcttcaaggtgctgaagcaggtgcaccccgacatctgcatctcgttcaaggccatgtccatcatgaactccttcatcaacgacatcttcgagaagctcgcggccgagtccgccaagctggcgcgctataacaagaagcccaccgtcacctaccgcgagatccagacctcggtgcgcctcgtactacccggtgagcttgccaagcacgccgtctccgagggcaccaaggccgtcaccaagtacacttcttcttaggctcatagtactaggctgggtggtgttggtagacgtggctcaattgaatctgtagagtgtgtgatggatgatatgatctgcgtctattgagcagttaagactgatgaacatttgtccacgt

SEQ ID NO: 44249 - DNA, 460 bp, Zea mays
  Clone ID: LIB3066-036-Q1-K1-H4
cggacgcgtgggctagcacttattggcaatccttcgaaagtccacagctggtttcctgggtactcgtggacgattgcagcatgcatggcctgcgagtcccacataggctggctattcagagccaccaagaagaatctgcggcctaggtctttctgggggatccgcagctcacaaatcgcagacgacacacaagtagatcagggtgactgatgctccaaacttccatgcgtataaggccatagtagcagtggactactaagccatgtatgacctggtgttcccaatcctccagtcgtctctggttcatacgcactgcctgcctttcgtgtgttggcatagtaaggacggtggaagtccctgtaaaacaatcactctttttctactggtgtagtagtgctctgcactgaacggatttactgaatctctcttttttggtctaaatagatatctggttcatagt

SEQ ID NO: 44250 - DNA, 359 bp, Zea mays
  Clone ID: LIB3066-036-Q1-K1-H5
cccacgcgtccgcccactcgtccgcccactcgttcgcggacgcgtgggtaaatgtgtctctgaggcctgtacagggagcattctcaaatatctgtaccttcaatggctactgttttaaggttagcatgtttggatgcgcttgggtgcactgcaggtgtcctacgactaatctctactggcggtgagcattatgatcctggaatgataatagtcttcgccccaagggcacctgtaccctcacgtgtgatcgtgggaattaggctctgatggatgcaatgttggaacgtgtactaacacacatagtgcgtttcagaactcgatttaaatgttagcctcagatgctaatgataacataaagt

SEQ ID NO: 44251 - DNA, 386 bp, Zea mays
  Clone ID: LIB3066-036-Q1-K1-F3
catcgttgttcatggcgcagacaatgtatgaagttccttcgccttctttcgtttgctcgcaaatggaagaagcaagtgttggcatcgccctcttccaggttctctggaggacatggttgctggagtgacttggccgtccatcttgccaccgggttggactgtcgagtgggaccctgcctcggctaacgaggagcatgaggagtgatgggacaggcttccccatctctctgtttaattactgttagttttattccgctgcacttcgaacaatgatgattacttttgcaaaaactccgatgatgatgtaataacttaatactccttaatgtatggttttatgctgtattgtatttgctctgtgactcaccttcgagtgagattgtggt

SEQ ID NO: 44252 - DNA, 382 bp, Zea mays
  unsure at all n locations
  Clone ID: LIB3066-038-Q1-K1-D5
ggtcgggatgcttgacgtgctcatcggcgtgggcaagggccaggtaaggaagcagtgccggctggtgaacgggcaggagaaggaggagaagcagcagcagccgcatgaggagcaggaggagcagcagccaccggagctggaggaggaggagcagcagcagccgcatcagccacagcttccatggttcctgcagaggcagcgcccgcccgttcttcttccatggctccggccccatccacggccgcgtcgaccgttccggaaacatccggtggccgacctggttaacggatttttccgtggttgtcactgaaggcgagcactatgctcgggacgtagacctncaaaatatgcaatgctacggtacatatcaatggacgtaaac

SEQ ID NO: 44253 - DNA, 321 bp, Zea mays
  Clone ID: LIB3066-038-Q1-K1-D6
agatgcccgatggcgtacccgcatgggctttagcgagtaaccattccaggtagttccactagaacctgacggccagcgacgtgcaccacaacccgcagggctactaccactacggacagatcaacatcaccctcaccatcaaggtcatggtctacctcggtcacatcgaccgcaagcttcgatacggcttcaacggcatcttctacagtgacaccgagacccccctcaagctctccgagtacttcaacgtcacctaccgagtgttcagctacaaccagataggcgacatgcctccagtcgtttacggtccactacatgtca

SEQ ID NO: 44254 - DNA, 371 bp, Zea mays
  Clone ID: LIB3066-038-Q1-K1-D7
cccacgcgtccggggggctctgcatgccacggggcgatgctggccggaggtgccgcggcggcgtacggagctcacacggtgtcccactcccacgggatgtacggccacggccacggccacggcaagttcaagcatggcaagttcaagcacggcaagtttggcaagcacaagaagatgtttggcaagcacaagaatatgttcggtcgcaagtggaagtgattaacgtacagctttaatccgattctggacgagcagacgtatatatatacaccggagtccagaatgctaagttatgctattttgattgtgattcgaatacgggaggttgttagggttttcgaagtacgtactgacggctgcctgtaagcttt

SEQ ID NO: 44255 - DNA, 373 bp, Zea mays
  Clone ID: LIB3066-038-Q1-K1-D8
cggtgccaggcctcgccttctggcggcggtgctccctcgctcttcgtccgccagcgacgcgggcaggctcgcgcgcggccatgaaggggggcggtgccatgaggccgtcgcctatgttctacgtccacgaggcgtacgtcgtccagatccaccacttcctcgaggagtgctacctctgcgccaaatcgctctactgcgacatcttcatgtacaggggtgacacgccgatctgcaacgaggagtgcaaggagcagcacatcgaggatgacagggcgaagcacctgctgaagaagcgcgcggcgactcacgcgctgttcgcacgcatcagggagcaccggcaccagcagcagctgcagcagcaccaccactagca

SEQ ID NO: 44256 - DNA, 124 bp, Zea mays
  Clone ID: LIB3066-038-Q1-K1-E1
cgcgcttctgttacacacgagacttctgttttcgttgagctaatcttacgacacctgcgtgatcgggttacagatgtgacacggcatccaaactccccacctgtaatgtcttgccaccggatcg

SEQ ID NO: 44257 - DNA, 333 bp, Zea mays
  Clone ID: LIB3066-038-Q1-K1-E10
actcgttcgcaagaacctactcgccttctacattgactaacaactaagcctccgtgaccgccacatcggttatgttcaaacatgggtgcctgtgcaacgaagcctaagacgcttgaggggaaagccccagctgaggccaccatcttcacacccaaggttgcacctgacaccactgccatccacattgaggttgcggcgaaacaagcagtagttgataaggtggaagatgacaaggaagaggcactaacagtggctgcgaaacaagagccagcagccaccatcgagcctcaacagattgctggtgaagtgaccacttcagaagtggctgtcgtc

SEQ ID NO: 44258 - DNA, 417 bp, Zea mays
  Clone ID: LIB3066-038-Q1-K1-E11
ctttaccaccgaagagagaaacgcgagctaccagcgatcgccccatggccgccatggctggttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaagccgtcgcccacctcaacggcctcgtccgggagcccaccgacg

SEQ ID NO: 44259 - DNA, 383 bp, Zea mays
  Clone ID: LIB3066-038-Q1-K1-E12
cccacgcgtccggcggcctccccatggttaggtcgggattctgggcgccgccgcgtggggcattgtcgatgactgccactctggctgctcctacggtcaggttgggtcgggcggtcgcggcctgggtcgtgcgctggtgggcactgggtgcgaaggcatcggccagatttggggaaattcctcaccgaagatcaacagtgccgccgatccgctgctcacgatgaccgtctctaccactacttcgaccgccattgagcgcgaggacacgtgtcatccgaaaagcaagttggtacctggaatctcaagtgccaggagaagaacaggtggtcgaagaggagccgcctaacactgaggagttcgatctgatctatgtggcgtgtctc

SEQ ID NO: 44260 - DNA, 392 bp, Zea mays
  Clone ID: LIB3066-038-Q1-K1-E2
atagctgctggtcatcagagttcatcgattcgccatcagcagctcttgaaaggtcagctgcagcctggatctgatacgagacaagccgattactttgcaggaaggtctgctccagttcatcaagcatcccaggaaattggtgtatatggaagagttgatgctgataaccacaacatgtccattcttgggactactccatatggaagacagcaagcagcctcattgttggaaggagctccaaagacaaacattgacagcctctatggacaaagatcatcaagtgctggttttggtgcatgtcttcctcctggacgtgattatgcctcaaggaaaggcctgctccatccatcttcggatcctgattacccagatagcatcttaccccgtgtaca

SEQ ID NO: 44261 - DNA, 319 bp, Zea mays
  Clone ID: LIB3066-038-Q1-K1-E3
caggcgctcacgttctgcgacaccatgtacatgaacacgcaggacaccatcggcgcggggcagcgggccatcacgttcaaggacaccgccaccgccaagatcatgctgcatctcgccgatcaggacttcgactcgtgcgaccgaccctgcacccaagccggcgttcacaaccacatggggaagcttgacaaggagctcaaccagatggccaacaactgcatggctcttgcaaacatgatatgaaccacgcatgcaacctcagcgtgaggtgccatcgcatgcacggaatgcttgcattcagttttcatttaattgagaa

SEQ ID NO: 44262 - DNA, 343 bp, Zea mays
  Clone ID: LIB3066-038-Q1-K1-E4
ctggcatccactcgtgctgatccctctttttccccgcaccatcgatcaagcttgacctggcggagttgatcatgcatggtttgaggttcttgtgcagactaaggaaccaggagctggaagaacatgggagtgaatcatatcactccaagggactctgcccctcctgtataatcctctgaaactcgactcgctctgtcaccctagtttctactttctagctgccaggaggaagaaatgtactgtaactaacagcaagcaaagcataagaatctgcatggctcacggtgtaattgttttttaaaaaaaattaaataagaatatatcgaaattaattagcatatat

SEQ ID NO: 44263 - DNA, 194 bp, Zea mays
  Clone ID: LIB3066-038-Q1-K1-E5
gaataaccgggctgacccacgcgtccgcccaagagctcgcgcgcgacggccatcaacctgctccgtccgctcgcgctcctcggggccgtgctcggctgcgcactgagtccccacgccgatgccaccgtctgcgacgtcggcggccacgacaggtggatccagccgacggtcaaccacagcggcaggtacaacca

SEQ ID NO: 44264 - DNA, 413 bp, Zea mays
  unsure at all n locations
  Clone ID: LIB3066-038-Q1-K1-E6
agaggagaaccagcagcctccaataagagccagccagagaaactaataaaactctcgccggcgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgacgcctcggggccctccgccagcagcggcgcgcccgccctcgccgccgcgcccgccgcgctcctcttctccctcctcgcctactacctncactaagcgtgtgcgtgcg

SEQ ID NO: 44265 - DNA, 321 bp, Zea mays
  Clone ID: LIB3066-038-Q1-K1-E7
cgccgcgccatgactatgacgatagtcgccgtgctctgcctgctcctcttctctgggcggcgcgccgcggcggagaagactttccgcggaggtggatgcagatgctactgcgggttggaggccggtggcggaggcagcggcggctattccaccccgagcgaggcggcgccattcacgcctgccgctggggagacgactacccctccgtcaggcggcgggtacttcactcctagcgtggcggctccatccacgcctgccgcttaggagactacgacgactccttcgtcaggcggcagtggttacggcggtgcaaccggcaag

SEQ ID NO: 44266 - DNA, 244 bp, Zea mays
  Clone ID: LIB3066-038-Q1-K1-E8
ggaccggcgtgagggaaacctagatgacccgttcctgggtcgggaccagagagccggccgggctgcgccttcgatcgccgccccgtcgcctagggttcccgcgcctgtagatcgggtttgggggacgaggaaggggagtgccaagtaagggaacgatggggcctaggcgctccaagcgcgtttcgtgggccgacggggccaatctctgcaaggtattgtgattacgtccttgtcggaatgggtt

SEQ ID NO: 44267 - DNA, 408 bp, Zea mays
  unsure at all n locations
  Clone ID: LIB3066-038-Q1-K1-E9
ggcgaagggcaggcccggctccgtcccgttccatgaaggcctaacccgagcgggcaggcttttaagtagggcgcgagtgagagcgagcggccaatcggccgggagcgaagccagcgctagctgccgcctccctccccggtcctcgggtccgccgcgcgcgcgccggccgccaccaccgcacgacgccgaccaccacaattagctagcagcggcgtcgactaataaacgacaatggcgtccatctccctcgaggacgtccgcaacgagaccgtcgacctcgagaccgtcccggtgcaggaggtgttccagcacctgaaatgcagcaaggaggggctctccagcgccgagggagacaatcggctcaagatcttcgggcccaacaagctgangagaagtcggagagcaagc

SEQ ID NO: 44268 - DNA, 239 bp, Zea mays
  Clone ID: LIB3066-038-Q1-K1-D4
caagatggcaaatgctctcctaggtggcctgtgggcgatcgtcgtcgtcgcggtggtcgtgggcggggtcgccaccgtcacccactccggcaagaacgccggcgacgacttcaccgtcccgggggaagcctccattgccacgtacggcaagtcggtcgagttcctgtgcgcgcccacgttgtacaaggagtcgtctgagaagacgctcttccatgccaccaatggcaccgagaacccca

SEQ ID NO: 44269 - DNA, 392 bp, Zea mays
  Clone ID: LIB3066-038-Q1-K1-F1
cttggtctcaactgaggtcggactcgacgttgtcgacctcaaatcagggcaggagcgcaggctaagccagcctgggaactacaacgacttctatgtcttctcctttatgagcttctatactcgagactgtacaagcggctaggtaccgtgacccatgacgacacactaatcactgcaatactgacgcgaataatgagattgcctgtctcatctacagattcatcaagttgagtatgcaggtgctgtcatatgttcgttgcacgaatgacgtcatcgcaagaaacacatgccgtgaagccaacatattggtcggttatgctgctatgctctctagcatattcttagatgcataatgtatacgcagacgtatactttggtctcgtaatatgtgt

SEQ ID NO: 44270 - DNA, 322 bp, Zea mays
  Clone ID: LIB3066-038-Q1-K1-F10
cccacgcgtccggccacgcgtccatggtttcgtccgcaaccatgtccctgcacctgagggcttcggtaagcaactgcctattctcattgcatggtacaggatcatgaactgtcgccttatcctgctctctgtcctgcgctcctgtgcactggttgcggatgcgtttgacatacgtggccaaagtactgactgcatatcaacgcgccacaacgatccgttgctgacgaatagccgttctaccactacttaaaacgccattgcatcgcgaggaccgtatgatgcgtgccgcaatgttagccttagaccatgcattgacattcac

SEQ ID NO: 44271 - DNA, 358 bp, Zea mays
  Clone ID: LIB3066-038-Q1-K1-B4
gacatttcttcaagttttgaaaccatctactaagcagaagttacgttttgagggagattcggacaagaagacgttggcggagttcttgcaggccgtgccagcgtttctgggcggtaaatgcagctgcccacgatgtgagaagcctcgtaatagttcagtggtgcaggcaggggaagggagcaagaaccaggctcgcttggtcagcgttgatggcggatcacctgtcgtggacttcgacttcgatgaagaagagatcccatcaccttatagctgcgagaacgccatcagggctgcgataatctgcctgctgatggtgtgcatcttcatcgcgtttctggctgggatgaacgaccctgca

SEQ ID NO: 44272 - DNA, 408 bp, Zea mays
  Clone ID: LIB3066-038-Q1-K1-B9
ggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctggcgctgctggtcaagtacgtcgatggcgacggtgacattgtggcagtggacgtcaaggagaagggctctgacacgtacgagcccctaaagcactcctggggcgccatctggaggaaggacagcgacaaa

SEQ ID NO: 44273 - DNA, 429 bp, Zea mays
  unsure at all n locations
  Clone ID: LIB3066-038-Q1-K1-C1
tggcgcgcaacctgtctgtcacattgttcattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctncatctggtagcgaagacggcctacccattgaccccactccagaaggcagcatgaactaaattaaataccaattacgagaccgaccagatatgcatggagcatgcaagaatgttgtcgaacgaatatatgctatgaatggttacatgtactggctacatt

SEQ ID NO: 44274 - DNA, 222 bp, Zea mays
  Clone ID: LIB3066-038-Q1-K1-C10
acccactcgtccgcggacgcgttcgcggacgcgtgcgtttttttcaacgtctataccgaataacaatctatgtatccatatatcaacttacacagagaagttcactacgaaagcgaaagagacaataaacatcaaagttgaatcatgagacatatgcatgtacatatacataaatataaaagaacaattatactgaatctcgatatgtttacgcatgcatat

SEQ ID NO: 44275 - DNA, 428 bp, Zea mays
  Clone ID: LIB3066-038-Q1-K1-C11
cactgctcatcgtcctcgcggctgccgtcgcggtcctggccgcgcggccggcgtctgcgggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcatgacacgcagaactgcgacgaggagttcatgaag

SEQ ID NO: 44276 - DNA, 197 bp, Zea mays
  Clone ID: LIB3066-038-Q1-K1-C12
acccactcatccgtccacacgttcccgaacatgtacatgcttttcaacgacctgaccaattcctcgaccagggacactttcaacaccaatcgcatccacattggcaactaaatcggcatcacaatcaccaacaccatcatcaacatcggtaacgactgcatctacatctgcccctgcacctgcaacgtgaacatcaa

SEQ ID NO: 44277 - DNA, 314 bp, Zea mays
  Clone ID: LIB3066-038-Q1-K1-C2
cccacgcgtccgtccacgcgtccgcccacgcgtccgcgcgtggttcgttaggaaaggaaatggaggcccccagcatctgatctcttcggtgctagagaaatataggccgccgccgcctactactcattcggtgaaaggtgcgcagttagggttgggagatctcttgcctcacgacacgagcagcagaatttgtcgagggccgctggttgctgcgagaggtccgggccttcgtgggatcttgaaaattgaatgttctaatggagtccaaaggtggcaaagaagaagtctagcagtagacggtcctccctgatgta

SEQ ID NO: 44278 - DNA, 362 bp, Zea mays
  Clone ID: LIB3066-038-Q1-K1-C3
cccacgcgtccgcccacgcgtccgcccacgcgtccgggagcaactccttgggcaggtcgacacagagcagctgggagaaactgctgaaccagaggtcaaggtgctggacctgaccattctgtcacctggcagaccggacctgatccttccgatcccgttccaggctgacgagaagggctatgcgtttgccctcaaggacggcatcccctacagcttacgcttctgcttcatcgtcttcaacaacatcgtgtcaggcctcaagtacaccaacactgtctggaaaactggagtcaaagtggagacccataatatgatgctggggacgttcatgcagcagctagagccctatgtctacgagggcg

SEQ ID NO: 44279 - DNA, 354 bp, Zea mays
  Clone ID: LIB3066-038-Q1-K1-C4
tccacgcgttcgtccacgcgtccgcccacttttccgggagcaactccttgggcaggtcgacgcagagcagctgggagaaactgctgaaccagaggtcaaggtgctggacctgaccattctgtcacctggcataccggacctgatccttccgatcccgttccaggctgacgagaagggctatgcgtttgccctcaaggacggcatcccctacagcttacgcttctgcttcatcgtctccaacaacatcgtgtcaggcctcaagtacaccaacactgtctggaaaactggagtcaaagtggagacccataatatgatgctggggacgttcaatccccagctagagccctatgtcta

SEQ ID NO: 44280 - DNA, 214 bp, Zea mays
  Clone ID: LIB3066-038-Q1-K1-C5
cccacgcgtccgccgaggagatggctgccttcatgaaggatttcgacgagccggggcacggggcccttaccggcctgatcctgggaggcaccaagtacatggtcattcaaggcgaacctggagctgtcatccgtggcaagaatggatccgggggcatcactgtgaagaaaacagggcagtcactcatcattggcatctacgacgagcccatgac

SEQ ID NO: 44281 - DNA, 424 bp, Zea mays
  Clone ID: LIB3066-038-Q1-K1-C6
cccacgcgtccgcccacgcgtccgcccacgcgccgccctccccttcccctgctcctcgacgacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcatgagctgctgcagcccctcaaggagga

SEQ ID NO: 44282 - DNA, 401 bp, Zea mays
  Clone ID: LIB3066-038-Q1-K1-C7
actacatgttgcgtttgttctgcatcggcttcaccaagaggcgcccaaaccaagtcaagagaacctgctatgctcaggcatcccagatccgtcagatccgccgtaagatggttgagattatgatcaaccaggcttctacatgtgacctgaaagaacttgtttcgaagttcattccagaagttattggtaaagagattgagaagtctacctccagcatcttcccacttcaaaacgtcttcatccgcaaggtgaagatactcaaggcccccaagttcgatcttgggaaactcatggaggttcatggcgactacaaagaggatgttggtgtgaaacttgagaggcctgtcgagggagatgaggctgggcaagaggttgctgctgcccagtattttgtttgctac

SEQ ID NO: 44283 - DNA, 425 bp, Zea mays
  unsure at all n locations
  Clone ID: LIB3066-038-Q1-K1-C9
gtgccgagctcaggggcgaggcacgcatgcagaggaggcctgcacctcagaggggtgggggaagatacccttcgggccactgcgcagcgacgcgattatcgtcgagccccctatcgcggggttaccggtgatctcgtccgctcccagccggatacctcgttccattcaaaggcgcccctggcgtgggtgtctaccgaaggcgatccatacttcattctcgacaacgtcaacgagcgagatgtctgggctgagttccaggcacaggaccatgtaagggcattggcctcttctttgctgaggttgcttgtcccttagcatgtggtgatgggagtttcgtttctttacatgatctcatgctgcggtctattgctaagtccatcttcccccgccgcgaacggngggtctgggaagcactgcaacgccac

SEQ ID NO: 44284 - DNA, 372 bp, Zea mays
  Clone ID: LIB3066-038-Q1-K1-D1
tccttcccggtctcctccgcccgttgccttcgtcccctccatctccggctgcgacgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacatgatcaggccactgtggaggcattacttccaagacacccagggtct

SEQ ID NO: 44285 - DNA, 171 bp, Zea mays
  Clone ID: LIB3066-038-Q1-K1-B2
cggactcgtaggtcgactcagcgctttagttctgcttccagcagccgtaacgactgggtggggtgcatttacatacacggctggcctttcgagtgtctggctacgcacgcacatgttgtggatcttgtgttcgtaacactatatggactccctgagtctattatagaaatg

SEQ ID NO: 44286 - DNA, 68 bp, Zea mays
  Clone ID: LIB3066-038-Q1-K1-D10
cttccaaatcatacatatcatttcacaaaccacattgctaactatacaatgaccattaaactaacccc

SEQ ID NO: 44287 - DNA, 425 bp, Zea mays
  unsure at all n locations
  Clone ID: LIB3066-038-Q1-K1-D11
gtcctcgaccatccctgcaaattaccgctatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatcctncccacgctgctctccgtcaccgacaagaaactcggcgtcctcaactacaccagggccgacgacgggcagatgtacttc

SEQ ID NO: 44288 - DNA, 201 bp, Zea mays
  Clone ID: LIB3066-038-Q1-K1-D12
cctgtgcttatcttttcttatatatataccaccatttaaattctcgacggaatttttttgaccaccgtgagctgtcatatatgtcgtccattgatttgtgttaatctgacaaaagacgttgaaaaaaaaaaaaaaaaaaaaaaattataaaaatcaaaaaaaaaataataaaaaaaaaagcggtcgttctaaatgttccaa

SEQ ID NO: 44289 - DNA, 374 bp, Zea mays
  Clone ID: LIB3066-037-Q1-K1-H5
ggagagaactagcaaagggaaaatggctgcttccacaaacaacactctcagggtgctgttcaccctaatggttgcatgcgccgcagtatgcacagcgaaaaggaccgtatcaaagacaggagacttggcgccagtccctgctgcattaggagcaggaggcgccaccgcagccccagaaggtgcagctagagccagcaggacgttcgacatatcgaagttcggcgcgaccagcgacggcaagacggactcgacacaggtggtccaggacacgtggacgtcagcgtgcggagcgatgggagacgcatcgatgctcatccccaagggcgactacctggtgggccctctctacttcagaggcccgtgcatgggggaca

SEQ ID NO: 44290 - DNA, 243 bp, Zea mays
  Clone ID: LIB3066-037-Q1-K1-H6
cttgaggctgccttggagtgtcctcctgggtgcggtggtgcacaccgtgtgagtccacagagtggccacccttgtggtcatgaccggcaaagcaggccttgacacagttgtactggtgaacaatagccatcacctcacccttgatgctgacttggagtgtcctcctggtaccagcgcttttggtcacgtcgaagtgtatcctaacaggctgctgcttgtaggttttgacacaatggctgatac

SEQ ID NO: 44291 - DNA, 448 bp, Zea mays
  Clone ID: LIB3066-037-Q1-K1-H7
atgtgcttgcactggcagtctaaagtatgctcataggacttgtgtacatcgatggtgcaatgagaaaggagatgtaacatgtgaaatatgtcatgagccttatgaacatgggtacactgcacctcccagaggccatcctgatgaaactaccattgatataagtggtgggtggacaattaccggtaccgtatttgacttgcgtgatcctaggatacttgcagtggcacaaaaccacatcatggaagctgaatatgatgattattctgccacaaatgcgagcactgctgacttctgccgctctgctgctcttgttttaatggctctcttattgttgagacacgcactgactctaactgatgaagatgacgacgacactttagcgatgttttcactttttctgttgcgtgctgctggtttcctgcttccgttctacatcatggcttgggca

SEQ ID NO: 44292 - DNA, 394 bp, Zea mays
  Clone ID: LIB3066-037-Q1-K1-H9
aaggaatgcaatcctttcttgcggacctccaatccagaaattaagagaacactgtccgttccagatcatttcgatgaagatcgggtgcttggagttgtccgtcgagcaaaagataacttctgactaacaaaaggaaatgctcgtgacgtatgacccatatcttgttgaagttcagacagagaacctaagtcacaataaacataggaggaaatgaaggtatatatgtttgagctagattttgaaatgcttcggcaaaattatgtcgagtgtatgtagcttgggcagtgcagtgcttgtctatagcaaccaatgattcttttgaccactacaaataagcgtgttctgctatcatctactctttgtaaaaaaaaacgccacgtagcccgttcatagt

SEQ ID NO: 44293 - DNA, 349 bp, Zea mays
  unsure at all n locations
  Clone ID: LIB3066-038-Q1-K1-A1
cccacgcgtccgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgtaactgcgtggtctccggcaccatcgacttcatcttcggcaactcggcggcggtgttccagaactgcctcatcatcacgcggcggcccatggacaaccagcagaactcggtgactgcgcacgggcgcaccgaccccaacatgaagtccgggctcgtcatccagaactgccgnctggtgcccgaccag

SEQ ID NO: 44294 - DNA, 420 bp, Zea mays
  unsure at all n locations
  Clone ID: LIB3066-038-Q1-K1-A10
ggtgaaggtgttcagcaggcattgctgataatgctggaaggcacgatagtcaacgttcctgaaaaaggagcaaggaagcatcctcgtggtgataatatacagatagataccaaagatattctttttatatgtggtggcgctttcgtggatttggagaaaactatatcggagagacggcaggattcttctattggcttcggcgcaccagttcgtgcaaacatganggtcggtggcacttcaagtgctcaagtgacatcgtncttgttggaatcggttgagagtggtgatctaatagcttatggacttatcccagaatttattggacgtttccctatccttgtgagcctaaccgctctaaatgaggaccagcttgttcaggttctcactgagccaaagaatgccctgggtaagcaattcaag

SEQ ID NO: 44295 - DNA, 426 bp, Zea mays
  Clone ID: LIB3066-038-Q1-K1-A11
cggacgcgtgggggccgccgtgccggttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggcggcgggatggaaggcagcggcgggctgaagaaggtgccgtggacgcag

SEQ ID NO: 44296 - DNA, 425 bp, Zea mays
  Clone ID: LIB3066-038-Q1-K1-A3
gaatttccgagcccagagcgtccgcgtggatttaacatctactgtgtcggaatcatcgtttatcgtggtctgtactttgggctctgtgattccatcaagccagttgtccttactggcaacctccaggacaatttctttgccagtttcgctctgggttggctgatcactaatggtgctggtcttgcatcttaccccatcgataccgtccgcagaaggatgatgatgacatctggtgaggctgtcaagtacaagagctccttggacgcgttccagcagattcttaagaaggaatggcccaagtccctgttcaagggtgctggtgctaacattcttcgtgccattgctggtgctggtgtgctgtctggctatgaccagctgcagatcctcttcttcggaaagaagtcggctccggcagtgcttaaatg

SEQ ID NO: 44297 - DNA, 318 bp, Zea mays
  Clone ID: LIB3066-038-Q1-K1-A4
gatgaaggaacgtaagaacagggcgaagaatatccgtggtgtgaagaagacaaaagcgggagatgccaagaagaagtaagggaggaagttacttgccttgccatttctcatcttagtctttggtttgtttagggtgggctccttccggcaatgctgaatgtttagttagaagtagagaagattttgccaattacccatcacgttgagtttctcgttgcaccttctgttcagttttgaggcaccttctgttcagttttgaggcactttgtcagacacaagaatatatatacttggtcatcacggcttttgtcctgctag

SEQ ID NO: 44298 - DNA, 408 bp, Zea mays
  Clone ID: LIB3066-038-Q1-K1-A5
acccacgcgtccgctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcggctgatgtcacc

SEQ ID NO: 44299 - DNA, 96 bp, Zea mays
  Clone ID: LIB3066-038-Q1-K1-A6
cccacgcgtccggcggatgagtgcgacggctacgaggccggcccgctggtcgccgccgctggaaccggaaccggaaccattcccggttgaacccgg

SEQ ID NO: 44300 - DNA, 427 bp, Zea mays
  unsure at all n locations
  Clone ID: LIB3066-038-Q1-K1-A8
cccacgcgtccgcccgtggccgccacgaactgcttcaacgcggacgtgctgagggccacgacgcggcgtgcgctggcgaggtacgatggcccgtgcttggcgaccaaccccatcgaccggtgctggcgctgccgcgccgactgggcgacggaccggaagcggctggcgcagtgcgcgcgcgggttcggccacaggagcgtcagctgcgcggccggcaagctgtacgtggtgagggacccgagcgacgacgagatgatcatcccgcggaagggcacgctgcggcacgcggtgatccaggaccggccgctgtggatcgtgttcgcgcgcgacatggtgatcgagctgcggcaggagctgatcgtgaaccacaacangacgatcgacgggcggggcgcgcaggtgcacatcatgttcgcgcagatcacgc

SEQ ID NO: 44301 - DNA, 357 bp, Zea mays
  Clone ID: LIB3066-038-Q1-K1-A9
cggacgcgtgggggccgccgtgccggtttttcccagctgcagcaaccggccagtgcgcgcggtttcgttgcattttcatggctgctcgctgcgctctgggagcttgcactagcgggtcggcggcctaagcgcggggcatttttcgagtgcgtgcgtgtctgttcaagctctgatcgtctctccggcccattcgccggaagaaactgaccgtcgccttctcgctctcgctctctaccctattcccggggctgagaggggaggagagaaggccacgttcacaccataaagcaagacgtacagacacgtgtaccagggggaacacggtcggttgaagtgactaaactggctgacggaacg

SEQ ID NO: 44302 - DNA, 270 bp, Zea mays
  Clone ID: LIB3066-038-Q1-K1-B1
cccacgcgtccgcggacgcgtgggtcttgaccacctctcgaggcgcagagtcgtcgttggcaaataaaatcaaactgtgtgtttttagcgggcaagtgattggacgaaatgtaaaaaagaacgaaaccagaacagcagcgcgaaaaaaaaaaacaattcacgattctttcgagtaactgcaaaaagaaaattgtaaattggtagcaactcgtttcttgcccttggtggcaggattgaataaactgatcgatacggggagctgttcaattg

SEQ ID NO: 44303 - DNA, 367 bp, Zea mays
  Clone ID: LIB3066-038-Q1-K1-B11
gtgccgagctcaggggcgaggcacgcattctagaggaggcctgcacctcagaggggtgagcgaagatacccttctggccactgcgcacctacgcgattatcgtctagccccctatcgcggggttaccggtgatctcgtccgctcccagccggatacctcgttccattcaaaggcgcccctggcgtgggtgtctaccgaaggcgatccatacttcattctcgacaacgtcaacgagcgagatgtctgggctgagttccaggcacaggaccatgtaagggcattggccttttctttgctgaagttgcttgtcccttagcatgtggtgatgggagtttcgcttctttacatgatctcatgctgctgtcta

SEQ ID NO: 44304 - DNA, 228 bp, Zea mays
  Clone ID: LIB3066-038-Q1-K1-B12
cggacgcgtgggcggacgcgtgggtctttttttttctttatagtgaataacaatctatggatccatatatcaacttacacagagaagttcagtacgaaagcgaaagagacaataaacatcaaagttgaatcaggagacatatgcatgtacatatacataaatataaaagaacaaatttacggcgtctcgatgtgtttacgcatgcatatatccgcatgcatgcattgc

SEQ ID NO: 44305 - DNA, 383 bp, Zea mays
  Clone ID: LIB3066-037-Q1-K1-H4
cttacgcttaggcttcgtcttcaaatgctacattgtgttttcaacatcgtactactataatatgagcatgtattactacataatcatatcactattgcaggaagtgctctatttttcaatcgacaaacttctctggctctggactgacagctattttgagcatccgatctcgaacactctgcttcattgacttgcatttgcagctatctggtttcaaaatgccagcctgtatcacttgaccatgtcgcatgccttccatcgctaggagcccattatagcaactgaggacgacgtatgcgcaccatctagccgattgccgaaaggcgctcgttgaagcgaggatggtcgcgagtctatatcgcaccggcgtccgatatcctgca

SEQ ID NO: 44306 - DNA, 376 bp, Zea mays
  unsure at all n locations
  Clone ID: LIB3066-035-Q1-K1-E9
gcgacaacgtatgcaagacggagaagttcacaggcggcgagtgcaagatggacggcgtcatgcgcaagtgctactgcaagaaggtctgctagggcatgaccggcagcaagccccaaccgtacggctggttgatccggttgcacactgcacagctcgtttgggcacgcggtcatgttccggcttctcggctttatttatttcttctttgttataataaatagactctgttagtcacgtgcgttttagtctgggttgtacgttattaattctctagtgtattgtatttgcgcaacgcgctgtacttaacgtagccatgtattcgcgttgcgtggtggagaggccaacgatttataaaaaaaaaaaantaaataaaaat

SEQ ID NO: 44307 - DNA, 439 bp, Zea mays
  Clone ID: LIB3066-035-Q1-K1-F1
ggcgagcgagtgcggctgccgcttcctctgcgagtcaggcgccatttaataattcaattggacccccaagcccacgcttccgaattcaccgactcctcctacacgccgcgtcgagatcgctcaggccttcgcttccagcaactccaccactcagcccacccgccggagcaatggggagcacggggcgcgagccggaggttacccgcgccgactttcccgatggcttcgacttcggcgttggcacctgcgtgtaccagattgagggagcgagaagggagggaggcaaaagagacagcatatgggatgtatttacagatgacaaagaacatgtcttagacagaagcaatggagatattgcagttgatcactaccatcgatacaaggaagacattgagctcatggcaagtctacgttttagcgcatacagaatttctatatc

SEQ ID NO: 44308 - DNA, 199 bp, Zea mays
  Clone ID: LIB3066-035-Q1-K1-F11
cttaagcaagatggaccgcccggcagacacacacctgactgacctgatgaccatcactcaggtcattcttaactaacaaatcccttacctctattgccgctactacttcaccattctgctctaccacatcatcctatgctacaagtatatcacctccgtcagtcaacaaggccgagctctcccagctcatctgactcac

SEQ ID NO: 44309 - DNA, 442 bp, Zea mays
  Clone ID: LIB3066-035-Q1-K1-F12
gccacgcgtccgcccacgcgtccgctcacgcgtccgcccacgcgtccgtccacgcgtgcggaagagcgtcagccggttcaggaccttgctgggccgcccgtggaaggagcactcgcgcacgctctacatccagtcggagatcggcgggttcatcgacccgcaaggctggctgccgcggctcggcgacttcagcctcagcacctgctactacgccgaggaggaaaaccacgggcccggcagccaacatgaccagacgcgtcaagtggagggggatcaagaacatcacctaccagcacgcgctgcagaagtacaccagctagagcttcatccaatgccagcactggctcccacagctcggcgtgccattcataccggggctgctgccgcagcagcaatcgggcatgatacactgacatctaatgaagatgatatatgatcggca

SEQ ID NO: 44310 - DNA, 445 bp, Zea mays
  Clone ID: LIB3066-035-Q1-K1-F2
cccacgcgtccgcccacgcgtccgcccacgcgtccgagaccgaccccgtggccgtcgtgcagcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgtcgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgccgagcgca

SEQ ID NO: 44311 - DNA, 436 bp, Zea mays
  Clone ID: LIB3066-035-Q1-K1-F3
cttcaagttcctcccatgttgctgccgtcgctggttcaccctgccactggaccaggactggtttaacgccgcgagctaggcggccagccaagacacgtgcaggtgcagacacggtggcgccgttgagcgtggccggcagcaccggaggttcggatggtggcgcccccacaaacttcctgaggacccccacgtggaagacgtcgtggagtctggcgccgggcgggagctgtaggcggacggccacgtcgttgatgacttcctcgacgcggcgcggcgctgggactcttgagcctggtggagacggtagcggacgtcgtcgaggaaggcagcgcgctcctccatctcttgcgccaccgcgggagcgcgcgcattcgccggctcataggaccggatggttggcgggtcgcgggcgtacaccacccggaatggcgtgtcg

SEQ ID NO: 44312 - DNA, 443 bp, Zea mays
  Clone ID: LIB3066-035-Q1-K1-F4
cccacgcgtccgctcggctcggcgaacgcgatctgttccccaacctccgcagccgctcgaccggcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccgcatgcatctccccggatgtcattcagatgcttctgcggcatgtcaccaccgtca

SEQ ID NO: 44313 - DNA, 366 bp, Zea mays
  Clone ID: LIB3066-035-Q1-K1-F5
cccacgcgtccgcccacgcgtccgtccgtcgcgacgattcctctcctccgcccgggcccgaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgttgtcaaggacgtcgtgaaggatgcggcggcggccggcgaggtgatgacgcccgccgacgccgagaagcctatctctgtcgaccccaaggcagacgccatcccggtgatgga

SEQ ID NO: 44314 - DNA, 437 bp, Zea mays
  Clone ID: LIB3066-035-Q1-K1-F6
cggacgcgtgggcggacgcgtggggttgtagccccaagattgtgcagcacatattctggcagttattgtaaatttctctcaggataaatcttggcgtgtgcgctatatggtggcaaatcaactgtatgaactatgtgaagctgttggtactgagcccacaaggggtgatctggtgtcagcgtatgttcgccttctctgtgacaatgaggctgaagtgcggattgcagctgctggaaaagttacaaaattctgcaaaatattaaacccacaaattgcaattgaacatattcttccgtgtatcaaggaattatcatcagattcatctcagcatgttcgttcagctttggcatcggttattatgggaatggctcctgtattgggaaaggacgccactcttgaacaactgcttcccatttttctttctttgctgaaggatg

SEQ ID NO: 44315 - DNA, 405 bp, Zea mays
  Clone ID: LIB3066-035-Q1-K1-F7
atatgctgctgcctgacctgtataatctccgatctgggcgtccatgaggatttggatatgaacagaggcgctaccacagaggcaatcaataccttggtggcatacaagttccaatcaaagagggttcatgatggggatgtgggaggagatggtggtggagctttgaaacgttggaactgacagaaagcgagctattactagactaaaagctctatgctgtatctgcttgatcacgttttaatactacgaagacctgggcgaactatcctgtgcacatgcattccacacggaatgcatagataagtggatccagatgaacacgttgtgtcctgtatgcaaggctgagatcatgggatcataagcgtcctgtgatccatagagtgactatgaggatcccgacaacac

SEQ ID NO: 44316 - DNA, 438 bp, Zea mays
  Clone ID: LIB3066-035-Q1-K1-F8
atcaagttcaacggcggcggtcatgtgaaccattcaatcttttggaagaacctcaagcctattagcgaaggtggtggggagccgccacatgggaaacttggctgggccatcgatgaggattttggttcatttgaggcacttgtaaagaggatgaatgcagaaggcgctgctttacaaggatctggatgggtgtggttagctttggataaagaggcaaaaaagctttcagttgaaactacagctaatcaggatcctctggtgactaaaggtgcaagcttggttccgctgttggggattgatgtctgggagcatgcgtactacctgcagtacaagaatgttaggccggattacctgaacaacatctggaaggtgatgaactggaaatatgctggagaggtgtacgaaaatgttcttgcttgaattgtcttaatggacaat

SEQ ID NO: 44317 - DNA, 432 bp, Zea mays
  Clone ID: LIB3066-035-Q1-K1-F9
cccacgcgtccggcatctcgcccgccgttctcgtccttgtagatctcctcgcacctggcccgttcgcttcaccaagggtttaagaccggcggcgatggcggcgaagctggcgcagctgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgattgtgtcaagcaggtatggaagaacaggaaggacctcacggttgaggaccttggcattgccagtttgtttggagttgagctctatgcatggttctgcgtaagcgagattgtcggcag

SEQ ID NO: 44318 - DNA, 431 bp, Zea mays
  unsure at all n locations
  Clone ID: LIB3066-035-Q1-K1-G1
cccacgcgtccgcccacgcgtccgcccacgcgtccgcccacgcgtccgaccattaattatattctctctctctctctttcatttctatagccagcaggtagcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcangcggtggagttggagatggagttggtgcctgctgatgcaattgcgatgactatggatcatgagccgccgcangagtgcgcgaccccggtgagcgtggaggaggcgtgccgcggcgcgtcggagacgcacgccggcgtggcctacgaccactgcatggcgtcgctgggcgccgacccgcgcagca

SEQ ID NO: 44319 - DNA, 426 bp, Zea mays
  Clone ID: LIB3066-035-Q1-K1-G10
cttctcaccgcatcacctctccctccggcgcgcgcgtccgggtacagcgctagagtcactggccaccatgcaagcggcggcggcggcgaatggcgcgggcgacgtgcagaagcctcagcagcagccgctggtggcgggggcgccgcccccaccgccggcggcggccgtggtgccgccccattgggtcgccatgccgttcgcgccgcctcccggggccacggccatggtgatgcagccgcaccatatggcgcctccgccgccgcagttcgcgccgactcacttcgtgccgttccacgccgtcgcgcgggcaccgtcggtgccagcagcggtcgcactgggttccccagcgccgcatcagcccgggcaggaggagaacaagagcgtgtgggtcggcgaccttcattactggatggacgagaactatct

SEQ ID NO: 44320 - DNA, 185 bp, Zea mays
  Clone ID: LIB3066-035-Q1-K1-G11
cctgttctcgccatcggcgcagtccttcggtagcggcagcggcagttcgcatcattgggagaattgagcaataatgcaatataaggatggatgattgttgctgcttgagcccattggtgccaatgtacataggaagagcaggagcatgccggcatgaaaatttggagcctttttttcagtgtgtc

SEQ ID NO: 44321 - DNA, 405 bp, Zea mays
  Clone ID: LIB3066-035-Q1-K1-G12
cgtgcttacgctctcgtctcggctttgctgttgaaggaccagctgctagacgtggtgcactaatatccggagcatgtactgcacttcttcaatcgttgtatctatttataagttgtaatgttacttgaaaacagtgacaaggtaattatttacctgtctaagcagttgctgaatcaataaggaaaaaacacaacacatcatgataataatgaggcaatgcaaatacgacttttgtattgcttgatctagctagggtttgttactgcttgatctagccaggataagaatgccaaaacgatcccttaaattcaaaggccccaacgactgaatgaaagcagatccaaaaaaatgctcaaaaaaaagagcagttccacaaatgttccttcccctacctatggtgacctt

SEQ ID NO: 44322 - DNA, 439 bp, Zea mays
  Clone ID: LIB3066-035-Q1-K1-E8
tgctattactagtatagtacgtgataaaaggcagccaggctggtgtgtgtggtgcagggtcttccatacacgcgcaagcatggtgccagtgccacgttccggcaggtcacatgggttggaagccggacggacggggtagggcgtccggtgctagtagcctctgacgaaagagacggaaggctgctttcgtgacattctattctatttgggggggtctaatccgccgtctctctgcagttttcttgttgcgtgtagcggtagtgcagcagcagtactacgttaaaaaaaaagaaaccgcgtggtgcatagtggagcacggggtttcgagaaaagaaagacgaccgggccacagggaaaaacgcccagagaagcctcaaaaaaggcaccctactaccttggtggtggtggcagtggtaggaacagtagacgacagcacgct

SEQ ID NO: 44323 - DNA, 191 bp, Zea mays
  Clone ID: LIB3066-035-Q1-K1-D2
tgcatgtgcacgcgtgagtatttgcttttccgtacatactctatgtatgaacgtgtgcgtgtgtgaactaactacatgagacgacaaggtgcaagagacatgtctggggcatcatttgtatggctttaatttttgttattatatatagataaggaaatatcttccttaaaaatggagtacaagggattgtt

SEQ ID NO: 44324 - DNA, 427 bp, Zea mays
  Clone ID: LIB3066-035-Q1-K1-D3
cggacgcgtgggcggacgcgtgggcggacgcgtgggcggacgcgtgggccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgc

SEQ ID NO: 44325 - DNA, 429 bp, Zea mays
  Clone ID: LIB3066-035-Q1-K1-D4
cctaccgccgccgtcgcaggcacggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacatgcaagcggaggagttcatcaccaagttctatgagcagttcaagtcagaatcgttcaacggccgtgcctccgagtgatccattgatccatccgcttgcggcatgtatgtaatacgtctgatcttacgccgaaattgcattcgcgtcagatacgactctagccaatatggatcaggaagaaatgtatcagtgatcgcattgataaacacagtgtgtctgaactataaactattgtgtgacatcattctattcttcaacaaactaaa

SEQ ID NO: 44326 - DNA, 412 bp, Zea mays
  Clone ID: LIB3066-035-Q1-K1-D5
cctgattcaagaagtgcaacacacagattgtcattcctcacctaacagagaactatggggcatccagagatccaccagaaaagcaggcacctatgtgcactgtacattcgtttcctcacaacattgatcactgcctgacatgggctagatctgagtttgaaggtctacctgagaagactcccactgaagtaaacgctttcctgtcgaaccctggtggatatgcaacggcagcaagaactgctggtgatgcacaggctagggaccaacttgagcgagttattgaatgccttgagacagacatgtgtgagacatatcaagattgcattacctgggcccggctgaagtttgaggattatttcttcaaccgtgtaaagcatctgacattcaatttttctgaagatgcattaactag

SEQ ID NO: 44327 - DNA, 184 bp, Zea mays
  Clone ID: LIB3066-035-Q1-K1-D6
ggcaaaggctctcctaggtggcctatcttcgatcctcgtcgtggcggtggtcggcggtgtggtcgccaccgtcacccgctccggcaagaaggccggcgacaacttcacggtcccggtggaggcttccttgccacgtccggcaagtcggtcaagttcctgtgcgcgctcaccctatacaaggagt

SEQ ID NO: 44328 - DNA, 405 bp, Zea mays
  Clone ID: LIB3066-035-Q1-K1-D7
cccacgcgtccgcccacgcgtccgcccacgcgtccgggttggatcaaggattaatggaaggttactcctgcccaacttgtcggagaccgctcgtattgtcatctgaagggcaaacaaggtctccgattgtggaggcagcaaatgttcagcgaatcgcagaacagcttactatggggatgaatcagcagagagtttctggtaatgaacatcctgttgaacagcagaacccttcagatgctgtttggaggggtgctggtctggatgctagctggattccaccgtggtcaagccctgtgatagataatcccagttcctctagtgcagtgaggtcagtaggtctttctggagttcagatgatgatgaggcagttggcttctgtgaccgacagttatgggcatgctgatg

SEQ ID NO: 44329 - DNA, 440 bp, Zea mays
  Clone ID: LIB3066-035-Q1-K1-D8
gtcaaccgtcatcgctttctccccctcccccgtctcttctccctcgagggaataagcccgccgcgtgaagcttcttcttgcatccgagtgcggattcacctccaatctgcccctcgggccgccggcgccgatggagaaggtgaagaacatgctcaagccgcggccgacgccgcagcagcagctgcgcgagtggcagcgccgcctccgcaacgagtgccgcgtcctcgaccgtcagatccgagatgtgcagagggaggagaagaacgtggagaaagccatcagggaggctgccaagcgcaatgacatgggatctgcaaaggctcttgctaaggaacttgtaagatcaagacgtgctgttaatcgtctttatgagaacaaggctcaactaaattcagtatcaatgcaccttggagaaattgtcgcaactgcaagaacagtgg

SEQ ID NO: 44330 - DNA, 413 bp, Zea mays
  Clone ID: LIB3066-035-Q1-K1-D9
gtcgtcgtctcactcaccccgccttctcgcctccctcaccaaataaggtcccgccctgttgggacattcacaggggggacaggaaatcatctgccttggcctcgattccggctactaccttcgccgtcatcttatccgttctattctgtgccgcggctggcaccgtcgtctacaacgaccttcccgactacgtcatccatggccgagtctactgcgacacctgccgcgcccggttcgagaccaatgtcaccgagtacatctcggacgccaaggcgaggctggagtgctagctcttcttcaccggcaagctcgagcgctccatcgacagtgtgaccgacgcgatccgcacgtactctatcgtgctcaacgacagggacgatgatgacatctaccaagtggtcctggtggaaagc

SEQ ID NO: 44331 - DNA, 245 bp, Zea mays
  Clone ID: LIB3066-035-Q1-K1-E1
tttccttctaccgcagcctcagaattcctccctcccccgtagcgaaaccctagccgccacgccaaaaccaaatcccgccgagcccgaaattttccggcgggttccttgccgcgaatcgatggatttcgagcgattcgactccttggggatctctcggcggggtaaagcgcggtcgaccgtcggccatgtcaaggtgcttcccctacccgccaccggggtacgtgcggaacccattggccgtggcc

SEQ ID NO: 44332 - DNA, 434 bp, Zea mays
  unsure at all n locations
  Clone ID: LIB3066-035-Q1-K1-E10
cggacgcgtgggcggccgtcgagcgagcagtctcccaattccacccaataactaatgacatgtcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggtcggaggtgcggctggccctagcgcaagctgcgccgccgccgccgccgtgcccgacgccggggcgctcgtcggctacttcctcgcctactacctccactgagcgacgacgcgcggggcggcaacgttgggatgcatcgtgtttggttcatccgattaattaatcgttngttttattgacgtggtttgcgattggttaa

SEQ ID NO: 44333 - DNA, 427 bp, Zea mays
  Clone ID: LIB3066-035-Q1-K1-E11
gagctcctcgggaatccggtgccaggcctcgccttctcgcggcggtgctccctccctcttggtcccccagcgacgcaagcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcaccaccaccagcagcagcaaccgcagccgcggaatgccggcatggacaccc

SEQ ID NO: 44334 - DNA, 426 bp, Zea mays
  Clone ID: LIB3066-035-Q1-K1-E12
cattctctctctcctctctcggccttcttcgcgtgtttccctctttttcttaagccgccctgtacacttctcgacataaccatcgagagggcggtcgagagaaacgagagcggcagacaccatggggagctcgaggaccatcgttgcgtcccccctgctcctactcgccctgctcctcctggctttcgcggccaccgccgaggcccgcgttgtccccgagctgtttggcgaggaccaattccagcggacatgcaaccaggtgcacttcacgaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggccgatagagtc

SEQ ID NO: 44335 - DNA, 345 bp, Zea mays
  Clone ID: LIB3066-035-Q1-K1-E2
cttgcatgtaccggaatctctctcaatatccttttcacgactgtagcatatagccctgggagggatctaatctataacggacgagcgaatgtgctggaaaatctcatgcatcgaataggatatactccatcgaatcttctcaataatgatgtgtccatcatcctgaggccgctatgcatgtcagatattcatgaagcaaataactatgtggatccatgctttatcaagttcaatttgaaacgatgcgaatgcagattgacactttacaacttgagaaataaactaatggcagatctaatgttataatacattgtaaactctaaaattcttgtgtctgaaattttt

SEQ ID NO: 44336 - DNA, 428 bp, Zea mays
  unsure at all n locations
  Clone ID: LIB3066-035-Q1-K1-E3
cggacgcgtgggctctcgtcgtcaagcatgatgtgagaggagccggcggcggaggtgagtggcgggtggagtaccactgctgctcggcggcctntttcgagcacatcgtcatcatcatcgtgctcgtgctcttcgcgggcctcatgtcgggcctcaccctgggcctcatgtccctcagcctcgtcgatctcgaggtcctcgccaagtacggcaccgagcaagatcgcaagcacgcagctaagattttacctgttgtgaagaaccagcaccttctgctatgcactcttctaatctgcaatgcggctgcaatggaggctttgcccatattccttgatagcttggtgacagcttggggtgctattttaatatcagtgacactgattctgctttttggtgggatcttaccacagttcatctgctcacattat

SEQ ID NO: 44337 - DNA, 66 bp, Zea mays
  Clone ID: LIB3066-035-Q1-K1-E4
cccacgcgtccgaaaaaaaaaaaaaaattttattaaaaaaaaaaaaaaaaaaaaaaaaggggaagt

SEQ ID NO: 44338 - DNA, 437 bp, Zea mays
  unsure at all n locations
  Clone ID: LIB3066-035-Q1-K1-E6
cccacgcgtccgcccacgcgtccggaggtagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgnctcggggccctccgccagcagcggcgcgcccgccctcgccgccgcgcccgccgcgctcctcttctccctcctcgcctactacctncactaagcgtgtgcgtgcg

SEQ ID NO: 44339 - DNA, 433 bp, Zea mays
  unsure at all n locations
  Clone ID: LIB3066-035-Q1-K1-E7
atgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactncatcatgaagtgcgacgt

SEQ ID NO: 44340 - DNA, 420 bp, Zea mays
  Clone ID: LIB3066-035-Q1-K1-D12
ggagagcgccggcgacgcgctgctccgcgttaccaaggacgccaacgcctacaagagggtggtcaagggcctcatcgtgcagagcctgcttcgtctgagggagccggcgctggtgctgcggtgccgagaggcggaccggagcctggtggaggcggtgctggaggtggccaagaaggagtacgccgagtaggccaaggtcaacctccccaagatcatcatcgacggcatggtctacctgccgccgcagaggaccagccgcgacgcgcacgggccagcctgctccggcggcgtatgtgctcgcgtcccatgacggcaagatcgtctgcgacaacactctggactccaggctcaacgtctactgcaggcgtaagcttcatgagatcatgatgaaactctgcagctagcgagtatcgtgctaat

SEQ ID NO: 44341 - DNA, 127 bp, Zea mays
  Clone ID: LIB3066-035-Q1-K1-B6
cccacgcgtccgaaaaaaaaaaattgctttaaaaaaaagaaaaaaaaagataatgggaggggtaaataaggaagaagggcataaataaatcaaaacattcgatgtcttccttaaaaaaatatgaggt

SEQ ID NO: 44342 - DNA, 409 bp, Zea mays
  unsure at all n locations
  Clone ID: LIB3066-035-Q1-K1-B7
gcctcctgcacaccgcgtgcggcacgccggcgtatgtcgcccccgaggttctcttgaagactggctacgacggcgcgaaggcggacatctggtcatgtggcgtgatcctcttcgtgctcctggcaggctacctcccgttcaacgacaccaacctgatactggtgtaccggaagatcacacagagcaactacaagtgcccaccgtggttctctgtcgaggcgcgcaagctcctcgccaggctgctagaccccaaccccaggactaggatctccatctcaaaggtcacggcaaatccctggttccagaaaggactctgccctctcaccaccgacaagcccctcgacttgtgggagacctccgaggtgctcggcaaggaaaaagcctgcaggtgccgncaccaccagcgcga

SEQ ID NO: 44343 - DNA, 439 bp, Zea mays
  Clone ID: LIB3066-035-Q1-K1-B8
aattgaataaccatatggctcaaggttatgggagaagggattacagagataatgacttgagagttaggcctgagagaagacactcaccctatgggaggttttcccctgaaagagatatcaggcgtcgttcatttcgtgataagagacagagagcaagttctgaagataggggatctagtcattcaagatcacctattaggaagagtgagagaaaacatagcaaaagtcctgatggtggaaaaaccgattcatccgtaagttttagaagttcagataacgaagacaaaggaaaagatgaaaggtacttaagcagtgatgagaaaaatggccgtgaagaacaattgaaacaaatgcatctggacatggaagcattgcgtgaagataaatcatagctggaggcgatattggagaagaagactgatgaagagcgcaaactttg

SEQ ID NO: 44344 - DNA, 459 bp, Zea mays
  Clone ID: LIB3066-035-Q1-K1-B9
gaattcccgggcggacgcgtgggcggacgcgtgggtgaaacgtgaccacaaatcaacattaacattatggaatgggattacagatatgcgactagcataatgaataagttccaagattgtgaggcgtcggtctaataataattacatcggttggttttgagatgatccaaagaagaaagaaaatacaaaccagcggattatatattcggaggagacttgagagtacgtgagaaagagagaggttacgaagagtgattatatatataatatatgcatgttagtcaattggttcagatgcaggcgagctcctttgccaagccgatggacttgccgatggcgttcttgcagactgccatggtcttgttgccggatccattgtacttgatgtcgacgttgacgagctgcacgccctggcatggcatgttgttggcgcagttgaacgtgatggccttcggcgtg

SEQ ID NO: 44345 - DNA, 407 bp, Zea mays
  Clone ID: LIB3066-035-Q1-K1-C1
gaggaagaactcgtggcacgacggcatgccgggcaccatgtgcccgatccagcccaacaccaacttcacgtaccactggcagcccaaggaccagatcggcagcttcttctactaccccagcaccggcatgcagcgggcggcgggcgcctacgggctgatcagcgtacacagccgtgacctgatcccggtccccttcgacacgccggccgacgacttcccggagctcgtgggcgactggtacaccaaggaccacgccgtgctggccaagaacctggacgccggcaaggggatcgggcggccggcggagctggtgatcaacggcaagaacgagaaggacgcgtcgaacccgaccatgtacaacgtggaggccggcaagacgtaccggtttcgggtgtgcaacgtgggca

SEQ ID NO: 44346 - DNA, 435 bp, Zea mays
  Clone ID: LIB3066-035-Q1-K1-C12
cgtcactggggagttctccatggccgtggttcatgccaaccagctcctcgaggaccagagcgcaagtagagtccggatcgctctccctggctgacccgggcccacagggcaccttcgtcggcgtctatgatggccatggcggcccggagacgtcccggttcatcaatgaccacctcttcaaccatctcagaaggtttgcaactgatcacatgtttatgtcagcggacgtgatccggaaagctttccaagcaactgaggagggctatctttctctagtcagcaaggaatggtctttgaagcctcagatcgcttcagtgggctcctgctgccttgttggcgtaatctgtgctgggactctctatgttgcatacgtgggcaactcacgtgcagttctaggaaggctagttaaggcatctggagaggctgtggccatgc

SEQ ID NO: 44347 - DNA, 425 bp, Zea mays
  unsure at all n locations
  Clone ID: LIB3066-035-Q1-K1-C2
ccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagcaaggaaatcaccgncctggctcctagcagcatgaagatc

SEQ ID NO: 44348 - DNA, 404 bp, Zea mays
  Clone ID: LIB3066-035-Q1-K1-C3
cccacgcgtccgctctacccttccctcgcgccgccgccaccgcaagagtatctcaactgcgcctcgagacctccccccctcgctggtctcagccatggtgaaatattcgacggagccgtccaaccccaccaagtccgctaaggccatgggccgtgacctacgtgttcacttcaagaacacacgtgagacagcttttgcccttaggaagttgtcactcaccaaggccaaaagttaccttgaggatgtgatcgcccacaagcaggccatcccgttccgcaggtattgtggtggtgttgggcgcactgctcaggctaagtctcgccactcaaatggtcagggacgctggcctgtcaagtctgctaaattcattctagaccttctcaagaatgcagagagcaatgctg

SEQ ID NO: 44349 - DNA, 404 bp, Zea mays
  Clone ID: LIB3066-035-Q1-K1-C4
accggatcggattcccggccagacctacccgtacgcgccgcatccgaaccatgtcttgtgcttgcgagaacgccagtgtgaccgacccgacgaagggaacagcgcaggtcacgcacagccagatgatccatggtgctactgctaactacactgatgctgcagacctgaagtggcgctcttgccggacaactgacgacctgcatatgcagaactgttttcgttatcgtgctgtttcatggagcctgcgctggtctgaatcctcctgcagcactggcaccatctcatactctgaccggtcttcctcctccagttatacgtccaccacaaggctcctccactgcttaggttcttggacgacaaagacggccacatctaactcgtgcacacgctgtgacagcttgacc

SEQ ID NO: 44350 - DNA, 429 bp, Zea mays
  Clone ID: LIB3066-035-Q1-K1-C5
atgggccttcaccaacaggaaggatccaccaaggagtttgttcaacatggatgaagaatacaattcctctggaatatagcgaagaatgcagctgggctcccatctttgtgaggcagtcaaatttcaagttacctgctgatccgtccactcctattatcatgattggtcctgggacagggctggctccttttagaggcttcttgcaggaaaggttagcattgaaacaatctggggcagaattgggcacttcaatccttttctttggatgcaggaaccgtaatatggactacatatatgaagatgagttgcaaactttccttgaggagggggcgctttctgagctaattgttgcattctctcgggaagggccaacgaaagaatatgtgcagcataagatggtggaaaaggccacagatatttggaacatca

SEQ ID NO: 44351 - DNA, 426 bp, Zea mays
  Clone ID: LIB3066-035-Q1-K1-C6
acccacgcgtgcgcccacgcatccgtatctttcctgtcatagaaagaacgacagaaagaaagaaagagagacggaacgaaagaaagtcgcacatcgcttgatgatgcattgttcaagagctcactacattaatgcgctgacatgtatggtgcttctgctggacaaatgggagcaagatatcctgacatgtttctggttctcctgctgcttcatggagccagtgctgctttgaatcctccaacagcacggccaaaatggcatactctgagcggtcttcctcctcaagtcatacctcgaggacgattctctgcgaccgcataggcttctgtaagacaaggctgacccttgataactcgacgactcgctctgagatcttgcccaagatggacaggacgtacaatctgtaaggagaggatgtcctactat

SEQ ID NO: 44352 - DNA, 166 bp, Zea mays
  Clone ID: LIB3066-035-Q1-K1-C7
cccacgcgtccggcgacgcttgccgaaatagtgtaccacaggtgcgaaaccaacactgcagcagacagaatgactgcattttcctgacctgaataatacgttgattgtgcgtagtaaagctgtgacatccatcgttgaacagtaccgatcagacaaccggacagga

SEQ ID NO: 44353 - DNA, 432 bp, Zea mays
  Clone ID: LIB3066-035-Q1-K1-C9
cccacgcgtccgccacctccatccgtgcgcctctcgctctcgctggtggtgctcctgctggtgctcctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttac

SEQ ID NO: 44354 - DNA, 433 bp, Zea mays
  Clone ID: LIB3066-035-Q1-K1-D1
gaaaaaatctacgtccagttcatccaatgtgcagattgaggaaagcagggaagcaagacagaaattctcaaaagcgaaatcaatttcttcctctcagttttttggtgatcaggccagttttgaaaaggacgctcaagtctctctccaaaagttttctggttcctctgcgatatcaagtgctgacctatttggccatccggcaaacaattctagcgtggatctcagtgcttcagatttgatcaacagaatctcgttccaggccactcaggatctgtcttctatcaagaacatggcaggggaaaccgggaaaaagttgacatcgatggcatccaacatcatcactgatcttcaggaccgtatcctctgagctttaaactcacagtaaacttctgcgttgtttcagtggctggcttctcccgtcgacccgggtgac

SEQ ID NO: 44355 - DNA, 387 bp, Zea mays
  Clone ID: LIB3066-035-Q1-K1-D10
cgtgcgtccacgcgtccggacctgttcttgaggctgtttgttctcaagatctagttttccaaccggggggagtctccagaagttcgctcggcggcatcgctttcttgttgagcatggtgcatgtcaagatccactcattgtttcaggtgcactctttcctcagtgctacattctacctgagatgtatcaagattcgctacacaatttttttcttcccaactggacagattggcaaccttgcagatactcgtaatcggactctgcatggtgtttgaagggttcacagctgtttcatggggcatcaagcccgccgttatgccagataaccaacacgaacagttttgactctttaatcattcatttctggtgagaatgcaccgcaaatct

SEQ ID NO: 44356 - DNA, 393 bp, Zea mays
  Clone ID: LIB3066-035-Q1-K1-D11
cggcccgaccgatcgcgtccgggctgttcttcaatcaagaaaacgtctcgttttgataactatacaatctgcatgtggggaagtccctcatatctgcttcgggcagagctatgcatacaagtggtggacgcctgctggtaaattgtttatcaagatcgctcgagcatataaatttactcctattatcttctaggatagatttggcacaccattccccttcccaaaacccatgcatgtgatcttgggtaaaccaatcgaagtcaataagattccccatactacaatcgacgagacaattgcaacagtatgcatgttcttggcgggaaaagttgaacaaacacccaaacctctgaaagatgtcatacttctttcatatgagatcatccacaaaaa

SEQ ID NO: 44357 - DNA, 429 bp, Zea mays
  unsure at all n locations
  Clone ID: LIB3066-035-Q1-K1-B5
ggaagaaagacctcgtcagcagcgcgctgtaccagccgctggagaaggagggccagcagccgccgccgcaggaagagcagccgcagctggagccccccgtgtcggccttcatggagatgacgacggaggaggagcggcggaggggcgacgccgggtgctgctgctgcggctgctgctggttcgattactcttggtgctgccggtgcccgtggtggcgatgcggctgttgcatctgctcctgccccagcttctgccggtgcggctggtgcacatgagagatccaggagttggcgggagatcacttgttgcccggaacttcatttggtctcacgagaacgagatccgcgtcgcgcgcacctnctgcttgtgttttcggaggattattcggcagacagggtttggcgttggcatgtgcacgtcagctgacac

SEQ ID NO: 44358 - DNA, 92 bp, Zea mays
  Clone ID: LIB3066-056-Q1-K1-D7
attcaaagtctagtagaattgtgcgctggaggtgtcgacggcgttaggtcggcgaatgcacgggatgatttcttggctcgatgacctatttg

SEQ ID NO: 44359 - DNA, 475 bp, Zea mays
  Clone ID: LIB3066-056-Q1-K1-D8
cccacgcgtccgcggacgcgtgggcggccgagaccttcttcgacatcgagatcgacggcaagcctgcaggccggatcgtgctgggactgtttggggacaccgttcctaaaactgcagagaacttccgagcactttgcacaggggagaaaggaattgccaagtccggcaagcctctgtggtacaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaaggtggtgaaagggatggacgtcgtgcgcaa

SEQ ID NO: 44360 - DNA, 448 bp, Zea mays
  Clone ID: LIB3066-056-Q1-K1-D9
gtcatctgcaacgtgccggagttccgcaacaccacagtcaaccacgacctgcatttcatttcctgggacaacccaccgaagcagcaccctcactacctcacgctcgccgacttcgacggcatggttaacagcaacgcgccctttgcaaggaagttcgggagagaagaccccgtgctggacaagatcgaccaggagctactgggccgccggcctgatgggtttgtgcccggcggatggacgtacctactgaatgcgacgactgaggaagggagacccttcgccgttgagcgcgtgcaggatctccgcccagggcctggtgtggacagattgaagaaactcgtcacgggcttgctcacacaagaaggctttgatgacaagcactgcttgtgagactgccccccagtaagatgattctggctgggggcggtagattacacggtcagatctt
